United States Patent 6,639,063 (EST'S AND ENCODED HUMAN PROTEINS) - sequence listing, part 2

SEQ ID NO: 2583 - DNA, 478 bp, Homo sapiens
  CDS 110..328
agtagttgatgtgtaaagagatatccaagtggagatgccaaagtaagagatgtagacctgtggctcacaagagaaggaagaggtcattgagatctgatattcctctttaatggcgtataagttacctgtggaggatgtccaccctctatctcggccctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttcagttaacaaaagaaaacatttaataaacattcaataatgaaaaaaaaaaaaaaaaaaaaaaaa

SEQ ID NO: 2584 - DNA, 647 bp, Homo sapiens
  CDS 355..609
atgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgrggttccgggaaggggctaggccggcttgaaaagagattatgactgtaccttttaactctgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaawaatcgttcatctcaatttggaagtcttgaattttagagatggattatcttgcatgccagagcgctggatgg

SEQ ID NO: 2585 - DNA, 476 bp, Homo sapiens
  CDS 166..420
  misc_feature 71,375: n=a, g, c or t
aaaaaaagaggtagattatgastgtaccttttaactctgtagctggaacacaagaagtgtttgtttaatgnatgacgtacacatttaagatctgtttggacgcggaggataatcctgtgaattgctaatagttsactgggtttggcccttagtgttgacttsagtatgctgagacggaaaccaacacgcctagagctaaagcttgatgacattgaagagtttgagaacattcgaaaggacctggagacccgtaagaaacagaaggaagatgtggaakttgtaggaggcagtgatggagaaggagccattgggcttagcagtgatcccaagagccgggaacaattgatcaatgatcggattggttataagccccancccaggcccawtaatcgttcatctcaatttggaagtcttgaattttagagatggattatcttgcatgccagagcgctggaatggaataaaatgatggcaga

SEQ ID NO: 2586 - DNA, 482 bp, Homo sapiens
  CDS 119..334
ctaagaaaaattcttctgccttgagattctgttaatctataaccttacccccaaccccgtgctctctgaaacatgtgctgtgtcaactcagagttaaatggattaagggcggtgcaagatgtgctttgttaaacagctgcttgaaggcagcatgctccttgagagtcatcaccactccctaatctcaagtacccagggacacaaacactgcggaaggccgcaggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaaagcctcttgcagttgagacaagaggaaggcatctgtctcctgcccgtccctgggcaatggaatgtcttggtataaaacccgattgtacgttccatctactgagata

SEQ ID NO: 2587 - DNA, 560 bp, Homo sapiens
  CDS 372..539
acttgtttcctgagttgtcctgtgctggaggtctgctcagacgaaggtctccatggcgttagaagtcttgatgctcctcgctgtcttgatttggaccggtgctgagaacctccatgtgaaaataagttgctctctgggacttggtttgatggtctcagttatcccagttgcagaaagcagaaatctgkawawaatttgsggwtgrawttaammatctgggraatgggctgccctgcaaatcgggatacatacatatgtatatgaagtttatatatcttgttcgtgattgtggcatcaggacaagggyyagtttctgaggaaactctcctttttcaaaccgagctgtactttaccccaaaggaatatagatcatgaccctcaggaaatccatttgggagtgttccacctctaggaaatcagtgtggcttacaccagtttctactgagaatgaaataaaattggatccaagtccttttattgctgactttcagacaacagcagaagagttaggattattatcttctagtccaaacttgctctgagctaaaggagaatggaac

SEQ ID NO: 2588 - DNA, 541 bp, Homo sapiens
  CDS 247..501
  misc_feature 494: n=a, g, c or t
atgtggtacatgactttatacatttccatctggaaactgaagtgttcaaatatatgtaaactatttggaattttgtaaatgatattcatttatgttgcgccacttaaaatctagtctctccgaggcaaagatggagctgagaagaaaagatcaatctctgcgtcastcaatagacatcttacccagctggagcaggacaagcgtcgactggaggagaacatccatgatgcagagagtgccctccgcatggcagccaaagacaaagaatgtgttgctaatcacatgagagcagtagaaaatacgcttcacaaggtcagagatcagatctcgctgtcatggtctgcggcaagtaggaatgacttcaccctacagctacccaaactgcacctggagacctttgcaatggaggggctcaagggcgggccagaggtggtagcatgccaggctatgattaaaagtttcatggatgtctaccagcttgcaagcactagaansdtgacatagagaaggaaatgacatctcatcgaagtcacattgcagc

SEQ ID NO: 2589 - DNA, 492 bp, Homo sapiens
  CDS 48..326
cttgaggctgaggttctactgctggcagacagaaaggtgtggttggcatggggcaatgcttgaggtatcagatgcactgggaggacctggaagagtaccaggccctgaccttcctgaccagaaatgaaattctgtgcatccatgacaccttcctgaagctctgccctcctgggaagtactacaaggaggcaacgctcaccatggaccaggtcagctccctgccagctctgcgggccttacakgataagagtgcacatcagcccctcactgggtctgggagccaggagttcagctctgcctgggttcagcccttgccctgcagagagtgaagcagaagagagaagcaaaagctcctgcctccaaccccctgggaaggaaagttgttttgcttgcttagcaaattgtctctggagtgcactttcttttttaatttactttttatttattgttaacgtagtatgacaccaataaaataaaattttaagaaatcaa

SEQ ID NO: 2590 - DNA, 497 bp, Homo sapiens
  CDS 214..456
aacactccgcaggttcctgagtaggcagttgtggcccacaggcatgggcaaacagaggcagagcacagaggggctgctcatccccaaatgtctctccagccgctctgaagctgctgcggctgctgtgctggtccatggagaaggtggaacactggactaaagagacaggctgaggaagccctcaagtcacccctgatggaggccagaccttgaatgttacaatccctctgcttatcgacccttaataaaaatctgagcaggtcttctctgcaggacacaggaggctttctggaaaaaaaaacatggaaaaaaagtccggaagtgctcgaccaagagatcgtgagatgggagcagagagtacaggaaaggaaggaggagaaagaaaggctggaaacctttgaatgcacaaaaaaaacaggtcatgaaagataccacgagccacctaaaatctctggctgaaaatgtgctggacaccatgcagttggaagatttcacta

SEQ ID NO: 2591 - DNA, 541 bp, Homo sapiens
  CDS 233..439
gtaatcaggatggcagtgaggcaggcacttgcttgcagaagaacaggcctagttttttaagaagccacaaaagtgtctttggatgattaggatctaaggggccaacagctttgcaataacagcataaatattgtgggctggatggacaggcaccaaatggggacattccatcctgctgtgtgatgagaaagctgccacttttgaggccttccaaaacaaatcaacactccatatgccagaaggaaaagcccaggaaagacctattccaactggagatggaatacgaagggagaatgaaacaaaactgctccgcttagggaacttggaaaggaaattgaaaaggcaaggcacaggctggaagaaaatatttgaaaaagatttatgtgaacttctttctggattatacaaaatatttttagatattcttacaactctaaaataagataactccttaaaaatctaaattctaccaaaggagagataaagatgacgaatacattcaaagatgctgaaaatcacttatttattattaggaagttac

SEQ ID NO: 2592 - DNA, 575 bp, Homo sapiens
  CDS 9..368
  misc_feature 17,25: n=a, g, c or t
atttaaagatgacaggnaacaatanagatttgttctgtgcaaccctttcttgttatgccggcgacatcagctccgcacatgaaactgcccgatatttcattccacctgccacctccctcccgcctcggtcgactctctcctctgctactttgcttgtccccactttaacacaaagagacagctctgtgttcacagcacctaacagtgttgaaaaagaatgctatttaaaacccgagttgagacatcacctttmcaaacccatgactgcttcctggctcactaaacacgaaccagaaattaatgctgcaaagagcagagacaagagattcgactgtgttagccaggatggtctcgatctcctgacttcgtgatctgcccgcctcagcctcccaaagtgctgggattacaggcttgagccactgtgcctggcttcaggctgggatttttatagcttattatggcaagggaggagacggagagtaaaagaagaaggaagagcatacacagtcaccccttgtgtgacaaatatgcaagaaataaagataaatgtgtacaattcttaaaaaaaaaaaaaa

SEQ ID NO: 2593 - DNA, 490 bp, Homo sapiens
  CDS 32..220
  misc_feature 481: n=a, g, c or t
gacaactgcagccgcacgtgggctcggcgcgatggaggaggagatgcatactgacgccaaaatccgtgctgaaaatggaacagggtccagccctcggggtcctggctgcagcctccggcactttgcctgcgaacagaacctgctgtcgcggccagatggctctgcttccttcctgcaagtgacacctctgtcctggcgggtgtgtacgggccggccgaggtgaaggtcagcaaagagattttcaacaaggccacactcgaagtgatcctgaggccgaagattgggctgcctggtgttgcagagaagagccgggagcggctgatcaggaacacgtgcgaggcggtggtgctgggcacgttgcacccccgcacctccatcaccgtggtgctgcaggttgtcagcgatgccggctctctcctggcctgttgtctgaatgccgcctgcatggcattggtggatgcaggtgtgccatgcgggctcnccttctgtg

SEQ ID NO: 2594 - DNA, 522 bp, Homo sapiens
  CDS 142..432
aaaattcagtccctgctctctgtgcccaaccatatgtccagaacttactggcactcctaggcctggagcctccagccagctcagaacaaagacagtctgaaaaggcctctcctcgtcgccatcgcaatcacttgagcatttatgctcaaaacagctctcttacaggaaaacgtttgtgttcctccagaatgtgaaggaaggttcatggtttttaaaattcatgaattgcgtggaatggaacgttccttctctgaatacaggaaagaaacagagaggcagtgtctttatgacccccaagctgtgggtcatctcaggcgggaaaaatctagtcaagccaattatttggcatggtgtgggcctcctttcctcccatcccaggaaaaggttgtgagggttttttttcacgttttaactcgttgccttggattcgcttgaaagtactcaggcttaggcaattagctaaagaagtctactcttttctagttaaaattatttgacgacagtgattctggctggggatat

SEQ ID NO: 2595 - DNA, 627 bp, Homo sapiens
  CDS 302..475
  misc_feature 62,240,270: n=a, g, c or t
actatggcatggaccctcatcctcgagccccactactcagaggagctgggaagaatttccanccttcctagtggcaagtctcactgtgagagcggagtgccaccaggcaaacagggcagaaagactgctttaaggagaatccttatattgggggttatgaagtgcaatacaccctcatcctcacgctaacactggtaccatgtagcccaagcttgtctaacctgcagcccgcgggctgtngtatggcccaggacagctctgaatgtggcncaacgcaaatttgtaaactttctaaaacattatgagatttttttttctcatcagctatcatcagtgtgagtgtatgttatttgtgactcaagacaatccttcttttccaatgtggcccagagaagccaaaagactggacacccctgatgtggccctttcatccatagtagcctattttgtcctaaagacggtcttgtgcagtgagtaggccaggcctccccactaccacagtttacaggcaaggaatgtgatatttcataggatgaccctgactggcacctacattgctagccaaagaatggcacaaagatgtggacagaagagacamcttaagcagctgactgctggctcctgcaa

SEQ ID NO: 2596 - DNA, 506 bp, Homo sapiens
  CDS 4..168
aagatggcggaccgtggcggcgtgggtgaagccgcagctgttggagcgtctcctgcatctgtccctggcctaaacccgacgctaggctggagggagcgactgcgtccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcaggtgactacttttctaatgtgttttcagagctgtgtatttaagattgagtttgg

SEQ ID NO: 2597 - DNA, 588 bp, Homo sapiens
  CDS 91..270
acaagcgaactgactaccggcggtggaagtcctcggccgagatttcctacgaagaggccctgaggagggcccggcgcggtcgccggaagaatgtggggctgtaccccgcgcctgtgcctctgccctacgccagcccctacgcctacgtggctagcgactccgagtactcggccgagtgcgagtccctgttccactccaccgtggtggacaccagtgaggacgagcagagcaattacaccaccaactgcttcggggacagcgagtcgagtgtgagcgagggcgagttcgtgggggagagcacaaccaccagcgactctgaagaaagcgggggcttaatttggtcccagtttgtccagactctgcccattcaaacggtaacggccccagaccttcacaaccaccccgcaaaaacctttgtcaaaattaaggcctcacataacctcaagaagaagatcctccgctttcggtctggctctttgaaactgatgacgacggtttgagtgacatcattggtgtagaaagtttgtgtgtttttttttcttctccctagttgccaaaattaaaaaggtggtgttttcatttttgtaa

SEQ ID NO: 2598 - DNA, 504 bp, Homo sapiens
  CDS 132..305
acaacacagattctactctcaccaatttaaatgtctttatatccatgtaacatgggtaacctcacttcaccccattattagatatttgagttatatctaatttttcactcttataaatagtgctgctatgaatgtctgtaaaaaaaaaaaactgctccttctttttgattattcccttaggaatatctccaaagagggattacaaggtcaaagagcatgaagtattttatagctcttgttttatattgccagattgctttctagaaagatccaatctttgggttggaaggaccttaaaggtcatctagtttagcctccccaccccctctgaatgcttgaatcccctcgacaatttatgatgccaccagcaatgtataagcatttctgtttaccaatagctctgccagtattgggttttgccatttttatttatttttgctagtttaataggtatgtatagttgttcttgaagagttgttttatttcattaaattgctagcaaag

SEQ ID NO: 2599 - DNA, 506 bp, Homo sapiens
  CDS 67..228
aramcmarscmmkkmacttagccgtgcaggaacaatggcaagcctttagcccaattgggagcggcaatgggcgcctcgctggatcaggagcacagcgacaccctgcaggatccagagggatgggagtcagcggcaggtctgcggtggtggcaaacagcagtggtggacgaactgtataatgatgactgcacaagataccaaatcagaagaggttccatttccaagttctgattcataagagcttccaaagtagagccggtacatattgaattttgattcatctggaaggatctcggacatctctaaagaaacaagggactgatctaagccacattctccatctccagctgaatcgtcagagccactgctatggttaagaaagaccattgaagamrrmytwrgkymmywwymrrrsykgramytycmwycywaaawwmmmmaaaggacaaccagtttaaagatgtaacaattttagtctcagaaataaataataacatagatagcat

SEQ ID NO: 2600 - DNA, 627 bp, Homo sapiens
  CDS 57..245
  misc_feature 108..110,168: n=a, g, c or t
tactacattatacatttttggtgaaatcagtattcaccatttacgttcttttaattatgtatgtattgttcacagcattatcatamratgtamtacatawhdwwtawnnnwwtttgtttttgctggagttagtagttgctaggawmctccccccaccaccaatatatnwggttttccatgtacctgtcaactctttcccaagtactctgacakwattgtacatgtcctttttgtatagccatacttgatctattagtcctcccctttactcttccccatggaaacaactctgttccagagccttttatcttactaatccagtctggattggctgatctctaggcttttgcatagctgccattgaggaaccaattctcatccaaattcccctcacctcttctgtgtttcattccttcttttgaaactcatgacttcttggtttacttccttcttgtggtggaatttaccttacaataactttttgggaaacaatgcttggaagacaattttggggtaacctgtattctaaaaatgtttttatttttattttaccttttgtttgataatatagacgggacagaattgtatgttagaaataagttttcttcaaaattttgatgatacttt

SEQ ID NO: 2601 - DNA, 542 bp, Homo sapiens
  CDS 211..366
attcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggagaatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagawaaataattgtccatgtgcaaagatgtgggcaagaatggcctctgcagattttcctgaacttctgctaacttgcacggctttatcacagcatttttaaagc

SEQ ID NO: 2602 - DNA, 451 bp, Homo sapiens
  CDS 117..290
ccagttccgggtcaggcccttctcccgcctccctcggccttagccatggcgagtagcggcggtgctggggcggcggcggcggccgggcggcgaatctgaatgcggtgcgggagaccatggacgttctgcttgagatttcaagaattttgaatactgtcttagatatggaaactctgtmtatttgtgtacggctttgtgaacaaggaattaacccagaagctttatcatcggttattaaggagcttcgcaaggctactgaagcactgaaggctgctgaaaatatgacaagctgactttctggagaaattctgatgagatatgtcaagctctgcaagagggttagaagattgcattgtagttgagaatgtacaatgaaattactgcatgcagcagtgtagaaaaattttactttttaaaagaattataaaaccatagctttataaatcagtgg

SEQ ID NO: 2603 - DNA, 453 bp, Homo sapiens
  CDS 128..331
  misc_feature 322: n=a, g, c or t
agagcggctgacggagccgggctcaccaggtcgctgccgcgagggagttgctgtgctgrrgcctgggtrgcggctggargcctgarttgggctcacagcgggggtcggcagggggccgggtggcggaatgatggavgaggaggaactggagttcgtggaggagctggaagccgtgctgcagctcacgcccgargtgcagctggccatcgagcaggtgtttccaagccaggaccctctagatcgarcagatttcaatgctgttgagtatatcaataccctgttcccaamcagagcaatctctggcgaacatagacgaatcrtngaacaaaattaggctgaaaataaggagactggatgacaatattcgaactgttgtaagavgtcagacgaacgtagggcargatkgacggcaagtaagtaactcakkcctccatattacctatgctcccctgg

SEQ ID NO: 2604 - DNA, 495 bp, Homo sapiens
  CDS 2..151
gatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaagggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggcctcaatggccgctggtttgctggccgcaaggtggtggctgaagtgtacgaccaggagcgttttgataacagtgacctctctgcgtgacagtggtccctctccccggacttgcacttgttcctttgtttcctctgggttttatagtgatacagtggtgtcccggggccaggcgcgctctgcccagcccagcctacagtgc

SEQ ID NO: 2605 - DNA, 538 bp, Homo sapiens
  CDS 287..490
aacggcggcggccacgggcttgctagaggaagcgctgccccggcagcgcagccacggccaccgggagctaggagtgaacccctgcggggagcagcttccccctcgcgatcgtggggacagccagtcctgtgaaacgaggaggcggttccggacgcccagaaacgcccagggagacctggagccgggggaagaggggacatgagcggccagctgagtccatccccaggcggctaggggcggacccagcagcccctcagctctcctcgtaaccacggaatctgagagaatggagccgagtacctgtaggaccatggaatcagaggaagactatgttgaggaaaaggaatctgagaagtgtgttaaagagggagttaccaacccctctaactcttcacagcaggctctcttaaaagctgactataaggcattaaaaaatggggttccctcacccattatggccacaaaaattccgragaaagtcatagcccagtgacacaggcgacttagaagctgggaggaggaagagaaggcggaaacg

SEQ ID NO: 2606 - DNA, 270 bp, Homo sapiens
  CDS 12..191
  misc_feature 101,126,172: n=a, g, c or t
gtggactcgtcatggcgaccgagcagaggcctttccacctggtggtgttcggcgcgtctggcttcaccggccagttcgtgaccgaggaggtggcccgggtncaggtggacccggagcggactccgncctgccctgggccgtggcgggccgctcccgggagaagctgcagcgngtgctggagaaggcggccctgaagctgggaagacccaacactgtcatctgaagttgggaatcatcatctgtgatattcgctaatcsagcctcgcttga

SEQ ID NO: 2607 - DNA, 235 bp, Homo sapiens
  CDS 2..166
catgagattatgtaatcaaaaggtgctgccatttttaatttttaattttttagagacagagtcttgctttgtcacccaggctggtgtgcaatggtacgatcatagcttgttgcaattrttcagccctgggttcaaagtgatcctcctgctacagcctcccagtagctaggacaataggtgtgagccatcatgcttggggtaaaaaaaaaaaacaaaaccatatatatatatatat

SEQ ID NO: 2608 - DNA, 471 bp, Homo sapiens
  CDS 158..331
gggatttggwgccatagccaatcgtcgcattaggccgaatcgcgggggccggctaaacgcgtgcgggggaggtggcttcttccggccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaaaaaaaaaaaaaaaagct

SEQ ID NO: 2609 - DNA, 530 bp, Homo sapiens
  CDS 9..314
  misc_feature 53: n=a, g, c or t
atggrgtaatggggagagactttgccgagatctgctcagactacatggcttcnactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgtctgggagcgcacacattttctgtatggacaaatcctggattggcttcgttatttcgtggcctggcaaccwgtggtgataggaatagttcaaggcattaactattcactagggctggaataggacagcagaccccagaagcaacatactgcatggttgaaatccttggtccaacatttaatattaatttttktaattttagagatgatcccaagtgtttagaaaactaagtaaactttgttgtcaagcaatttgtccatgtggaaagaatttaaagagaagctgaacaatggaataaacaaataaagcatgttttttcatcttaaaaaaaaaaah

SEQ ID NO: 2610 - DNA, 489 bp, Homo sapiens
  CDS 259..411
  misc_feature 228: n=a, g, c or t
aacattctaccaacaaaaggaagtcccaaagccaccctagattcaaagattggaaaacggacaccacctataccatctcttgaagcgaaaagttgaaggagtcaggagaggagatgttcaaaaggcactgtgactggagaaaacaagttaacctcttatttccagtcatcttcagatcatgagaattaaaagtgctattatggatggaagaagaggaaactacaaatngcttggatccttgatttcaaggaaaactatatggattcccaagcaatatgtaaaaccatatcagtccttgactacccacctctggacttattatataagaaaaataattctgtattttctgaaaaaactgtgattgttctacgaatacgtgtagccaaacactattttaaccaacacagcaactgaagttgatcacaagagtatgaactgatattagcaatacaagtggctcagagaaaaaataaagagttcattttcctc

SEQ ID NO: 2611 - DNA, 468 bp, Homo sapiens
  CDS 217..450
agattctgactttaaacatggaactgccaccactgatggagcagagtgacctcaaaatgtctgatcagcaggatttaatcatcactatggaccagtgacagctgtgtctgacccatacctcctctgctgatattcattgagtgtagaaggagaaggaagatacattaacttgtgaaccatgagccaatagatcaaaaagagccatgcctaggcctgatggcaaagactccactacataccacattgaaatctggtattcttgtaaaagaggacagcgtactctgtgcaggaagaagggtgaatatgaatatttggtcatcagaaaggaagctttcagcagagatagttaactgtccaccaaagttagttacagctgggaagttgactatcatggtgtctagaaagcaagaagttggagataacagaggttccatcagcctgggccctaaataactgcacagagaagac

SEQ ID NO: 2612 - DNA, 720 bp, Homo sapiens
  CDS 279..443
  misc_feature 18: n=a, g, c or t
attgataggcgggatwknggagggggattccagcccccctggaccggccggagtttattctagagttactggcgggtagctgtgcttttctttcccgtttgtaggtgaaacccattggcttcattggctccttgatttaaaccacgcccggctttctgccctctttgctgctctgggccaggttgcccagccatatcccagccccgtctgcagggagccggacgctgctgctgctgctattgtgtggatgccgcgcgtgtcttctcttctttccagagatggctaacaggggcccgagctatggcttaasccgagaggtgcaggagaagatcgagcagaagtatgatgcggacctggagaacaagctggtggactggatcatcctgcagtgcgccgaggacatagagcacccgccccccggcaggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctggatggctttaggcagcgttgcagtcaccaaggatgatggctgctatcggggagagc

SEQ ID NO: 2613 - DNA, 556 bp, Homo sapiens
  CDS 253..417
tttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcaggcccattttcagaaatggttaatggacggsacggtcctgtgcaagctgataaatagtttatacccaccaggacaagagcccatacccaagatctcagagtcaaagatggcttttaagcagatggagcaaatctcccagttcctaaaagctgcggagac

SEQ ID NO: 2614 - DNA, 803 bp, Homo sapiens
  CDS 529..780
aatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgtgaaaccccattggcttcattggctccttgatttaaaccacgcccggctttctgccctctttgctgctgctgggccaggttgcccagccatatcccagccccgtctgcagggagccggakgctgctgctgctattgtgtggatgccgcgcgtgtcttctcttctttccagagatggctaacaggggcccgagctatggcttaasccgagaggtgcaggagaagatcgagcagaagtatgatgcggacctggagaacaagctggtggactggatcatcctgcagtgcgccgaggacatagagcacccgccccccggcaggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctggatggctttaggcagcgttgcagtcaccaaggatgatggctgctatcggggagagc

SEQ ID NO: 2615 - DNA, 491 bp, Homo sapiens
  CDS 101..253
  misc_feature 332,334,370: n=a, g, c or t
aatttcggaagtcctcacataaaatccatactttttgaagaagcaatttacttctaggcacttaatttaaggaagtamagagagatccacattataacttatgcatctctccccaagctcctggagactgactcctccaaacctatactctacaactcatgatgctccccaacttatgatggggctatgtcccaataaatccattgtaagtcawaaaatcgttaggtgggccaggcgcagtggcttacgcctgtaatcccagcactttgggaggccaaggccagcgaatcaacagagatcaggaggtcagcctggccaacatggtgaaaccngnmdctctactawmmataaaaaaattagccaggcgarntgttgggcgcctgtaatcccagctacttgggaggctgcatgcaggcgaatcgcttgaactggggacgcggacgctgcagtragctgagatggcgccattgcactccagcctgggcagcags

SEQ ID NO: 2616 - DNA, 478 bp, Homo sapiens
  CDS 164..400
gatttaaaatgatggatggaatgaaaatagagttgccagctactttttagctaagaaatatggtagaactctacccttagttgttttcaaggacacatgatctactctaggaaacttgtcagtacttttgtatgctagttgcatacggacctaggccgaaattatgaggaaaagcagcaggaccctggtaaatattcctggtgggataatttatgcatatacctttggagaaaaactccaatatgctgtgtatgtgacatatagggtgttatgctctatgatttgtttgactatatttaatccaaaaatcgtgtacacaaatcaaatagagggactggaccagatcaatgagatcaataacaaaggtaaatttggatttttttttcttggaaagaatttataatatgactatggacagacaattagtcataaaattttaaaaaatatttgtctttattctttagtggtgtccattcag

SEQ ID NO: 2617 - DNA, 578 bp, Homo sapiens
  CDS 285..458
aggtggcttcttccggccgggccgagaggtggttacattcgttgaaggacaccagctgcggaatttgcggctttggcagacccagctgagtcactgtcactgcctaccaatctcgaccggacctcgaccggctcgtctgtgytgccaatcgactcggcgtggcgtcggtcgtggtagataggcggtcatgcatacgaattttcagctcttgttctggtgaccttttgaatacgtcttgtctataaaagaaattcatgcctttgtaaaatacacagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctgga

SEQ ID NO: 2618 - DNA, 511 bp, Homo sapiens
  CDS 286..447
attatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgtycaatatataggcagaaaaaaatttgtgtcaaaatgttgaatggaataataatgaggaaactgtgttaggcatgtattaaaacatttaaataaaataaaaatacatttcagctacaaaaaaaaaaaaaat

SEQ ID NO: 2619 - DNA, 619 bp, Homo sapiens
  CDS 146..322
agatgtgggtggggccaaggccacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgstcctgsaagtyccccccgggktgcykgwaacttacgtgtactttaccaacgagctgaaagcagatgcaggacaagtactccaaaagtggcattgccytggttcttaaaagraagatgacagttattgggaccccmawtgacgaagagagtatgaacagcccctgctggcaagtcaagtggcaaactccgtcagctcgttagaaagatgattttgwagaacctctgaggaaaccatttctaccagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctggga

SEQ ID NO: 2620 - DNA, 488 bp, Homo sapiens
  CDS 66..464
agaaaggaaccgggttgtcttgggccgggcagggcgggtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgttcggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaagatgaagaataagtaatcttcaccgaagattgtctga

SEQ ID NO: 2621 - DNA, 547 bp, Homo sapiens
  CDS 281..460
attagggtagattactggtttcagtataaaactggttaatggccaatgaagccatcaattttaagggcatttgttcaactggactgaagttatttgtatctttttaaacaaaatcaaattaacacataatttatgtgttaatatataatttattwatatttkttgawctaagatcattgcccaagatagctcttgggtggatttctttctcctatatgatattccccccagtgttatcattctgtcgtatttcaaggattcagattattttgctgatataatgttgtggctttttcactcctgtagtttggcgagcagaagagagggctacagctcctaccacccaccgctcagagagcaggagcattacagctctttcactcctacagttcgcctcattctctgcaatataatggtgtctgcatcaccaccgtgctctaaaataaaactaccatgcatataawaygggttgtattaatggacatttgttaagcaagggggatgcacagatgaggatgacacctattgtgaatgagtgcatagtcta

SEQ ID NO: 2622 - DNA, 429 bp, Homo sapiens
  CDS 56..226
ttgggctcctctactgcacaagggccagtccccaagtctactctgattgattgtcatgggcaccacacagatcaggacaccctttgaatttttgtttgacatgaactatttaggtgttccaaaaccttgggatctcaatgtgcaaactccttggactccagacccctgtctggttggcactcccagcagtgtktggtttcatcaggaaatccttgcagcaggggtttagatggttccttcaggaggtgggaagcctccatagcattgaaggccagcctgcatctsgcggtgtgtgtccacttctcccctcactttcscctcacccatccctttaaagtgattggctgtgaggagcacagagggtggcaattccatctgttatgggctcagaagacatagccgccatgttgatttcacattaaactgtgt

SEQ ID NO: 2623 - DNA, 437 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaa

SEQ ID NO: 2624 - DNA, 452 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaaaaaaaaa

SEQ ID NO: 2625 - DNA, 445 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaar

SEQ ID NO: 2626 - DNA, 442 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaa

SEQ ID NO: 2627 - DNA, 446 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccatagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaaw

SEQ ID NO: 2628 - DNA, 448 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaaaaa

SEQ ID NO: 2629 - DNA, 441 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcdggtgtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttccaaagttaaaaaaaaa

SEQ ID NO: 2630 - DNA, 475 bp, Homo sapiens
  CDS 147..335
  misc_feature 474: n=a, g, c or t
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaaaaaaaaaaaaaaaaaaaaaaaargggggna

SEQ ID NO: 2631 - DNA, 443 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcstcctgggttcacgcgattctcttgcctcagcctcccaagtagctgggattacaggcatgggattacacasatagctaatttcactgagggttttcaacagtagaagtgacaagatctgaattaagttttcccaaagttaaaaaaaaa

SEQ ID NO: 2632 - DNA, 469 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaaaaaaaaaaaaaaaaaaaaaaaaar

SEQ ID NO: 2633 - DNA, 452 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaaaaaaaat

SEQ ID NO: 2634 - DNA, 439 bp, Homo sapiens
  CDS 147..335
acagatgacaactgcagcccagacgacccatggctaggataaagctggtgctgtcctagaaattgggtctcccctcccagatccaggstgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaa

SEQ ID NO: 2635 - DNA, 488 bp, Homo sapiens
  CDS 199..357
cagtaggatacatagcttttcttccagtgaaacaaagttcatatcatccattgtttttcaagcacgtgacaccagcctcaaagtaaatgacatgaccagtggttgaacagtctaattttcaaatttaatatagagcatataacttctgatttgatagtatttattttaaaaaattatgttttcatcattcatttgaaaatgaaaaagccccaaagtgagaactttgggggagggcctagaacatggatagatctcttagtggtctttccaaaagtacatgtacttgaaatattttcattatcatactattctttgaaaaaaaagatgcttactgtatacttgttttcaagcatcctctaaaatcaaaggttttgatcacaatatgcagatttctcttgatagatacttaaataggctatttctctcctcttcttgggcaatgccttgttttctcctctgaatatttgcatttgaaaggattgcttcct

SEQ ID NO: 2636 - DNA, 447 bp, Homo sapiens
  CDS 147..335
  misc_feature 174: n=a, g, c or t
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttnaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaaaa

SEQ ID NO: 2637 - DNA, 484 bp, Homo sapiens
  CDS 12..374
aactattcaacatggaggcggaggtcgataagctggaactgatgttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaa

SEQ ID NO: 2638 - DNA, 388 bp, Homo sapiens
  CDS 124..324
cctgtttggcggccatttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagattttcatctacatcttgggaatattgaaacaaagtaagattctgctcttccagctctctgaggacttgaagtaactcctctggttccttgaaataaagtgctggctcctaattaaccaaaaaaaaaaaaaaaaag

SEQ ID NO: 2639 - DNA, 444 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaar

SEQ ID NO: 2640 - DNA, 458 bp, Homo sapiens
  CDS 113..409
attttttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtccgtttatatcagaggtgtggaagaagaggaagaagatggggaaatgagagaatagcatcttttgtgggggattttttttatatatatttctagacaataaagatttgtttgtttttcaacttgaaaaaaaaaaaaaaaa

SEQ ID NO: 2641 - DNA, 394 bp, Homo sapiens
  CDS 110..310
atttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagattttcatctacatcttgggaatattgaaacaaagtaagattctgctcttccagctctctgaggacttgaagtaactcctctggttccttgaaataaagtgctggctcctaattaatcaataatgaagaatataatttacttaaaaatgattaaaa

SEQ ID NO: 2642 - DNA, 444 bp, Homo sapiens
  CDS 34..213
actcggcggttgttccagaagaaagagacagcgatggcgcagaggcttcgaagactgggccttctaggtcttcctaccagcgaatggggakgaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactakacaacgctactacccaatggctggatatattaaggaagactccataatkgaaaaactgcagcctaagacgataaagaattgttctcaggactttaagaagactgctgatcagctaactactggtttagracgttcagcctccacagacaagactcttttgaagc

SEQ ID NO: 2643 - DNA, 439 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaa

SEQ ID NO: 2644 - DNA, 493 bp, Homo sapiens
  CDS 165..374
gttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggtwttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaaga

SEQ ID NO: 2645 - DNA, 444 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaam

SEQ ID NO: 2646 - DNA, 448 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaaaar

SEQ ID NO: 2647 - DNA, 522 bp, Homo sapiens
  CDS 285..443
caaaataatcaaagggaaatgctaaattgccctgcagtctattaggagagatgcgggggtggggcgataagtgtcatcagcaaatatggtcagattgtaaaccaaatccacaactgaaggtcctcttggggtagtttgtgtttgtctgtttatttgagagagagtttcactctgtcactcaggctggaatgcagtggcgctgtctcagctcattgcaacctctgcctgccaggttcaagtgattctcgtgactcagcctctagagtagctgggactacgggcgcatgcactacgcctggctaatttttgtagttttagtagagatggagtttcaccacgttggccaggctggtcttgaactcctgacctcacgtgatctgcccgcctcagcctcccaaaatgctggaattacaggtgtgagccactacgcctggccttgggggtagtttattatacagacttgtcaaatgtaattcagtcattttatttaaagcccactgtgtgctaggmcactgtgcttag

SEQ ID NO: 2648 - DNA, 481 bp, Homo sapiens
  CDS 275..469
aaaggagagggttggagcccacgcaaaacatgggtgtgataaagccacacgcgacctgagcccccaccctcagtaactactctccagcgcccaccgggaggaggggtccggggaaaggattggcatcctctgcttctgcagaaaacatggctaccaacagcttctgtatccacctgcggaggagactgactgctctgttattcccccagcatctgtgaagaggctctgactggctaaagtgttggtatagtgatcaccccagggttaggcaaccatggctggtgaaaaggaaaaacgttatgaacctggctgtgcggastacctgaggaagcttgtaggagaagggtcagtttgcagagaaaggggggcctgggcagatgacgcaagaggtgcccattacatccctctagaggaaggagtctgtagctttaggggaagacagagcacaagatggaggagcttggatgtctgaactattcat

SEQ ID NO: 2649 - DNA, 600 bp, Homo sapiens
  CDS 212..391
ttgattcagatattcatctcatctaaaaacaccctcaccaaaacacccagaataatgtttgaccaagtatctgggcaccccaaaactcagtcaacttgacatgtaaaatcaaccatcacagttggttaatcaaaaaatgtccatcatattagacaatcatgaaagagacacatagagacctttaacgttttattttacttcaaacatttaaatgcatattcatttcccaatcatttatagcaggcccaaagccttttctttgagcatgaatctagtaattggggttccagatcatcttgcccacaaaactatactcataattcatcttcgacatttccagtgtctgtttccttacatgaaaaaagaacttagagacaattataatacaatctaagagcacaagttgttctaggcttttaaagttattttttccaatttcttaatagttatttgatttgatttcatttttaaaatgcaatttgctttctaaagtatttaatttggttttcacagtaacagcattttaaaaaacttgacatagtatgtagttgttaaattattataaggacaaggtttggggtcaaacatgactgagtctag

SEQ ID NO: 2650 - DNA, 492 bp, Homo sapiens
  CDS 41..271
cactaccggtccccgggcggcggctacgagcccaagaaagatgccagcgagggctgcaccgtggttggcgggggcgtccagccctacctatagaagggccgagcacagcaatgcaactcataaatttacagatacaacaracagatgtctaaatccagaccacatcttgtgccactgtaaaagagaaggatccacacagcactgtcagcccacagactctaacaattggaacagactattgttggacatatgtgaatttgttggcatagtatagtttccccgatgtatgtgtgacttttgaaaacaatctgtttttctcaggatatcttgaattgatcacttcattgccacggtatatattctataggtgtgataggatttactgtaaagtttatttgtaaaagatgtacacagtagaaataaaacgtgatggaagaacttgagtacttcagaagtggraacaaatttgrtatttatttttataatgrtata

SEQ ID NO: 2651 - DNA, 357 bp, Homo sapiens
  CDS 20..184
aactgcctaattagtggacatgaaaactggacagtctccaaagtcatcagagatgaccacgcttgccaggcaacttactagactaagggtgacgtgcccatcatgcaggaagcttctccaaggctggcgagasaacttgtctgctttgagaaatgcagatctatcaggatccagaatcggactctgaaaaagctgtcatttcatgtctctaaaacagcctttgatttaatgtacaagatgtcaagaagtaaaggacaataaaataaaaaccaaaaaaggagaactatttcaattaagaagcattcctatatcaattcttggaaatcacataaaataaaagctgtcagaatcaaaaaa

SEQ ID NO: 2652 - DNA, 587 bp, Homo sapiens
  CDS 229..462
acccgggaggcggggccagcgaggcaagatggagttagtgcaggtcctgaaacgcgggctgcagcagatcaccggccacgcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaaaaaaaaaaaaaaatgg

SEQ ID NO: 2653 - DNA, 540 bp, Homo sapiens
  CDS 204..437
aagatggagttagtgcaggtcctgaaacgcgggctgcagcagatcaccggccacgcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttacattcactataattcacattaaatgtgtgcta

SEQ ID NO: 2654 - DNA, 472 bp, Homo sapiens
  CDS 185..355
agaccaataacggctaccagggaagaccacgctctgatgcacttaccctgaccacctcccacctcctgagctggggctgggtctgcaggggggcagatacctgaacaaaactggagttttgataacaacaaagaaaatacaattttacttaaagtgatccaaggggacactgagtcagccattcatgaagctgaacatcatttcaagggacgctggctccggtatcatggtgaacgccaaggtgaagagcagccgcatgagatcccaaaggaaagcccgggagtcacacaagtggagtacagcagcaaaccccctccaccgcctgcccttggctttggtcttgccagggaacagctgatgccgactagatgacgcaaccaggaagtgaatatcctgtctgctccttgttctgtgctgtctgtgtgtcctagcttgccatccaaatcaaggcatcccttgaaatcccctgggt

SEQ ID NO: 2655 - DNA, 512 bp, Homo sapiens
  CDS 298..465
aaaactaaaggccaacgtgtgaaaaacaatcttcagaaatgaacgttaaatgatgacattttcaaacaaacaagcaacaaaaagaagcaaaaagtaaacaaaaaacmaaaattcacataatttattgctaggagttttacactgaaatgctgaagggatttctactagcaaaagtaaaaatgatctcatttgaaaagatggaaattcaaggagggaatgaagaatactggatgggtaaatgtgttggtaactgtaaatgaatactgactacacaaaattatgttgaataactgaaagatgaaaacacaatcacttgaaggagaaatgtatggtcaaactgcatgcaggaaaaacttctataaaagagttacttcatgctctgggttggcagatacaatgagcaggagtgcatcagaagtaatcaagaaggtgattagttggtgtacttcagcaggagcaaccagatgaattgggcttctctatatccccgtattagccacasctaggcagca

SEQ ID NO: 2656 - DNA, 407 bp, Homo sapiens
  CDS 121..273
tatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgcaaaaaaaaaaa

SEQ ID NO: 2657 - DNA, 461 bp, Homo sapiens
  CDS 26..406
accgacgggacgcggctccgggaacatggctcgcttcgctctgactgttgtccggcatggagaaacaagatttaacaaggagaaaataatccaaggacaaggagtagatgaacctctttcagaaactggatttaaacaagcagcagctgctggtatatttctgaataatgtgaagtttactcatgctttctccagtgatctcatgaggacaaagcagaccatgcatggaattttggagagaagcaaattttgcaaagatatgacggtaaagtatgactcaagacttcgggaaagtaaatacggggttgtagaaggcaaagcgctaagtgagctgagggccatggccaaagcagccagggaagagtgccctgtgtttacaccgcccggagagagacgctggaccaggtgaaaatgcgtggaatagacttttttgaatttctttgtcaactaatcctgaaaga

SEQ ID NO: 2658 - DNA, 414 bp, Homo sapiens
  CDS 28..222
attttggyctgtcaggtccatccggcgatgctgggtctggacgagctcgggaggagtggttgtggccattgcacacaggcggatctgaggttcggcgacgsctggtcgcgacccgggacaggacaacgacaggaacaccgccgagcccgcgttcccccccccgcccagagtcatggcggcasagccgttcttgagggcgcctgctcagagcagtgtcacctttgaagacgtggctgtaaacttttccctggaggaatggagtcttcttagtgaggctcagggatgcctgtaccatgatgtgatgctggagaccttgacacttatatcctccctgtagagatggggtttcactgtgttggccaggatggtctcgatctcctgacctcgtgatccacctgcctcagcctcccaaaa

SEQ ID NO: 2659 - DNA, 336 bp, Homo sapiens
  CDS 11..172
atttttcctgatgmtctccctcctcaccctccatcctctggaatgtcacccaggcactacatccaggagtctcaggtgccactgggttcccatcctcagtgaggcagagctgggagaaggcacgcagcattcaaatttccttcaagtcacttgcttaagaggagatgacatttgagcaagatcttaaagaaaatcagatgccttcacctgaccactgcttggtgatcccatggcactttgtacatctctccattagctctcatctcaccagcccatcattattgtatgtgctgscttctgaagcttgcagctggctacatcagtccaatgtgaatw

SEQ ID NO: 2660 - DNA, 484 bp, Homo sapiens
  CDS 126..398
gtctcagtcgccgctgccaactctcgcactctgttctttccgccgctccgccgtcgcgtcttctctgccgggtcgcaatggrargaagagatcgccgcgctggtcattgacaatggctccgtgtcatgtgcaaagctggttttgctggggacgacgctccccgagccgtgtttccawtccatcgtcggggsgccccagacaccagggcgtcatggtgggcatgggccagaaggactcctacgtgggcgacgaggcccarcagcaagcgtggcatcctgaccctgaagtaccccattgagcatggcatcgtcaccaactgggacgacatggasaagatctgggcaccacaccttctacaacgagctgcgcgtggccccgggaggagcacccagtgctgctgaccgaggcccccctgaaccccaaggccaacagagagaagatgactcagattatgtttgagaccttcaacaccccggccatgtac

SEQ ID NO: 2661 - DNA, 337 bp, Homo sapiens
  CDS 73..285
ctcagtcgccgctgccaactctcgcactctgttcttccgccgctccgccgtcgcgtttctctgccggtcgcaatggaagaagagatcgccgcgctggtcattgacaatggctccggcatgtgcaaagctggttttgctggggacgacgctccccgagccgtgtttccttccatcgtcgggcgccccagacaccarggcstcatggtgggcatgggccaraaggactcctacgtgggcgacgaggcccarcagcaakcstggcatcctgaccctgaagtaccccattgarcatggcatcgtcaccaactgggacgacatggasaagatctggcaccam

SEQ ID NO: 2662 - DNA, 465 bp, Homo sapiens
  CDS 38..286
  misc_feature 154: n=a, g, c or t
agttcaaaatggcgacggcggcggcaggscggcggtgatggctcctccgggctgcccgggttcgtgccccaacttcgccgtagtctgctccttcttggagcgctacgggccgctgctagacctgcctgagttgccgttcccagagctggagcgngtgctgcaggcgccgccgccggacgtcggcaacggagaaggaacaagtcggtcaggaagccgtgcagcagctatggctttgaaggttaccggaaaaacacgcgtggagctggaggtggcagttcaccgaaattgaatcactctaacgagccgcaacataaaatccctggaaaaggtgtgtgctggcttcatcagaggagcagaggcaaagaatctccaagtgaaaggaccagttcgaatacctaccaagactttgagaatcactacagaaaaagtccttgtggtgaaggttctaagacgtgggatcctttc

SEQ ID NO: 2663 - DNA, 489 bp, Homo sapiens
  CDS 164..454
aagagttctcccttcaaggggtgagggagctggggtatttatacaccacttccaccagtcatgggttgggggctgttcccagaagtgtcaatgccttggcacgtccagcctgcccctcacacaggaaaagcagtccccatggccgaagacagccttcagatgaatgcacgtgatcaagcaggaagtctctggaggatttgctaacgagacacacaggtccccaaagctcagtctttcttcattttgcaacaaggacatattggcaatggtcagtctctatcatggcgtctgcatgctaaccatgaaaccgccacagaagaatttggcagaaggtgtcactgaaataggagtaagtccttctacttctttctgcattcgtggtggttgggacacaccaaggatgaaggctgctacagttctaaggaaaccttgtggctttatgggagtaaacctgtaaaactggttccttctctgaacattctttctgta

SEQ ID NO: 2664 - DNA, 490 bp, Homo sapiens
  CDS 44..208
aacatctgacataaagcactaactcagaagacgcctcatctacatgtgttctgttcctgttgttgcctttgaaagtgaaacaactgcacatggagagaagaatcacacatttctgagcctgaggccagtctggccactggggacccaatgctcctgctcctcggcaacatgcaactttggggatttctgttttgctgctgctgacgtgtgaatctttacaacaaccattaacatagtaacaatatcatatcatacagaaacaatttaattttattcctgatttctcaaaaagctttcttgagggaaaactgtacacttgtcctgatcttcaccatgctctgaaatgaacctgtgtgaacccagcgtgacagaagcagggaccacaaaagtctaaggaattcatgtgttaggacttcttccagttctatacaattcattttatgagaagacatgattgccttcccgttttcaagacacgcaactctaaaat

SEQ ID NO: 2665 - DNA, 470 bp, Homo sapiens
  CDS 164..355
taatacgctggtgtcttcacagtccttttggattaaatgggatcccagagccacttcttggtcggtttgagggggcagtacatgtgtggtatcaggcacatgcagtgtgagggctggactctgtggaagccggaaggtttcaacatctgccgcaaaccgttccatgttgcacagaactgacagaaaggaagaatgtgcttttggtattgaaggttaccacacattacagattgatttgtctcatcctgattccctttttagtcctcctccatcaaagaaaatgaagttatttggatttaaagaagatccatttgtatttattcctgaagatgacccattatttccacctattgagtaaggattcagcctttttaattattcatttaaagaaatttactatagagtatcaaatgtacaactgatcacatgtaaccattgttttgtatgtagttctgtctagcttttttttt

SEQ ID NO: 2666 - DNA, 396 bp, Homo sapiens
  CDS 113..358
gtkwaktatctagarccacgtgtccctatgacgcgtttagarcgggtcacgtgagcgcctcgcctggatgtgagtttcagccagacctgtggatatctgggctttgggctgtatgatcattgagawdkccactggaaatccctatcttcmwagtagttctgatttggmtttactccataaaattgytttgaaagtgggcaatttgtcacctcacttgcagaatatcttttccaagagccccatttttgctggggwagttcttcctcaagttcaacaccccamaaatgcaagaaaaaaatatccaaagcttaatggattgttggcagatatagttcatattcatgccagaactgaaagctaaattactgcaggaagcawaagtcaattcattaatar

SEQ ID NO: 2667 - DNA, 491 bp, Homo sapiens
  CDS 2..205
catggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgsmagraakgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgattttttttc

SEQ ID NO: 2668 - DNA, 553 bp, Homo sapiens
  CDS 129..329
acgggcggggcggggccggcgggggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgragatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaaagtggcagaggacctgggtggcaaatgggccccttgtcagcatctgtaacaagtatggagagatgcctgtggacaaagccaa

SEQ ID NO: 2669 - DNA, 485 bp, Homo sapiens
  CDS 219..431
tattttctttggggtttttttgtaacgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaacccgagattgttttttcacttatttattcatatcatgccttatggaaatttctttttctgtattttctctctttgctcgtattcacctgattaaatattgctctaaaaatcaccatggcatatggaaagtctcaaaattatacca

SEQ ID NO: 2670 - DNA, 455 bp, Homo sapiens
  CDS 17..169
caccgcgcaccaaaacatggggtccaagatcttctgttgttgccgcaagaccagcgaggggtcttccaccactgttggcttccacaatccaagaatgttcgaacagcatcatccacggtccttcatgctgtaccaaaaagacatccacgcctcccctatgacaaccgcatgatgctcaaggcgtgcatccttaggaggccatgagcattctagccggcggsacccacgtggtccctgcggctgcacagctgctgggcttccatgaggaagagggcagtggacaggagtcatgaagactgattcagaaactcccctgcaggaggagaagacgtctgagccatccctgtgccaccaccaagagtcactccagcttctgaaaaagccaccgtgggggggagccgcctccaattaaagtccttggtcacatcaaaaaaaaaaaaaaaaaaaaaaaaaaa

SEQ ID NO: 2671 - DNA, 607 bp, Homo sapiens
  CDS 157..402
aaaaaggcgycatcccttagagacagtaggaaaatggtatctcccggaagttacctcacgacctccaacagcggcttccaaccttgccggaaatgacgaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcactgttgtgatattacatttttgtgagtagaatcctgtgtgaccactaatattcaagttcatgaagcgcccctcctcagcatgagtcttgaaggtttg

SEQ ID NO: 2672 - DNA, 479 bp, Homo sapiens
  CDS 60..284
gaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcgtgagtgccttgggcccgcgggaggraarggctggaccccagcagcagcagcagtcactgcgcctcccctctgagcgctggcggccgggcaggcgctctgtaactcccgtacacacctttctcattgaatattcctgaccgcccttaagctggtcatattatcctccccatcttacacggggaaaactgagctacagaactgaaatgactggcccaaggtcactcgggtgattccarcatgttcctctgaggtcacctttatttag

SEQ ID NO: 2673 - DNA, 452 bp, Homo sapiens
  CDS 63..308
gacgaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggacagacctttctctggaagaggagtctgcattgtagtgtctcaaagacacaataaacttcctatggtccgaaaaaaaaaaaaaaaa

SEQ ID NO: 2674 - DNA, 330 bp, Homo sapiens
  CDS 135..299
tattctggattttctctaacaaataatacttgatagggccaggcatggtggctcacgcctacaatcccagcacttttggaggctgacaggggtggatcactttagctcaggagtttgagaccaacctgggcaacatggtgaaaccccatgtctaccaaaaatacaaaaaattaaccgggcctggtggtgtgtggtcccagctactaaggaggctgagatggaaggatgacttgaacccgggaggcggaagttgcagcaagccaagatcacgctactgcactccagcctgggtgacccagtgagaccacatctcaaaaaaaaaaaaaaaaa

SEQ ID NO: 2675 - DNA, 748 bp, Homo sapiens
  CDS 473..652
aaactgcctgggaatgtagcccactgggtgtyytsctycawtttamctcagcccctattcaagatgggagttactctggttcacacacctcttgacatgacctccaacaagttgtgaacattgagagaaaacccaaactgcccacagatgaggraagttagtgagaaagtggkwacctaaagccatgataccaacgagctctatgcttcttgaaaggtggtaactttagtgagacaagcctcaaattttaccactgtaccaagaaatgaaagccagaaatgtggaattggagctggtaatgacgacgtcaggacmaggttcaaaggaagcccsatcacttgagtaaaaatttatagcccctgcttgtgcygwgsctgtgctgtgctgtgagtttcagttccgggcccagcaaaaggatttatcaaagggaaagcaacaaggtgtgttgggaaattawgaaaggggctcttcaatgaccaaaggccataagagactggaaagggcaaaagtgtaccccattaatgtaatccaaacatcagtctcctgcagcaaagagggtgaattggagaaaggggtggagagtagctgtggacgagtgaaaaagacatcgcaccatgtcttcaaattacatccagcaacttcatatgaactatgaaacccttgttgccacaatagtccctctttgtttgaactactacaagaataaagaaatttctttctaaaaaataaaaaaaaaaaaaaatgcgaa

SEQ ID NO: 2676 - DNA, 502 bp, Homo sapiens
  CDS 253..447
agagctggccagggcggccgcggctgggcaactacgacagcggasccctggggaagccaagatgccgtcgaagggaaatgacaaaaagaaaggcaagagcaaaggcaaagacacgaaattgaaaaactgaaacagcaattaaatgaaacaaaggaaaaagcccaagaggagaaggataaattggaacaaaagtataccaggcaaattaatgaactagagggacagttccatcaaaaagccaaagaaattggcatgattcacacagagctgaaagcagtaagacaattccagaagagaaaaatccaagtggagagagagttagatgatctgaaagagaatttaagaaacacagagcggatacatcaggagactcttagaagactggaaagcagattttttgaagaaaaggtacagattattagggttaatttaaaatgttttgtttactagaacataagtgtatttataatgcattctgaaacatcagccttccatttggtat

SEQ ID NO: 2677 - DNA, 497 bp, Homo sapiens
  CDS 49..222
atcctaatcgaaaactgtgccttttccgatgtgctacctgtgctctccatgaagcacaccaaggaccgcgtggggcagaatctaccccgctgtggcattgagtgcaaaagctaccaagagggcctggccsgkctaccagagatgaagcccagagccgggacagagatccgcttctcagagctgcccacgcagatgttcccagaggtgccacgccagctgagataaccaagcacagcatggacctgagctatgccctggagactgtgctcaacaagcagttccccagcagcccccaggatgtgcttgtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatcccgctgacttcttcgtagacat

SEQ ID NO: 2678 - DNA, 468 bp, Homo sapiens
  CDS 152..337
atctccccactaggctaggatgcaataagaaggcagccatctgtgaacaaggaacagggctctccccaggactcaaccctgctggtaccctgatcttggacgtgcagcctccagaactctaagaaataaatgttggaatccagctcagcctatggtattcagtaacagcagccaaaacagaccaagatgccagagaatcagtggctcctgtctgccagcacatgacctgctcattcccaaggacactgcagactccagtttctggatagctagtaatccagacaaccatcactggggaaattcacagacctcaagcttaccctctaaaaacatcaaataaaaggtattacaggttgggttcagagacaaggagtgacactgtgagaagaagtcctgagagacagccacgtccctgcttgcagatttgtgaatctaacacacactcacttggcattataattacaccag

SEQ ID NO: 2679 - DNA, 482 bp, Homo sapiens
  CDS 23..220
agggtccgggctcagaggggctatgattcggagggttctgccgcacggcatgggccggggcctcttgacccggagccaggcacgcgcagaggaggcttttctctggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccmrgctctccctcttttcagccagctttctacggaacatcaatgagtacctggccgtagtcgatgctcctcccctggacctccggg

SEQ ID NO: 2680 - DNA, 520 bp, Homo sapiens
  CDS 116..283
aaaatgaatatgtgagttgggatcaggagaggtctatgcaggaggtaatgtagaaaattaattttaggaaattgaatcttgcagtgcttggcacaatgcatgaaaagggagactgatggcatgtggactattcagaaaactgtggcaacactgttgggtgcaaggtgaccttatgagatgggctgacagtggggactgccaactcatgtgtctgtttagctcaccttttcctgtgcccatcctccaaccccccaaccatgtgggaaggaaatgtttggccctctgaccctaactacatcccacagactgggatggaaaggtgtctgatattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggac

SEQ ID NO: 2681 - DNA, 484 bp, Homo sapiens
  CDS 116..283
aaaatgaatatgtgagttgggatcaggagaggtctatgcaggaggtaatgtagaaaattaattttaggaaattgaatcttgcagtgcttggcacaatgcatgaaaagggagactgatggcatgtggactattcagaaaactgtggcaacactgttgggtgcaaggtgaccttatgagatgggctgacagtggggactgccaactcatgtgtctgtttagctcaccttttcctgtgcccatcctccaaccccccaaccatgtgggaaggaaatgtttggccctctgaccctaactacatcccacagactgggatggaaaggtgtctgatattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctggaagaagctgggagagca

SEQ ID NO: 2682 - DNA, 481 bp, Homo sapiens
  CDS 247..453
agtgagactgactgcgtcggggttgagactggstggatgaggctcaccccggcgggagaagggacgaggaggggcggacagcggaaggtccgggagtgtccgccataaagtcgtttgaggtgaccgttgcgtaattgtgagtctgtgagagaagatgtgaagtatggcctcgtcccggtcatctgggcgtgcgggtcccgggttttgatcgcgcgtttgtgtagttttaacttctagtcatggcgaatgatcgcaggagagcacagactggaccctgctacgatctctcttggagtggatcagactgatgatcaccaacaaccaactcattcccggataaggaagaagagagtgtcacctacttcagtgtggtttcaaccctacttctgcatcttaaagacacttgtacaacgttggacactgtgcaggatgatgccacttcatcttggatgctaatctgccatgttgacttctgatttaa

SEQ ID NO: 2683 - DNA, 596 bp, Homo sapiens
  CDS 93..299
agtcatcctgcgacctccagaatccaccggggtgcagcgaggctgtggaaagtccsacccagaacgtgagttttaacttctagtcatggcgaatgatcgcaggagagcacagactggaccctgctacgatctctcttggagtggatcagactgatgatcaccaacaaccaactcattcccggataaggaagaagagagtgtcacctacttcagtgtggtttcaaccctacttctgcatcttaaagacacttgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgc

SEQ ID NO: 2684 - DNA, 470 bp, Homo sapiens
  CDS 19..315
  misc_feature 153: n=a, g, c or t
aagactcatttagaacaaatgaaatttctccagtcctacatttctgaattgacttctagcacatcaraaatatttcagtcattatcagtctcattaactgaaatgccaaatgctaaatgcagtgttctttcacactgttttaattttcttggnaaattgagtccagtggatgttaatggagtgggttgcccatccctgaaatgtcttattttcaagtggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaraaatctaagcctgaaacctgawaaaagagatatgaca

SEQ ID NO: 2685 - DNA, 571 bp, Homo sapiens
  CDS 75..281
agaatccaccggggtgcagcgaggctgtggaaagtccgacccagaacgtgagtkttaacttctagtcatggcgaatgatcgcwkgagagcacagactggaccctgctacgatctctcttggagtggatcagactgatgatcaccaacaaccaactcattcccggataaggaagaagagagtgtcacctacttcagtgtggtttcaaccctacttctgcatcttaaagacacttgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtacaktgcagaratctactgtctg

SEQ ID NO: 2686 - DNA, 468 bp, Homo sapiens
  CDS 261..422
cactagaacccttttcatcttgcagatctgaaactctacccattaaacaacttcccatcttcccatccccacagctcctagcaaccaacattctactttctctatcagtttgactactctaggtacctcatatgagtagaatcatacagcatttatccttctctgcctggcttatttcacttgtataatgtcctcaaggttcattcatgttgtagcatgcatcagaacttcctccccttttaaaggctggataatatttcatggtatgtttagatcacattctgtttatccattcatccatcagtgaacacttgtgctccttccaactttgggctgttgggtgtcctgccactgttgctcctagtgctcaatctcgtttattccctcctaatcaagtgtacaacgttggacactgtgcaggatgatgccacttcatcttggatgctaatctgccatgttgacttctga

SEQ ID NO: 2687 - DNA, 451 bp, Homo sapiens
  CDS 195..350
  misc_feature 371: n=a, g, c or t
tgaattatktrttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttsntttgtgtatgtttctgtggtccaaatggcaatataaatccagtctttattctccctttgttgtatttatgctgaatcttc

SEQ ID NO: 2688 - DNA, 488 bp, Homo sapiens
  CDS 206..364
gaaggtattttaaaaagtagatgagaccacacgctgaaaatgattttagtaagactgaaaaagggctggcataagaagtgggggaagggagtgggaaatagtgtatagggagatagcagaggaaaaggaatgatgtaaggagaccgagaagcaaggggtcaggcagaaggaatgaaaccctagtgtctgagaagttgagagaggaatgcttcaagaaaagagttggctgtgtgcgatggctcacacctgtaatcctagcatgttgggaggccgaggcaggtggatcacctgtggtcaggagtttgagaccagcctggccaacatagtgaaacccctgtctttactaaaaatacaaaaattagcctgacgtggtggtgcacgcctgtaatcccagctactcgggaggctgagacacaggaatcctgggagttggaggcttcagtgagctgagatcacaccactgtactccagcctgggtgacagagcta

SEQ ID NO: 2689 - DNA, 505 bp, Homo sapiens
  CDS 26..226
acagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacaattctgcaaaatattgtgaattttctttccaagggcatgtctccacaaaactgttacctcgcagcaggtaactggggtgaagccacaaacagcataaaacccaagcttctatggacatccatgcagtagaagcctggtggaaccctggttctctttaacatgaagcaacactcgaagaaccagcaaagaagtaactggtttagatggcaggaagctcatgtttattccacatgcagcagcagcctggttccttccagaggcagaaaatggagcatgaaggaagagtcactaccgttgtgaggctgcagtttggaggacagctgcaggctcacgaggctccctttctt

SEQ ID NO: 2690 - DNA, 491 bp, Homo sapiens
  CDS 26..424
acttccggcagcaggtggtggggccatggctgcccttctccgagctgtgcgtaggtttcggggaaaagctgtgtgggaaaggcctctccatgggctgtggtgctgcagtgggcaggaggatcctaagaggtgggtgggcagcagttcacccatctcgaaggagaaactaccaaacgcagagactgagaaattctggatgttttaccgttttgatgccatcagaaccttcgggttcctgtcacgactgaagttggcacagactgccctgacagtggtagctttgccaccaggctattacttgtactcccagggcctcctcactctcaacaccgtgtgcctcatgagtgggatatcgggctttgctgaccatgctgtgctggatgagctatttcttacggagactggttggtatcctgtatctgaatgagtctggcaccatgctgcgggtggcccatctgaacttctggggcctggccggcaggacacatact

SEQ ID NO: 2691 - DNA, 507 bp, Homo sapiens
  CDS 282..470
accactaattgagggagtgaggaagagagcagctcgcttctaactggactgcacgttggtgacagcgtcccaagctggtgacagacccactctataactttcagctagattcagccaccagatcccagaaacatcgacccttgctgcctacaaagagaagatgaaggagctcccgctggtgtccttgttctgctwcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaargcggcgagacccatccctggaagagatccagaagaaactagaagcggctgaggagcgaaggaagtaccaggaagcggmbkcctgaaacacctagcagagaaacggtaacatgagagaga

SEQ ID NO: 2692 - DNA, 526 bp, Homo sapiens
  CDS 203..355
actagggtgtggagaagaggcaggggttgaatatgaagtagtaagagagaacattctgtgttgatggccatgttcctatctacatcgtaacaggcatgcgggctataagwatgtatacatttgttaagacttatcaaagtgtacatttcactaaatataaattatatttcaataaaaactctgagaaggaaaataaagggccatgaatgccttacagagatgtgatcataagccattaaaaaatatggatgttggccagacacagtggctcacgcctgtaatcctagtgctttggaaagcaaaggcaggtggactgcttgaggccaggagttcaagaccagcctggacgacatggtgaaacacttccctactaaaaacacaaaaattagccaggcgtggtgatgcatgcctgtaatcccagcttcttggaaggccgaggcacaagaatcagttgaacccaggaggcggaggttgcagcaagccaagatggtgccactgcactccagcctggctgaaagagagagac

SEQ ID NO: 2693 - DNA, 523 bp, Homo sapiens
  CDS 154..330
taatttttattaggttgaaatgtaaagcaaatacccagttcaacattagaatcttggcaaccctaaacaaatacagttccaaagcaaaatctctacatattcctaccaaaaagcaaggaaaaaacaaacaaaaccaaacctgcatgtctgcacatggaggagagattttctatttctctgatcttcatcatgaaatgtctcaccctctgtcccataagaacaatgtcagcacaagatgccagttaccttcttacactgaagacagcacactatttttctttccagtctactcatttctgtggtagaaatgctgttaacattttaaacctttgatatttttcacacatgaagaatctgtgaccaggcaggttgaagacagtatcttatatgaaattaataatatggaagacaactgagaaaactgtggcatagtttagtttagtaaaataatctatgccatgataaacaatgtttcctttcatttctcaataaataatgttatgatgcctattctgagctataa

SEQ ID NO: 2694 - DNA, 572 bp, Homo sapiens
  CDS 250..501
ctctggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagakatgcctgtaccgtgatgtgacgctggagaacctggcacttatatcctccctggatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagc

SEQ ID NO: 2695 - DNA, 544 bp, Homo sapiens
  CDS 85..336
cctaatgtagcaccagatggtctctctctaaaatctatatccagtgtaaatgttgatgagcttagagtgagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggacccagtagtgccttttaaggtgaaaggaatggtaaatctgtacctttaatatgtcctacttttggcccctacctgaaagttactttttttccatcatctgtatataaaattatttttatcatgatgtatattatgtacataaataaaaggccatgattattgatttatataaaaaaaaaaaaaaatgs

SEQ ID NO: 2696 - DNA, 494 bp, Homo sapiens
  CDS 197..445
aactaactgccaagatggagcgaagggaacatttaaccttgactttccacagtcctgaggttcccaaaataaaggggaaccggaaataccaaaggattatctccaatattccagggcmktctttctcatctctgtctttaccatacttactggccttggctggctcttcagctcttggatccttaatcgaggaagcatgaccaccaacttggatctgaaggtatccatgctcagcttcatctcagggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctt

SEQ ID NO: 2697 - DNA, 392 bp, Homo sapiens
  CDS 12..275
atcgtgccctgatgcaactggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgt

SEQ ID NO: 2698 - DNA, 461 bp, Homo sapiens
  CDS 248..397
  misc_feature 247,381: n=a, g, c or t
ttcacaatagtgatgttagctataggagtagatgggggagttataaatcatgtgacccccagttttgtgattctggggcagtaaacaacttatagaaaaacaaactaagcgatggcaggtcatggtttaactatssctattctacagcaaagtccaaggccctaccacaattttagccttgtcttatgaacgcagcttcagtctacaaaaaaaaaaagaaatttagcctgtgaggttagaagcaaanatggaktcattcacgttaaatttctctcattacttattccaaaaaggcaaggagtttccaaacctagcccagggccaatgctggagctcttgtttgaaatgcagattcctgaacgcsagccccaaagattctgntccaacagaccctttctgatgcstctgggccattgggagaaccatgggctctaagaggtactgcttactgcagaaccttc

SEQ ID NO: 2699 - DNA, 499 bp, Homo sapiens
  CDS 65..229
gaaattctaagcaacatccaatgcataagtgatagtttgttaggattttgtaagaactcccactatggtcaaatcacctattgtaccatattttggtgaccatccccatttctcaagactctgtgaaggtgcttttcctacctcttctgacaccctggatgcccattgtctaagtgttctacttgatacactaaatttcaattcatgtatttgtcagagcttctttagatgaaattaagcattgaaagatgtgttttcactacattcagtctctgtcagaatatagtctctgaaaactgtgtgaattatgagaagaaaattgtatatcctaagctgctctctgctacccagtacaactttacactatcttatacagtaatgagcagtatatgcaaaattaaattgctgtaagttttattacattcaaaatataagtaggaatgtggaaactgccatccccaaaataattgatgctgttttgagtcatgtatatcagtgt

SEQ ID NO: 2700 - DNA, 552 bp, Homo sapiens
  CDS 325..489
agctacgtagccgccgagagscgcggascagcgataacagacccaggtgagcggccaccgctgcgcccccatagcggccgccaaggacactcgtgaggaccatgatacttccactgagaatacagacgagtacaaccatgactctcagtttgtcttcctgagcaagaaattaaaacgctgaaagatgatgaagaggaactttttaaaatgcaggcaaaactgttctgatttgcctcagagaacgatctcccagaatggaaggagcgaggcactggtgacgtcaagctcctgaagcacaaggagaaaggggccatccgcctcctcatgcagagggacaagaccctgaatatctgtgccaaccactacatcatgcggatgatggagctgaagcccaagcaggtagtgaccgtgcctgggtctggaacacccatgctgacttcgccgaccagtacccaagccggagctgctggccatctgcttcctgaatgctgagaatgcacagaaattcaaaacaaagtttgaagaatgcagaaaagagatcgaagagagaga

SEQ ID NO: 2701 - DNA, 466 bp, Homo sapiens
  CDS 4..420
aaaatgggctctgctcctcctttccctgggtgcccacatgaacagagacaccaggatgctctcctgagaccacagcaactgcagaagctgaagacatttccagaagttcaagcttccaccctctgcaggtccccactgagctgggacccaggtcatccaccccaccccaaatccctggataggaaacccctttctcctcctgctccttgtccccttcatccctgccgcccagcatcctactggcctcagcacctgtggccagaccgtccaagatcctctgaaggcccagctcttgctgtccaccccggcagtaggcaggcagcctggccatgtgccctccggtcagcatgcggtatgaggaagagggcatgtcctacctctacgcctcctggatgtatcagcttcaacatggagatcagctaagcatttgcttcasctgcttcaaggstgcctttctagactttaa

SEQ ID NO: 2702 - DNA, 481 bp, Homo sapiens
  CDS 233..397
aaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcastccgaggaaatggctcgggagaccctagggttgctgcgccagatcatcacggaccaccgctggagcaacgcggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtcctgcacaaactgttgacatccggagcctaaacgaggatttcagcttccattatgcccaactccagtccaacatcattgaggcgattaatgagctgct

SEQ ID NO: 2703 - DNA, 511 bp, Homo sapiens
  CDS 191..442
aatttggataaagaaagctttcataatgaaaccacttttatgaagcccctaatcaagcaaaactaaccaacacaatattttgtttaggagtatatactactaaaaaaggaggaggatataaacacaaaattcaggatggcagctacttcagggcaggaggcaaaattacagtctgggaaaataacatgatatggaaaacagcagtagaggtttctgccaccaatttggcaacacattggctgcctcccagatctaccaccctgaaatgaaaagaagcctttcgagatgcttattatctctgagtcaaacggaaaagaatcttatggacgccacctcagattttagaccagcagatatggggggacatcaatcacatagaggcacacctcattttaccgcactcaactcacagatgggtagttttgttttgtttttaacaaattaaaggttttgtggcaaccctgcatcaagcaagggtatcagtgccatttttccaacagcaaaaaaaaaa

SEQ ID NO: 2704 - DNA, 464 bp, Homo sapiens
  CDS 230..415
aataaatatggagtgtcagtagtctccttccaccccagaaatgtgttggtgtacattctcgtttcttttaacaacctggaagtacctttcttgtgatcttcactgaggaattagaactatgatagaagttaggctgtggcaaatgggacattcgtagagtgggatagaggtggcagaatgaacctggtgtagggcaggagtatgttgtgtagttacatcaatttgatgcatgctttccatctgcactccagacggctttctcagttccaagattttgcagagagaaggagcaaaccttttcattggaaaaacagaaacaaccctcccccccattttttcccctctattcatcaaacctttatgtatctttcatcttccagttacctctaggcatttagatagtgaaatttacctttgagatataacaataagtgatttaactgttcactttcagatgtaatggc

SEQ ID NO: 2705 - DNA, 590 bp, Homo sapiens
  CDS 105..446
attccataatactcgtagtggttcttctttcctgactgagctttgactgccacagtccttgcagacagagtcttgttctgttacccaggctgaagtgcagtggtatgatctcagctcactgcaaccttgaactcctgaacagcaatcctctttcctcagcctcacaagtaactaggactacaggtgtgcatcatcacacccagctgatttttaaatcgtttgtagagacagggtcttgctacgttgtccagcctagtctggcctccagcaattctcctgcmtttgactcccaaagtgctgggactataagcatacaccaccacacccagtcaagagagttctgtcatacaaagattagaggttcaccaaaaacggctactacatcttattgttttctaaacctgacttcttcatatataggaactaatattgaaaccattcagctatgaaggcgagatttcaggatacttttttcccagagaagggatcagcaagcagyyaatccacamccagtcatggtgaagctgacaccagccaggcttctagatggtcctttactcatgatagccattggaataagacgtgtagac

SEQ ID NO: 2706 - DNA, 484 bp, Homo sapiens
  CDS 219..431
agatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgargagccattttgsagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaaagaagacactgaaggaacatcacctaagagattattttgaacagtatggaaaaatttgaagt

SEQ ID NO: 2707 - DNA, 483 bp, Homo sapiens
  CDS 137..337
ataacaacagaaatggccagtcagtcccaaggtatccagcagcttctgcaagctgagaagcggggcagctgagaaggtggcagatgccagaaagaggaaggcccggcgactgaagcaggcaaaggaggaggcacagatggaggtggagcaataccgcagagagcgagagcacgaattcsagagcaagcagcaggcggccatgggctcccaggggaacctgtctgctgaggtggagcaggctacaaggcgccaggtgcagggcatgcagagctcccagcagagaaaccgagagcgtgtcgaatatggattaactccgcactcccctgggatcgccacatgaccacttcaagtccccaagccgcccttcggctgcacagactgcatttttttctgccataattacaagcaatggcactgactggagggcatgacaagtgtgtggtggggggatggacargtggcacaatgtctgctgctcaaccc

SEQ ID NO: 2708 - DNA, 517 bp, Homo sapiens
  CDS 179..412
aatggaaaagctgtggtgacccgaagctgccatgtaagaaagaagctgccatcttgtgaactgtctatggaaaaagctatgtagcggggaacagtgggtagcctcttgggagctgagagtggcctcaatctgacattctggaaaaacctgaaaattttcgtcctaaaaatgtaaagaaatgcattctcccaataacattagggagttggaagttgattcttccctactcaaaattacagcaacatggatgaagactattatcccgagtgaaataactcagaaaaagaaaatcaaagatctgaaccacaacaagagaaaagatctccagatactgattttatgtgcctcagccagaagatactgtattaatagatgcctgttgcagcaagccaagaaaataaccagtccagactgaggcaggataaatttagtgtataattcttaaaaccctgaaatgttacagatttaatttgaccgacagaagcaaaagacctgtgaatatgttatcttacatggc

SEQ ID NO: 2709 - DNA, 474 bp, Homo sapiens
  CDS 234..410
tctttcgcgaatgtaaggaacccagcttctgtgtggtgggcactgagagcagaaccgcattgagtcggagtggagcacagaagtgtaggtccttttgcgctgtttcaagctaaacccgtgtcactgatgccgtacagaagttacagaatgggacgccaccccaaacattacgtcatccgctgaccatttccttgcggtcttcccaccgtctaaatcgccatataatctgatggatggggtcctcgcgcggttcagctcctgggcgacagcgtaacccgtcgctcctmcctctgcgggagggcgtggacggggcacgggatttggagcatggaaggaatcgggacctaaaggagtcccaggacaccggaaccaggactccccggcgcacccggagagtttccgagctcctttgaagtatgaatcagaacttctggatgggaatcctggagccaccacttgccctatggtcgcaat

SEQ ID NO: 2710 - DNA, 473 bp, Homo sapiens
  CDS 52..252
  misc_feature 127: n=a, g, c or t
aagaagtttaggagcgggagatagggaaggagggcgggtcggggaggagggatgcggttcggcggaggcggccgccacagggacttgccgccatcacccctgctgccaccaccgcagcctcgggctncagggcggacacggccaccgcctcagcggagaggagtctccaccaggactgaccgctgccgcccagcacgtccaggtaaggtactcaactgtgtggggtactacataaatcctgaaagactacaataaagtggtgatgtctcgggaacccaccccacctctacctggagatatgtctactggtcccatagcagaaagctggtgttacacacaggttaaagtagtaaaattttcctatatgtggaccattaataacttcagtttttgtcgagaggaaatgggtgaagtgttaaaaagttcaacattttcatctggcccaagktgacaaaatgaaatgtcagctgccc

SEQ ID NO: 2711 - DNA, 513 bp, Homo sapiens
  CDS 11..232
tatctaggatatgttgatacaaagtctgcttttgctattctttttgcttaaatactcctatcatcttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactgggaggtttaatcctgtgatatgtacattgggattcatgactgtgcagcatttttagttatgtggtgtttggcagaatgacaataaggttttcccccatttttggtttcaggaggacatgaatagtgtgtttattgtaactcctcatacacttttaaa

SEQ ID NO: 2712 - DNA, 513 bp, Homo sapiens
  CDS 269..472
acatgttaaggaatgaagagtgtacccgtgtcggcaatggcaacgcgatcaggagtaacagcctagagttagctgcctccagtaacccgattttaatcgcccgttaaataccctttttgccttttccagaatgtcatgaaaatggaatcagaccgtatgtagccttttgaggatagaggatctcccccaccaccccaactccagtgagctttcagatgagattgtagccccagatgacaatgtccctgcttcccctttgccttccaccatgattgtgagtttcctgaggcctcgcagccatgtggaaccatggagtcttgccctgttgcccgaggctggagtgcggtggtgcmatctcggctcattgcaacctctgcctcccaggttcaagcgattctcctgcctcaccctcccgagtagctgggattacaggggccattatttccaatcaacagagaaaaagatggaggcctagacaggttgaataagttgtctaagattatattatcccca

SEQ ID NO: 2713 - DNA, 501 bp, Homo sapiens
  CDS 142..435
agcggctgtcctccctcgcttttggagctccgacctcagcttcgcctgcgagctgggttgtgtaaaggctggtcattttggggcgcttaggggtgggtgccggggggcgcgctttccctcgtgaaggtcgctccaggagtcatgcgtacattcgttcattttgctctggacgcactgatgttcccggctcgccgccgtgccgcagtcacgaggctctccgaacgcctttcactgtgtttctgtttacattcgcgtctgcaagacccggcggcgcgaccgaggcccgaacagatggggtcttgctgtgttgcccaggctgggcttgaactcctggactcagacgatcctcccgcctcggcctcccaaagtgctggaattacagatggagatgggctgccatgttgtgagctgccccatggggaagaggctcacatgtgaggaactgagggaggctccagaaaacagccagtgaagaactgagaccctcagtccaatagccta

SEQ ID NO: 2714 - DNA, 506 bp, Homo sapiens
  CDS 21..230
attttgctctggacgcactgatgttcccggctcgccgccgtgccgcagtcacgaggctctccgaacgcctttcactgtgtttctgtttacattcgcgtctgcaagacccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggcaactggcatgataaatgttttttcccatgaagctatgttttagagtaatttgttttgcagcaatagataactaattcactag

SEQ ID NO: 2715 - DNA, 471 bp, Homo sapiens
  CDS 21..230
attttgctctggacgcactgatgttcccggctcgccgccgtgccgcagtcacgaggctctccgaacgcctttcactgtgtttctgtttacattcgcgtctgcaagacccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagascccaagccagaagagtcaggtaagcagtgcctgcactcctgacccatggcaactggcatgataaatgttttttcccatgaagctatgttttagagta

SEQ ID NO: 2716 - DNA, 525 bp, Homo sapiens
  CDS 103..327
atgacaggcggggacgtggcscccatgggcgggaaggcgtgaccgccatgtacaagctcttatgactgggccaataccagccggcgcggsstcstgctcttcatggatgaagcagacgccttccttcggaagcgagccactgaggagataagcaaggacctcagagccacactgaacgccttcstgtaccacatgggccaacacagcaacaaattcatgctggtcctggccagcaatctgcctgagcagttcgactgtgccatcaacagccgcattgacgtgatggtccacttcgacctgccgcagcagaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtctcamtga

SEQ ID NO: 2717 - DNA, 515 bp, Homo sapiens
  CDS 343..504
gatgaaggactctggcagtgctgtttttaaataaatgatgtggcactgaccatgatcttctgtaagatgataaaactgttggaacagcgacasctgccacagatgatgtcttcatgtcgcacctgtgttgcgcgggttgctggtccctgagaagctttgctcttaggattttccactcaccctgtcacctgtcagcctcgccttgatccctcacccccgactctggtgtggcagcctcagtgactgagctcctccgcccccctcctcagcagggctgactttccctttagcttgggaggctcagcatttctgtttagcctgccgcgatggcagcgcasatttatgccggagggcagtgagagcgtcaggcaaccagctaacactgcttattttgtctgcctatcggcttcatgtgagttgcctgccttcttttccaaacccctcggggcttgctgtcttccgaggccttgtaaatgggaagtattcaagcccatgtgtatgaactgatatcggtt

SEQ ID NO: 2718 - DNA, 521 bp, Homo sapiens
  CDS 42..263
attttgtctcggcagcggtggccgtagctccatcgcattttatgtttctggcgagaagggaacggagttttcatcaggtagattggtttttgtgcggccgtcctccaccgtttcctccaggacagcacctagtcgtggccggagagtctcagagctgtcagaaaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtggtctctatgaataaagaaaagcaaatagaatcttatcaggtaccagcatcaagatgatttatggtaataagatataaaaccaaggaaaataacctaaagtctgaaaaagaccagaatcgaagtttcctgattcatattttaatgttttgaaatttatactccaggctgggtgcagtggcttgtgcctgataatcccagcactttgggagg

SEQ ID NO: 2719 - DNA, 399 bp, Homo sapiens
  CDS 3..176
  misc_feature 358: n=a, g, c or t
ccatgaacccaaagatccaagaaactcaaagagctccaagaagaataaatattgattcaggccaggtgcagtggctcacgcctataatcccagcactttgggaggccgaggtgggtggatcacaaggtcacgagatcaagaccagcctgaccaacatggtgaaaccctgtctctactaaaaatacaaaaattagctgggcgcagtggcatgcgctgtaatctcagctactcgggaggctgaggcaggagaattgcttgaaccagggaagcggtgggtgcagtgagccgagatcgcgccactgcactccaacctggtgacagagcgagactccgtctcaaaaaaaaaaawtaaawtaantaaatactgattcaaagaaaccckctccaaaacatatcaca

SEQ ID NO: 2720 - DNA, 481 bp, Homo sapiens
  CDS 46..249
  misc_feature 377..378: n=a, g, c or t
atatagcctgagtgcgacacgaggccgccgccgtcgcggmwtaagatgactcaagaccggcctctgcttgccgtgcaggaggcgctgaagaagtgcttccccgtggtggaggagcagcagggcctgtggcagagtgcctgcgggactgccagcccctcctgtcctccctcagcaacctggcggaacagctgcaggccgcacagaacctgcggtttgaggatgtgccggcgcttcgggccttcccagatttaaaagagcggctgaggcagccatcctcctcaaggtgcgagacatggtcagcagccatgtggagcgagtgtttcagatctatgagcaacacgcagacacagttggcattgatgctgtcctgcaagwcnnagcagtgagcccctctgtggctgacatgttggaatggttgcaggatattgagagacattatcgaaagtcgtacctgaagagaaagtatcttctttcgtctatc

SEQ ID NO: 2721 - DNA, 497 bp, Homo sapiens
  CDS 1..156
atggataaagatcctatcctctggggtcaagtcctggatatggaccatagaagattacatttttattttcttgatattactagccatgtaactgctaaacagaaaactgttttggggaaatcaagatcctattcgsccttgtttcccagggtgctttgaaggctcagctgaccaaaagacttgagaaaccttgcccagcccaaggaagtttcctgccactatgtacctaacagggctcaatactaccacagctgtggaagagagtctgtaatttgggagatcactcctcctgcattgtttagacaaccctccaaaaggatccagaggctgtcacagcccaatggattcaaaagacagtgtctactaaatagacccttcagtgataactcagcaagagattctcttcgaatctctgatccttctccccggatattacaactctcagtagccaaaggcacagacccaaactatcatccttcaaaaaaaatgcaaaccaa

SEQ ID NO: 2722 - DNA, 459 bp, Homo sapiens
  CDS 131..388
agagtccgttctgggtgtcttggctctatggctcgcctctgccagctcctccgctgccaggcgccgcacgctcgggaacctgtgcgcctattttggtcctacagaatgctgcggaastctcgctcggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgcatcagctaacaaatgcacttgtggaaagaaaacagcccctgcgaggaattggcatccttaagcaagccatagacaag

SEQ ID NO: 2723 - DNA, 498 bp, Homo sapiens
  CDS 71..379
acagctgcccggkactccagtsatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaayattacaaaaaaaa

SEQ ID NO: 2724 - DNA, 506 bp, Homo sapiens
  CDS 71..379
acagctgcccggtactccagtcatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaacattacaaaaaaaamhaawaaa

SEQ ID NO: 2725 - DNA, 890 bp, Homo sapiens
  CDS 333..683
gagcaagccctggtggcagcgccagggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaagtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaaaaaaaaaaaaaaaaaaaaaaaaaaaaaaaaaaaaaaaaaaaaaaaagaaaaaaaaaaaaaaatgcgaa

SEQ ID NO: 2726 - DNA, 517 bp, Homo sapiens
  CDS 103..261
aggtcatctaaattactttgacacaaagaagcagctcaatttaaagctcaagcttcaggaaagggagcccatcagaatcctgaaggaaccattccagaacttatgaagcaaatgaatctgagcagcagaaagggtggaccacagtggaggctggtgtccagattcaccgcttcaggactaaagcacttatttcctaagctgctgggtgtgctgacagctgacaactctaatctgaattcctctctgagaaccaattttggctgaagtcagtcaccacatccaaactcattccttattcctggtaaaggtgggactatataggtccagacaacttgcctcaatagagaacatctctgcagagccatcctagcttgagctccctgtggactgacctttattcagactgtatcacctcaacttcttttacccaatcctgcttccttcactcccccatgggtgttgatccagaggatccccctcctataaactttctgcatgcaagawaaaaaagagtgaa

SEQ ID NO: 2727 - DNA, 583 bp, Homo sapiens
  CDS 341..505
gttgtgtcggaggatgaggttttggctgaggactgaacagatggccttggaagaaatggtgcagagattaaatgcggtttccaagcacacgggtaggaggagctgctggccgtcagtgatctgtgcttaagcttgacatcatgggctgaaatgtggggaaatgcgtctgatttttgtaagccgccctcgtgttcctttctagccgtggtagctgtgacatggggggcactggttggcagctggtgtgttttcagaggctgtcggcgatcgtatgctgcccgggatagtcaaaatgactgcacgttggtgacactggctctctcagggttgctgggtctgcatgcggaccatttgtgtgtctgaagtctgcccatcaacctgcctgtccgcagccctcgcaatggagaatgcattgcgaatggagaatgatctgagccaagggctttcagagcttggggtttcagagccaggggtagggatggtgaagctacctggaagctcgttttgaggatgaaaaaacctggactaatcaggtggttcttttcttcattaaatgcaatttaaaccaaaaaaaaaaaaaaaa

SEQ ID NO: 2728 - DNA, 569 bp, Homo sapiens
  CDS 105..377
agagacgccggcgttactataagagcgcacgtggcgcttccgcgctctttctcagtgaccgggtggtttgcttaggtgaggcgcagacggggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgcctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacag

SEQ ID NO: 2729 - DNA, 549 bp, Homo sapiens
  CDS 129..401
ctctttctcagtgaccgggtggtttgcttaggtgcggtgcggtggtgtgctttttctctagggtttgggttggatggtggcccgggccttccgagtttccatgagcgcagacggggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaakatccgcaaggccgcccgggaactgctgacgcttgatgagaaggacccacggcgtctgttcgaaggcaacgcctgctgcggcggctggtccgcattggggtgctggatgagggcaagatgaagctggattacatcctgggcctgaagatagaggatttcttagagagacgcctgcagacccaggtcttcaagctgggcttggscaagtccatccaccamgctcgcgtgctgatccgccagcgccatatcagcctcggaggtgatgg

SEQ ID NO: 2730 - DNA, 470 bp, Homo sapiens
  CDS 57..329
actctttctcagtgaccgggtggtttgcttaggcgcagacgtggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgcctgctgcggcggctggtccgtattggggtgctggatgagggcaagatgaagctggattacatcctgggcctgaagatagaggatttcttagagagacgcctgcagacccaggtcttcaagctgggcttggccaagtccatccacmacgctcgcgtgctgatccgccagcgccatatcagggscgcaa

SEQ ID NO: 2731 - DNA, 279 bp, Homo sapiens
  CDS 16..234
agaggctgtcgggaaatggcggccgcggccgggctggggcttcagcgggaggcagcagaggggaagtggtcagcgtggcgaatgacggaaggtggcgagggagaggaagaggggtcgggtgtccgcggactccaagagggaagacaatcgctttgccaaacacggcagggcatctggaaaggcctgggaacctcacccgccctcccaggcccttcgggctcttttcggtcccattaggaggagggggagggcggcasgtgggaccgggcacaggcctag

SEQ ID NO: 2732 - DNA, 477 bp, Homo sapiens
  CDS 26..193
tagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccaggggactatcacagaagaagcaggcatgtaagattttaaggactggtttmsaggggtckagtgtaggaaaacagcctgttgcattgtaagagtgatgtcatcttgaagagcaggtggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgt

SEQ ID NO: 2733 - DNA, 606 bp, Homo sapiens
  CDS 217..387
atccataaagtgcatatgctcagaccacctacttcatagggttgcaataaggataaaacgcaatagcaacagctgacacttactgagcattttacataaattaacgcatttaatcccacaacaacgcaatgaggcagccctcgttttacaggtgagaaaactgaggcacaaggaggttaagtaacttgtgcaagatcaaatgacaaataactggagatgctgagatttaaacccgggtgctctgacccccagaacctaccccgtcagcagtacatacagtgtccagcacacaggaagccccaaacatatgcttgggtgtatccaaaagtccctgtctgtgctctgggagagctcattcctctacccgccactgcattccacagcctgtagaagtcctcaagcgccccgtgatttctgctagttccagagtggggtgtggaggaaaaggttccccaagagttccacatgctgtgttaggcagaaaatacaaccatgccagctccaagctccaaatgagcaaacccagctctatcaaggagcttagaaaataaagagcctcccatttactattcctgaccttcttacaaggcatctaggaagatgaaa

SEQ ID NO: 2734 - DNA, 554 bp, Homo sapiens
  CDS 198..380
  misc_feature 182: n=a, g, c or t
ctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcantgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggta

SEQ ID NO: 2735 - DNA, 481 bp, Homo sapiens
  CDS 63..221
ataacgacccaggtcgcggcgcggcggggcttgagcgcgtggccggtgccgcagagccgagcatggagtaccaggatgccgtgcgcatgctcaataccctgcagaccaatgccggctacctggagcaggtgaagcgccascgggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttaggtactggcttgtggggggatgtggtgtctgtgtcccaatggaccctggggggctatggaaccagccagtgcttcaggaccagggtcacccccaggaggtcagctgcatgtctctctgcccagtgtttattcattcaataaacattcagtttwagcaactt

SEQ ID NO: 2736 - DNA, 485 bp, Homo sapiens
  CDS 189..389
aactttcttcaagtctctaattttgcatatgagaaacactaagactcagcagataaggatggaggcgactcaacatcacactgagacaggtcatctgggacccatggtttctaacttctagaccgaatctctttctttcgaatgtccagatcatctctccttcttctaaaaaccaaagaggcctctgcatgcctctccctggatatgagccctgcatttctgaatgccttgaaagaaaaaccagcaagttgggagggccgtgtctccttatcatcttccaggaattcaaaaccgtgatttccagtttccaaatgcaactcaagctccatcaccctgtacatcttgcacggtttctccagcatatcctgatcgccacctccagacccttctgatagattcattacctgaatctatttgatcctgaactcctgctctcccttggctcaacctcatcacagccagaaaggatgagagctctttaatga

SEQ ID NO: 2737 - DNA, 552 bp, Homo sapiens
  CDS 110..271
aacatcctgctcctgctcatggacgacgaatcactcccgccacctcgggccgccgggtccccccgctgggctcaagtcttacctgacggctgtctctgtcctctggagaatgctgagcgaaggtcaggtgtccctaagtgactgctttccagagcacgctctccagcgcccaggggtccgtgtcctgacagcagtagccgggcctttctctgcactgagtggcatctccctcctaaagatactttgcttcagaatttcatcctttcacttttgaagttcctctgggccagtgtagatactttgtttcagaatttcttcttttcattgtgtaactccttctgggccagcatagcttcgctggatgagctgggctctgcaggtgaagcctccctgttaagtttctgcttttcctgactttctcagaggacagaggggtgaggcggggcagctcatgaataattttttatgttgaagacttgtcgaaataatattttggttatgttgggttaaataaaatataaagttagtctgtaaaaaaaaaaaaaaaaaaaa

SEQ ID NO: 2738 - DNA, 451 bp, Homo sapiens
  CDS 13..162
aagttctaacatatgaattttggaaggacacatacatgcaaactaatggtctcatccctagttccattgtatgcccagctgatagtcattttcctaaaacatacatcttactatgtcatttccctgctcaaaagcctcagtagcttcccatggcctcaaaattgagtccaaatgcatttaggagctccttcagggccctccataatctgccttttcagtcctaacaacctgccaccgaaattttagtcatacaaattgttcttcagttgtgcatttctctctccacctttattcatgtcgctcccttggcctagattgccgatttccatcttttctgcccaacacagttctaatatccttaaaggtttacttcaaatgtgaaggcaactgaaataaactcttcctccactgggaaaaaaaaaaaaaaaaaaaaaaaaaaaaaaaaaaaaaa

SEQ ID NO: 2739 - DNA, 492 bp, Homo sapiens
  CDS 41..226
gcgcgttctcgtgtcccggccctgccttggcctctagtaaatggcggaggtggttttaatttttttgagggctgaggagatcacttccgaagcggtaactgcagcctccctgcccctccaaggtggtgctggaaggacctccagtctttcctcgcctcatcccactccacggcgggactttgacagggttacctctcgaccctcatcccactccacggcgggactttgacagggtcgtgcagttaaccccgggggcgcaaagaggggagtcattcctttcgtgcatcctgacacacacaggttcttcccggagacgaatggtgccagtgatggttgcccgctcggatgcgtagtttccagtttacatttagaaccgacctgccagactccctcctctactctccccaccaccacgacccgcctgccgmgttccccaagcctgagaagttgctggctacgtgtttctataaagaatgagtgaaattctgcctt

SEQ ID NO: 2740 - DNA, 549 bp, Homo sapiens
  CDS 46..471
acaattcccggcgggagcgcggtgaagcgggggtgggatctgaacatggcggcggtggtagctgctacggcgctgaagggccggggggcgagaaatgcccgcgtcctccgggggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctgggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctga

SEQ ID NO: 2741 - DNA, 493 bp, Homo sapiens
  CDS 163..312
aaaaacaaagcaaaacaaaatccctgctcatattaacggcaaatcagttgggcaatatgaaagcttctactggaagaaaatgttccccaaatggtgacccttcaatgaccttaatcacctctaatttttgaatgcacaagcttgcaagattatgttgatgtgatggtggctgtgctagcacatccaggaattgaaagagcagaagaaaaatataaaatctgttctggcaaattcctaaagcaagccatttcagtaaaagcagaaatactatatgtgaagaataataaaattctctttactgaaacttcagattaacaataggaaatttcaaattattttgacaggaaagaggctaacaatatttgccaaatggacttgatgactgttgatggagctgaaagttgtgagcagaaacaaagtaacaaaggaggaacaggttgctgaagagactgactcaggagcagccatgagagatgatattcatcaaatatac

SEQ ID NO: 2742 - DNA, 453 bp, Homo sapiens
  CDS 235..444
  misc_feature 418: n=a, g, c or t
gtggcgggggaggggacgctgagggcccatgtgctgaaaatccgaagtgccgcggaaagtggagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattngcaagaccatggattaccggggaacatgatcccta

SEQ ID NO: 2743 - DNA, 546 bp, Homo sapiens
  CDS 30..329
ctggggatgtcaggggacccaatgcatggatgactcccatccctcttgaaaggccgagcatgaggactcgaggcagggtgtgcacagggccacagcggacacagcctcattcctgttcattgcagaacaaggctaagggcgcgggcatcttaatgagagcagcaggcaacaatcctggaagctgggtccacacagactgcggtgaacaaagaggtggcgtggaagctgctgctgcagcccagagcctgccaagaaggtcccaggtccacagggcctgcgcaacactgggtgccaggggtggggctggcctgccccccaaccccatctgctgaggagtggctgacaagcggacacccaccagggtgccactcgcttgtgcctggggaagcaaatgtgctcgcttgacccgtctgatgtgctgccgtgggcacttgactgagagtggcagagcactaggctaacccaaagtgacacatgcctggcgggatgttcagtctctgtaaacccatatggtttttttttttctttcctttaaaaaaaatttct

SEQ ID NO: 2744 - DNA, 484 bp, Homo sapiens
  CDS 97..288
  misc_feature 426: n=a, g, c or t
agctttacgtatgttttcccatttgtcactagcttttgctcatcacttttgtcataaaacttcaacagtctgtccttctgtttcttcaggtcacgtatggtggtcattccaacaccamgctcttttctaaggcatttcacacttaagctgtggtcctatttccccaacagctggactttctgtgccataaatcaatgctttgtctttttcttattacgtttgcccaaaggggtatctgtagccctttttaatatttccagcaatatctttacaccacagagcagagaataagaaaaaacaaaacaaaacagtgagtcatgcaggtttggatctcatcgctaccatagactgttggagtttcaagggtggagatccgccattgctttttccatatccgcagaaattcctttcacatgaaatgtgagntctgttgggttcccccccgagaccagcggtggaagaagaagctggaggtggctgattg

SEQ ID NO: 2745 - DNA, 534 bp, Homo sapiens
  CDS 95..454
aaaagacttccggtcggcgtgasgttgaggtgtgggtgttcgtttctcaggtaaaacatggctaaaagcttacggagtaagtgggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaawaggggaaaagcaaagcaaaagcagtgaaagtggcaaagggtttggcctggtagactcttaaaaccttggaaaatgccacatgggatagatgacgggattagaatgtatacacatgtatactttgatttcaactgccac

SEQ ID NO: 2746 - DNA, 491 bp, Homo sapiens
  CDS 93..416
  misc_feature 217,399,405: n=a, g, c or t
aaagacttccggtcggcgtgasgtgaggtgtgggtgttcgtttctcaggtaaaacatggctaaaagcttacggagtaagttggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccanacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggnaaagcnaagcaaagcagtgaaagtggcaaagcgtttggcctggtagactcttaaaaccttggaaaatgccacatgggatagatgmggattag

SEQ ID NO: 2747 - DNA, 330 bp, Homo sapiens
  CDS 12..191
aaaacaaacgcatggcgggaaggggcgcggtagtgcatcgtctccccctggagagagggaaggagacacgagggcgagtccctagctggagtgggaagaccggagagaagcggaaagacgctcccggggagccgcagaaggaattccagaagcaaaaacaaaaaaagttcgggtacagcggctcacacctgtaatcccagctcttagggagatggaaactggaggatcacttgaggccaggagttcaagaccagcctgggcaacatagcaagacccagtctcttaaaagaaaattaaaaagaaagagtaaataaaaaaaaaaaaaaatgs

SEQ ID NO: 2748 - DNA, 472 bp, Homo sapiens
  CDS 41..232
acccattaagcagttacttcccattccctgcttcccttaaatgcctggaagccacaaatatgctttccatctctatggatttgccaatgtggtattttgtgtcagttttctttcacttggcatgatgttttcaaggttcatccacattgtaccatgtgtatcagttattatatgtttttttaatttatcttcactgcttggtgttaaatttgtctccaaatatttttttctttaataatgtttttcaggttgaattcaagctaaataaagacacatcgtcattcccckgtagacttttacaacatgaccttgaaagaaactactcaagtaggcaagattttaccaagaatataaagaatgtaaaatgaggtccatcacccaaggagcttgtagatttatttgggaagacaagggctacatatctggtgatcatattaatttggtgagctcatcattgtcatcatttcctatt

SEQ ID NO: 2749 - DNA, 407 bp, Homo sapiens
  CDS 77..241
  misc_feature 406: n=a, g, c or t
atttttactccagcacagaaagatgattatagaatcataagttgactacctttgcttaacaccaaattaccttttgatgtacacatgcagctttaaaaaaaaaagtctggggccgggcgtggtggctcacgctttaatctcaacactttgggaggccgagcgggtggatcacctgacatcgggagttcgagaccagcctgaccaacatggagttaccccatctctactaaaaatacaaaattagctgggtgtggtggcgcatacctgtaatcccagctacttgggaagctgaggcaggagaatcgcttgaacctgggaggcagaggttgcggtgggccgagatcgcaccattgcactccaccctgggcaacaagagcaaaactcggtctcaaaaaaaaaaaaattng

SEQ ID NO: 2750 - DNA, 607 bp, Homo sapiens
  CDS 115..354
agaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacartttgtcctctttttataatagttggtgatttttcactgacatgtgagtaagataaatgtatacaattgtggatttaattkgtgaaatgttctttcacttgtaagtttcagtcattttcttttacctcgttgtcagtgtacagatgctaaaataattaaaaaaagaca

SEQ ID NO: 2751 - DNA, 548 bp, Homo sapiens
  CDS 93..257
aaaaaccaagacagcaccatcctctagtggtgttcacatcccaccacagtggagtcaggactttgaagtcctccattggatcttctcggaagatgagggaaatgagagagtgtggagagagattttgtaagtccggtctggaagtggtcattgttcagaatccagccacgtgggtacatggaactgtaaggctatttcaacatgggaaactgaaatcgggcatatccctgcggaagaagctgtcccttagcgaagaataaaactgtggactgacccccacccatttgcgaagaaagtactgggtcttcagctttcattgttcagccggtggtctttgtggacaacaccaggggcccctcctgctgaagactgtctggacttcctgattttcactcctgtataaaccccctcccccattactacctttgtctccttggggaaaaaaaatgtttttcacttaagcaaaataataactacccagtatttgtttctggagtgaaattgtaaacttcattgtacatacttcctggctttgatgcttatcgtga

SEQ ID NO: 2752 - DNA, 496 bp, Homo sapiens
  CDS 231..440
agctccatcaggacgaacctaggcacttagctgcgcaggaacaatggcagcctcccttgttaaccaaccagtaggatgtgattccttttgctatacatctcctctgggcaagtcagagtaaaagcaaaaagtaaatatactggctcttcagctgaggagaaagatactctacgctctacagcttccaactgcttacatttgaatgactttgccacaatgacccagactgaatggaggaaaaaagagtgactgaatctaaaaccctaaagctggaacacatttcagcaaagaagaggaaaggagaaattcaaatgaaaataaatcatatacacaaatatcaaggttcaaaagctggaggatttaattcaatcaatttagcaaggcccaaaatgaaacctggtaatgaaaatgaagacacagcaatattttcctcaagaaaatagacatttgggagaagaaatgttttcttaaaaaatgtttatttggaaaagtcagc

SEQ ID NO: 2753 - DNA, 352 bp, Homo sapiens
  CDS 8..202
  misc_feature 211: n=a, g, c or t
cagacagatggaactctccagcatgaaaatctgcgcmgcattccaacaagcagggctctgcctgaggttgtccgaagatgccgaggaaaaggatatcaggactggaatggctcttacagcaagatccaacgatagggccttgggagatggaaaaggaattaatcttctcaccctggcgagttttcctgaaactacttatccttagcgtcantgtaagaggtggagccgctcagtcccgcgggtggctgcagacagaaggtgggcgagtcctgggtcttaaaaagttttgcagaaggttgaaaagaggagcagagggagagttttgagtttatttattttaktttcctttttt

SEQ ID NO: 2754 - DNA, 447 bp, Homo sapiens
  CDS 59..307
actatctcccgggtgaacggagctttcgcagctggagaaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgt

SEQ ID NO: 2755 - DNA, 526 bp, Homo sapiens
  CDS 362..514
agtggatttgagttttaggctggccatttggcttttccagcccaggtggaactcagaggagtttgcaatggcctctggcacattttagacaactgagcagaactttttgaaactaggaagaccctttggtccatcttttgataaacagaatccatacatgtctaccccagttggaagtatctctgcaatgactggaaagtaaagaggaccaaggtgaaaataaaggctcggaaggggagcaatcttgaaaacatgtcatcccatggtggtgggaagtccctggagaagatcaggggaaacacagtcataggctgcaagtctataagataattccattggggagggagcccatttgtcatgcatggctgcaaggggcagatacaagtgtggagtaagcttgcaagagctgatcctggtcccagagagggaaaaatatgccttggtgggtaatgaaccttttgttccagaggcagaaggattgggactaggccaacatagagattggcgatggttgtgagattctaag

SEQ ID NO: 2756 - DNA, 482 bp, Homo sapiens
  CDS 46..264
ctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctg

SEQ ID NO: 2757 - DNA, 551 bp, Homo sapiens
  CDS 139..525
gacagcacgtcggccgccatgtcgccaagtggggctggaaacagacccggcgcccagcggtagcctccttgcgcctccgattcccagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaactcgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatctcttctttaa

SEQ ID NO: 2758 - DNA, 476 bp, Homo sapiens
  CDS 39..356
attttttcaagcgtaggcccccgggaactcgagctgccatgagcctctgggtggacaagtatcggccctgctccttgggacggctggactatcacaaggagcaggcggcccagctgcggaacctggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacaactccatctaaaraagrraaattgaaattagcaccattgcaagtaactaccaccttgaagttaatcctagtgatgctggaaatagtgaccgagtagtcattcaggagatgttgaaaacagtggcacaatcacaacaacttgaaacaaactctcaaagggattttaaagtggtattattgacagaagttgacaaactcaccgaaagatgctcag

SEQ ID NO: 2759 - DNA, 563 bp, Homo sapiens
  CDS 48..341
acacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggttgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccrggaagtccagagacccctgctctctcagcggatctcctccctcacagcatcactacatgcacacagc

SEQ ID NO: 2760 - DNA, 670 bp, Homo sapiens
  CDS 125..445
  misc_feature 555..556,562,616: n=a, g, c or t
gaaggcagagggcgtccaggtccgctcggtaaccgtttcccgcgcgcccggccccgactccggggtaaagagccccggagcggasagcgctggcmgcgtgccgcctccggagccggcagcccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaakgagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattatbyaccnnyrrgcnttttccccaattgttctgtgcattgttttgcctttttaaaatacatctcccmangtggctcaaaaggscttgacacagggaacctgcacatatccaggatatgtgtac

SEQ ID NO: 2761 - DNA, 501 bp, Homo sapiens
  CDS 147..497
ctgtgcagcccaggagctaggcgcggtastggggctggcttttgaggggcgcgggcagccttctgactgggtcggaggcctgcgggccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgtatgtcttttgaa

SEQ ID NO: 2762 - DNA, 472 bp, Homo sapiens
  CDS 81..254
  misc_feature 425,464: n=a, g, c or t
cttttttccacgtgcgaaasccmggactcgtggagttgtgaacgccgcggactccggagccgcacaaaccagggctcgccatgaagccaggattcagtccccgtggggtggctttggcggccgagggggctttggtgaccgtggtggtcgtggaggccgagggggstttggcgggggccgaggtcgaggcggaggctttagaggtcgtggacgaggaggaggtggaagcggcggcggcggtggaggacactttgtgatttccattaaggccaactgcattgactccacagcctcagccgaggccgtgtttgcctccgaagtgaaaaagatgcaacaggagaacatgaagccgcagagcagttgacccttgagccatatggaagagaccatgcsgtagtcgtgggagtgtacaggccaccccccanggtgaagaactgaagttcagcgctgtcaggattgcgagngatgtgtg

SEQ ID NO: 2763 - DNA, 539 bp, Homo sapiens
  CDS 81..374
cttttttccacgtgcgaaasccaggactcgtggagttgtgaacgccgcggactccggagccgcacaaaccagggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggacactttgtgatttccattaaggccaactgcattgactccacagcctcagccgaggccgtgtttgcctccgaagtgaaaaagatgcaacaggagaacatgaagccgcagagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaaaaaa

SEQ ID NO: 2764 - DNA, 481 bp, Homo sapiens
  CDS 276..440
aatcccagcactttgggaggccgaggcgggaggatcacgaggtcaggagatcgagaccatcccggctaaaacgggaaagggagaaaagaaaaacacaaaaattggaacccacagctatatctacgtgtctcctgtttcatgcaagtgtgttaattcatcccagagcacttaacagagttaagcagcatgaaacccttgaactctaagcaccatcaatgagccttagagctggattcttgatatgtactgagtacctctcctaggtactgtaatagatgctgaaactgaagaaaaaagtgaacgagaatagtctcccagttccattggagaaggaacaagtttcccatgggaagcataattgtgctctgcctctacaggctgcaaagcaaccagctctcacccctcatggagatgtctgctcagtcctatggctccgcatttgaagcctgcttgcctgcggatacatgatatttcacctcat

SEQ ID NO: 2765 - DNA, 509 bp, Homo sapiens
  CDS 115..405
acatcctgtctctgtgtgtggagctggctggaatctctcagcctcacctgccagacaacaccccctccttcctcaccctgtctcctgcattctcctgaaaccttcatccacacaatgcctcccaacctcactggctactaccgctttgtctcgcagaagaacatggaggactacctgcaagccctaaacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccaggctgcccttggcatgaattctccagccagagccatctcctgagctccagggcaatgttttcaactgcctacaaaatacagttggccctccatattcatgggttctgcatccacagcttcagsaaactgcaaatggaaaaatat

SEQ ID NO: 2766 - DNA, 436 bp, Homo sapiens
  CDS 64..306
acagagggtggggcagacgctccgtttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggcacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaaraaaaatctcaaaaaaaaaaaaaaaa

SEQ ID NO: 2767 - DNA, 424 bp, Homo sapiens
  CDS 135..314
aagtgttccggaaccgtgagactgcggggacggcggggtggggaccgggcggcaggggcaggccgaacgtgctcgtgtcgcccacaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggcacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaa

SEQ ID NO: 2768 - DNA, 423 bp, Homo sapiens
  CDS 64..306
acagagggtggggcagacgctccgtttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggcacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaaaaaaaaaaaaggc

SEQ ID NO: 2769 - DNA, 556 bp, Homo sapiens
  CDS 64..306
acagagggtggggcagacgctccgtttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggcacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcgttcctaccataactgtgaatttaaagtaaaaccagctcagaatcttgccagagtctgttctttggtccttgttctaccctaaactttgtatcacct

SEQ ID NO: 2770 - DNA, 333 bp, Homo sapiens
  CDS 24..266
  misc_feature 131: n=a, g, c or t
ctggggaagcggcggcaggcgccatgtccggccgcgaaggtggcaagaagaagccactgaaacagcccaagaagcaggccaaggagatggacgaggaagataaggctttcaagcagaaacaaaaagaggwncagaagaaactcgaggagctaaaagcgaaggccgcggggaaggggcccttggcacaggtggaattaagaaatctggcaaaaagtaagctgttccttgtgcctgaggagatggtgaccctttatttcatctgtatttaaaccctctctattccctgccataacatcttttggccacgtatagctggaattaaagtgtttgtct

SEQ ID NO: 2771 - DNA, 320 bp, Homo sapiens
  CDS 58..237
cgtttccgaagtggcaagaagaagccactgaaacagcccaagaagcaggccaaggagatggacgaggaagataaggctttcaagcagaaacaaaaagaggagcagaagaaactcgaggagctaaaagcgaaggccgcgggtaaggggcccttggcacaggtggaattaagaaatctgtcaaaaagtaagctgttccttgtgcctgaggagatggtgaccctttatttcatctgtatttaaacctctctattccctgccataacatcttttgccacgtatagctggaattaagtgttgtcttggagctgttgtacatttaa

SEQ ID NO: 2772 - DNA, 506 bp, Homo sapiens
  CDS 170..448
acacatccggtagagttagagcccgtgcggaggcggtgcggasattttcggctctgagcggctgggcgaccggcgcgtcgtgcggggctgcggcggactcccttaaggaaggtgcaagaggttggcagcttcgattgaagcacatcgaccggcgacasagccaggagtcatgagcgacasscgagcagaactacggcgagcgggtctagatccagaagaagctcccgaagcattatacccggtcacgtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttggggctgagcttgtacaccacagaaagagatctaagagaagtgttctctaaatatggtcccattgccgatggtgtctattggtatatgaccagcagtcttaggcgt

SEQ ID NO: 2773 - DNA, 517 bp, Homo sapiens
  CDS 118..267
gctggcttccggtcccctgagactggggcctcgctcgctcccgacccggttgcaagtgttgcggtgggagaaagtcgcgtccgcatcggaggggaagcgccgtcatgcctaagtattatgaggacaagccgcaggcgcgcggtgcgcgggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatsagttgttttcgaatatgtataaagtaaatgattctcttgatcc

SEQ ID NO: 2774 - DNA, 572 bp, Homo sapiens
  CDS 285..497
aattttgaaatgttatgttagttgttttacggtatgttgctgagcgtatsgtgtgcacggttggtgttaagaagggcgtataatctgctgggctttctctattgttgattgttgctaataattctctggttgaggaaaaatatttccttttcaggaacgtattgggaatatatttgaggtgagtaaaggtatatattcttttttgtgcttgggcagaagtactgagtttttactgtttaattgtaataacataaatctaaactattgatacattttgcgtatttatgtgtatatctatgtgtatagaaagtgatacatatgaattgaagctgattactgcttcagaaaagatttgttggctaggtaatatattcacgttgttcaaaattcataagtattctctcccctacccctacccctaccaagttactttcctagagctaaccactgtcatcagttttctttgtatccttccagatattttatatatakaaaagtaattaagtgtatactttacamcctctccccagtattgttttaaatacaaatattagggtactagtcactttgat

SEQ ID NO: 2775 - DNA, 647 bp, Homo sapiens
  CDS 134..472
ataagctgaacctctggcctgcagttccagatccaaggtgactgagacaaactgccagctgccactggcttatcaggagcacctgggctatcttagtttccactgctgcagcctgtggcctggacatttgcccatggttgtgaggtccccatgcatgggacttcttcctcctgactccaggcttcagttcacccatcaggccttaaagcatcttcggccctatcttgccctgaactttttgctgcaaaaaccaagggcactgcctcaagcttatcttcccagccactgtttactgctgctacattgttgcccaagacacttcagaagtgaccattgttgtcatctcctgccaagtcctggaaggcaagccaccaagtcccatgcaccattcccacagcccgacaaccttcctgactctacccactggaatctaaagagtctgcccacttctggatgtttgttcagaatctgctgacacatcaaggccacttttcttaggagccccctgacttccaaaatcagtgcctttggattcatctcttccgggagagttcagtgtcttctgaaatgttacaaaacgtccttcagagcaagaaggcgtacacgaggagctcgactctgtagaaaggagatggacgacatgtctc

SEQ ID NO: 2776 - DNA, 504 bp, Homo sapiens
  CDS 338..487
ttagttgtcttctgaaaaaagagttgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaa

SEQ ID NO: 2777 - DNA, 506 bp, Homo sapiens
  CDS 109..351
aaaggcattcaaggttggtctggccccaagaactgtacagcagcagcagcagttcagctggcagaggtgctgttgctgagctgggagtggaaagcacattttctcttcatgatagatggtgtacctgcacgtgggaaggtgagaggtggtgacagtgggggcggggactccaccatgggacctattgagctggggtcttcatccgttccagctcctggcccagaaggagcctcaccatggcttcatgatggcctcaccatggaacccaagaacacagctgccacaggactgctcctaccctcccaagagccactcttaaacagctgccaaatggcagcmagcaacctggggtgaagaggtgggcagtaaatggatgtggtcctagtgaagtcttctaacaagatttctgacagtcttactctgtcacccaggctggagtgcagtgccacaatcttggctcattgcaacctctgcctcccaggttcaagcgattctcatgctcagct

SEQ ID NO: 2778 - DNA, 490 bp, Homo sapiens
  CDS 256..411
ttcccggagagggggagccgcggggacgcagcgacagactcggggtgctggcagcggcagcccacgcctcccagggattgcaggcctgggcgccggggttggaccagtctcccgggcatggcacgccctggttattctgtacccgtgatttgtggcggggcaagacgttaagttgggtgacaccgaggtgagccacggtcctcggcaccagatgaggaaccactgtctcaataaggtctcagtgctgtgtgtgtaatggttaccgtgagagcttccctgcaatccgaatttgtgtgtctcattctcagtgacaccagtgatgctgttaaacaaggacaatccggttcatggattgtgacaacgcacgctgacatcaagcagaccctgccgtcagtacagagggcaccacagtgaccaggaactgctgtcctttcataccaggttttaggaggctttaccagaaggaatggaaaatgctggtgggcagtaa

SEQ ID NO: 2779 - DNA, 471 bp, Homo sapiens
  CDS 130..438
atgcacgatcagccttggtattggagggaagatgatgcggaacagagtcccagtcacatcatgaaggacatgtaaaatgctgtagaagaacctcttctgcaagaccattcattcatgccttgagacagtatgaatcaagctgactttttttttttcsaaggagtttttaaactccagtgggcactaatggaaatggagagaaagacaaacaagatgaccctgttagctccctgtgtactgcagatgtggtgtaggctgtgctccgaacttagagagaagaaggaagagaggacaacccctctatccccaaattctcttcsaaccctgttctgccagccatctgattggaagcaagagggaagggaggcctgtggtgacctctctcttgacaacaggggaaaacctgaccctagaaaaatcagctcaatcaatatcatgtgatcttatcaaagcaagcaaccctactcccta

SEQ ID NO: 2780 - DNA, 502 bp, Homo sapiens
  CDS 73..429
gggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcggaaaaaaagcttggccagaccacaagcgggaatgcaaatgccttaaaagctgcaaacccagatatcctccagacttcgttcgacttcttggcagagttgtcttcaaacttatggatggagcaccttcagaatcagagaagctttactcattttatgatctggagtcaagtgatctgcaactctttcaccatctgtaatgcggagatgcaggaagttggtgttggcctatatcccagtatctctttgctcaatcacagctgtgacccc

SEQ ID NO: 2781 - DNA, 630 bp, Homo sapiens
  CDS 189..581
acacccgtcctagtcgaagtcgagatttcctttggcttcaaagctctctcaccatattttgggaagttatggatcatcacattcccatgcatgcgttgcctgaagaaatccaaaagaaattgttatacatttcataaccaccaacagtaaagaaaggaggcaaggccagctccttaaatggagtagctatgtgttcctatatttggagaacaacttttttccttcacttaagaatttacgatgtaggcatgcagttaaaaagtcaacaaaatgaatttcagaaagtaaagaaacaactgagtcatttgcaagatgagctaaaaattaaatatagacaatcatacatcttcagtcaaagattgtcagagtacaaatatttctggaataagactctttcattacttacttttactaaaagggaactaaccagtattaaaaatgaagtatatgataattaccaaaactggacttcattgaaaggagcagtttttctacaaattaaatctataagtgaaacagccttgacagaaatagacatactgaataaaagtttgacagtatccagagaaataaagtatgcttgaaaaggraatgraaaatctgaaattgttgtcagatgcagcatattgr

SEQ ID NO: 2782 - DNA, 520 bp, Homo sapiens
  CDS 88..249
gagacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaagcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcagctgtgacaatgcctgccactgagaccaaaaaggtcagccatgtggctgatacaaaaggtcaatacaaaggctcaggagactgaggctgcacc

SEQ ID NO: 2783 - DNA, 488 bp, Homo sapiens
  CDS 119..328
atttttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcgaagcaggactcggggcacttggatctacggaatccagaggcagcattgtctccaaccttccgtagtgacagcccagtgcctactgcacccacctctgggccctaagcscagacagcttcagcagttcctgaattagctacagatcctgagttagagaagaagttgctacaccacctctctgatctggccttaacattgcccactgatgctgtgtccatctgtcttgccatctcacgccaggatgctcctgccactcaagatggggtagaaagcctcctgcaggaagtttgcag

SEQ ID NO: 2784 - DNA, 555 bp, Homo sapiens
  CDS 299..499
atgctggaaatgatcttgtcaagtgaaaagggcaggttgccagagcacataacgarkttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcatcggagagaagtctttccggagtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagatgttgacttgatacaatataatacctatatcttggggtgcttgagtagtcattgcactgcttgatcctcacagcaatcctctggtctcagttttcttttctgatatggtgatgctaa

SEQ ID NO: 2785 - DNA, 527 bp, Homo sapiens
  CDS 90..491
agttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatgggtttgtgatgatccggagctggggagatgacatcagaaaac

SEQ ID NO: 2786 - DNA, 430 bp, Homo sapiens
  CDS 16..210
tctcacgcagccaacatggctccagtggacacgttgtggcggatgctggggctttcctgcggcatgcggctctgcaggacatcgggaagaacatttacaccatccgggaggtggtcactgagattcgggacaaggccacacccaggcggctcgctgtcctgccctacgagctgcggttcaaggagcccttaccggaatacgtgcggctggtgactgagttttcaaagaaaacaggagactaccccagcctctctgccacggacatccaagtgcttgcackcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaaga

SEQ ID NO: 2787 - DNA, 527 bp, Homo sapiens
  CDS 91..315
  misc_feature 471: n=a, g, c or t
tataaatagcaccctagtgagtgctgtcgtccagtctctcttgggtgtggtttgaatgatctcgggatgcatgactaaaatggaattacgatggcagatcggaaacgcgtttataaacaagtgatggtttgtgagtcgactgtcaagaccaggaggtggtgcaccgtgggaggttgccttccctcccatcacttctttttgtttttgagtcagggtcttgctctgttacccaagctggagtgcagtggcggtaccttgactcactgcgacctccacctctcaggctcagcgattctcccacctcagcctcctgagtagctggaattgtaggcgtgcaccaccacgcgcastagtttttgtattttttgtagagacggggtttcaccatattgcccaggctggtcgtgaactgctggactcgagtgatccacctgcctcggcttcccaaagtgctgggattacaggcgtganaamacgcgctcggaggacagatgtgccgtcttgtcctgstgtttcasatcagcata

SEQ ID NO: 2788 - DNA, 504 bp, Homo sapiens
  CDS 123..449
  misc_feature 96..97: n=a, g, c or t
aacacgtgggggcggtgcggtcggagggctcctagtgcgccaggttgtgggaagtgaggctggcggtggcgacaaccgaggaggaggggcgggacnntggagcacggcaccggctgagcgtcatggagggctcaggggagcagccgggcccacaaccacagcatcccggagaccaccgcatccgcgacggsgacttcgtggtgctgaaacgtgaagatgtgtttaaagcagtacaagtccagcggagaaaaaaagtaactttcgaaaaacagtggttctacctggataacgtcattggccatagttatggaactgcatttgaagtgaccagtggaggaagtctacagcccaagaagaagagggaagagcctactgcagagactaaagaagcgggcactgataatcgaaatatagttgatgatgggaaatctcagaaaacttactcaagatgacataaaagctttgaaggacaagggcattaaaggagaggaaatagttcagcag

SEQ ID NO: 2789 - DNA, 485 bp, Homo sapiens
  CDS 174..344
actgtcgcggctgagggggcgtcccggtgtatccgcagcgsccctgtcccgccatatacattccgtgcttttcaaacacccgccgtgggctaagcatgggacccacgtggggcggggacacacggcgataaagagccaggccctcgctgccaaggagctttcccgtaacaccgatgcatcaaacaaaaggcagcagtgaggatgccagagttcatgggtttctagaagacaagttttcaactgcagatacaaacatcaggacgtcaatgtatctgctaggagacacccggacagtgttgagaacacagaacctggaggctaaacccccagctttctatgccagctgagagtctgtgggcacattactcagcgtctctgaacctcatgctcctcccctgtgacatgtagattgctaaacccatctcacagggctatcttctcatttaaagaataaaataacacatgaggggtctaaaaaaaaaaaa

SEQ ID NO: 2790 - DNA, 487 bp, Homo sapiens
  CDS 10..297
agattcaagatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatg

SEQ ID NO: 2791 - DNA, 483 bp, Homo sapiens
  CDS 20..313
aaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggaractggctttcacagaggtttgggttrggttcagttttcttcagaagaaggacttcggaatgcactacaacaggaaaatcatattatagatggagtaaaggtaaatttatttctatgccagatacatacatgatatacatgtaggtactatttaattatgtatcaattaaatagatcataaatgtggaatgatggggacttggagagatttgtaactgaagctgccttaatgcttgttaagaatgtggggtggaggctgggcacggtggctcacgcctgtaatcccagcactttgggagg

SEQ ID NO: 2792 - DNA, 903 bp, Homo sapiens
  CDS 473..700
ttatgttacaggaaccttctgggcttcctttgctcttctggggctcgttatttagagaacatttgtggtccctcacatgtcacctargtggactgcacacaccctccttcttgaacttcttttccttcccccagacactcagagtagcctgcattcttcattagggtgccccagcacttccaagaaccacatgggcccgtgagagggaggtcaaggtcatcccttttgtctcttgttatcatagtcataattctgctgaaaagctacacgatgcagatcccaagatgagagtgaacagcaccagtcaatacctgtagacacacagagctaccagagggagggccatctagggggttttgtagaacaaatgtaggtgcaatgggggttggcagtaagtagccctcgaaattcattactgagctgttggcagctctaggaaaagtttaatggaggagactaaaatacagccacaatgaggtttgggatgggagagaacacgaaatcaaaaaattttagaaattatttatcttgctcccttactgcatdgatgagaaaacagagcagtgattcaccacgatatagcagagccagggacagaacccaaggctcccgactcagtggacagtacacttgccactggaaatcatggtggcatggaaagaatgtgccctttggagtcaagcagctctggattcataactagcattgccacctattagctgtgtgatcttagaaaagttactttgggccaggcatggtggctcacacctataatttcagaactttgggaggctgaggcaggaggatcacttgagctcaggagtttgagaccagcctgggcaacatagtgagacccgtaacatagcaagaccccatctctacaaaaaaaaaaaaaaatgcgaa

SEQ ID NO: 2793 - DNA, 472 bp, Homo sapiens
  CDS 216..431
  misc_feature 9,46: n=a, g, c or t
agtgttttnagagaacttccttgggttggggtgtggagctgggcgntccaggatgttctgtcatcagagactggcgggttctggggaacttggtgccatggaacacagtagggacgttctgcttctcatcaagaacatgaagacattaagaggtggaattgtaatggggaaaaagacttttgcattctggtaaccaactgatcctacccggacccatgatgcataactcagctggtcctgtggcgcacacccagaggccgactcaatgcaagaagactgttttccacacccctatgatttcatccccaaccaagcagcagcatccattccctagccccctgcccaccaaattatccataaaaactctggcttctgagttctcagcaaaactgattttagtaataactccagttcttccacttggctggccttagttaattaaacttattctttactataaaaaaaaaaaaar

SEQ ID NO: 2794 - DNA, 501 bp, Homo sapiens
  CDS 74..226
agtgattcttgaagtgagggcctttctgggcacctactccgcaccaggmtgggttttgggaactgtgccaaggatgctgccctggcagagctcagcatccaatcccacagcctgcagcagatctccaggcaagaacctgtggcgtcccaggggatgcatgagcacagcaagaccctatcacacagatggatctgccaggccggccccatctctcacttcagtgccctgaatgcctcaccagcatcatgtccccatcaccactcttcacttagggtggagaaggagtccacccctggaatgagaggccttcaggmraagatggcaaccttggaggtactcagataatkccaggagctgagggtgtggccaggtggcactctctctggatgacatgctggatggaaccacagccttctacaagaccacctggatcaggagttgctagtgcttacaagtgtgttcttatttactcgtgtcctgaccctcagctgctagaactaa

SEQ ID NO: 2795 - DNA, 455 bp, Homo sapiens
  CDS 94..276
ctggccgccgccgctctcccggcgcggcastgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaa

SEQ ID NO: 2796 - DNA, 460 bp, Homo sapiens
  CDS 96..278
  misc_feature 20,456: n=a, g, c or t
ctggccgccgcccgctctcncggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaaycagnagag

SEQ ID NO: 2797 - DNA, 459 bp, Homo sapiens
  CDS 96..278
ctggccgccgcccgctctcccggcgcggcagstgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagagag

SEQ ID NO: 2798 - DNA, 457 bp, Homo sapiens
  CDS 96..278
ctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaa

SEQ ID NO: 2799 - DNA, 462 bp, Homo sapiens
  CDS 95..277
  misc_feature 18..19: n=a, g, c or t
ctggccgscgscgctctnncggcgcggcasctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagagagaaga

SEQ ID NO: 2800 - DNA, 455 bp, Homo sapiens
  CDS 96..278
ctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaaattaatgaatagtagatcagataaaactagaa

SEQ ID NO: 2801 - DNA, 457 bp, Homo sapiens
  CDS 96..278
ctggccgccgcccgctctcccggcgcggcasctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactagaa

SEQ ID NO: 2802 - DNA, 457 bp, Homo sapiens
  CDS 96..278
  misc_feature 455: n=a, g, c or t
ctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattwaatggaatagtagatccgataaaactcgnag

SEQ ID NO: 2803 - DNA, 456 bp, Homo sapiens
  CDS 95..277
  misc_feature 19: n=a, g, c or t
ctggccgccgccgctctsncggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaatagtagatcagataaaaaycagaag

SEQ ID NO: 2804 - DNA, 458 bp, Homo sapiens
  CDS 95..277
ctggccgccgcccgctctcccggcgcggcastgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaactagaagag

SEQ ID NO: 2805 - DNA, 472 bp, Homo sapiens
  CDS 94..276
  misc_feature 469: n=a, g, c or t
ctggccgccgccgctctcccggcgcggcastgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaactagaagagaagaggaaagancaa

SEQ ID NO: 2806 - DNA, 483 bp, Homo sapiens
  CDS 89..268
  misc_feature 141,156: n=a, g, c or t
acttaaggccgtcgttcgagarrgcggggcctggccctccacgccccgcccaagacctgaacttgcggaaccccggctggcagccagcatgtccccgcaccttttcatctgtccgctgacgctgccctggcrsttcagagntagtgctaargcaangtgctgccgccgcrsccagaactcagtgaggaagggggccgcacaaagggcttcagaggaatggagaccgcgcctccaggtgggagtgatggctcagacccctaccggaatctagccagtgtttcagctcggctccttgtctatacctcgctttcttcgcctataagatggattaacaaatcacgaagttgagaattagaatgtgagctcgaacgttgactaattaagggctttttttcctcgagagcttgactcggcaggtactatgcctggcacatggtaaaaactcaacatgtatttgtgaaataaatgaatttgtgttatgaa

SEQ ID NO: 2807 - DNA, 474 bp, Homo sapiens
  CDS 276..434
gagttgtagtgcagaagctgaggcgcctggtgggttcccacgtgcgtcctccgccccccaccctcggttttaataaccgtaaaaaaaaaaaaaaaaagwtgsktttcccgaacgtgggtacttagcaatacctagtaactaatgattttttgggaaattaaataagatcaaattataagcaatgaacatttcagatgtcgatttaacacagttccaatggaaactgcttgcctgttatctttagttcgtgggggaagcactgtagaagtttagaaatggctagagacatccccagattcccaagcagaatgaaaacttcctttccggaaaacacaaaatgttctcccacatcacaccccgcctgcatttatcaaaaaagaraacacctgatgctggctgtgtgctkttggaaccaraaactttttagcatattatagtcgagtgccagtgacttctttgttctttcagaggcat

SEQ ID NO: 2808 - DNA, 464 bp, Homo sapiens
  CDS 227..433
aagtccttggtttctattacctgctcaactccttctgtgcatagctcctgactgccgagctgggaagaactccagtcctttcctaggctagggattttaacaacggaacaaaatcccagtgctcttcaaggtgacaaggggaaccactaaggtttcacaaggcacagtttgtgaacaactgattggagccagcctcatcaggctagatgtacctatagcaaccagcatggatctcaaaaacatagtaccaaacgaaataagacagactgaggtaatagaagattactatcttctttacctgaactatggtggccagaacacggcaatacatattctgcaagaagacgtctacacaaaagatacacactcaacagaaagggtgccgtggtggggagaagggggtgaggcagagacattaaagggagtgagttattaaaatgtatttaaccaaaaaaaaaaaaaaw

SEQ ID NO: 2809 - DNA, 605 bp, Homo sapiens
  CDS 187..495
tcaattcattccccagtccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgscttctgcaccaagaagaagtgaatgatatttttcatcaatgktatcagatgacatttgacacatgcaagggcgtctgacacacagag

SEQ ID NO: 2810 - DNA, 510 bp, Homo sapiens
  CDS 293..487
actcaactggtaaggaaaaaatgcatcaagtggtcacgagtacaacactagtaaacgcactgtgcatgcwccgcttctaagcgmtagaagccactgcacacgcagacacaccacttaagggaagaatcacaggagtagggacgcaagaccccagaagtatgccaacaggtaaaacctgaagtcagtcaggtgcggtggctcatgcctgtcatctcagcactttcagatggattatttgagaacccttaaccaacattaagaagtctagctacactcctggagtccagctaacatggagaaaccatacagagaggccacatggagcggtggggacatgagaatgtgcagggagggagaggagtccagctgcctcataatcctaccggagcccaggcatcagccatctctgccaacctgcagcacgagtgaggacgcgartgtgccacctggcaagtggatcctctggccccagtcaaggagctgcagctgatggtgcatggagcagagaga

SEQ ID NO: 2811 - DNA, 499 bp, Homo sapiens
  CDS 313..486
gttggtgtcgaaggtgcggaagacgtgctcggcgaacttggaagcgtcgccgtagggaagaagttggcgtagatcttcttgaactcgtccacggtcctgcagcacctcgggccgcagcttgctgttctgtttgcccatggcggctggcagcggcgactacacctgcaagacagggggtcagccggggacgccacccacggccacggagcagggctgagccatgtgccggagagaccaaataagcccatcgctgtgcaagcgctgcgactcagcaactcccgggtcccccatcggaaggcatgccgctatcttatggaccaccaagaaggccaagagactctaattatatcacgacagctcaccctcacactgcgggacacgttctcacttggagaatgtggaaatgcgggggggaaaatgcaacttaaaatcagtggaacagggcatcatccggtgcccaccaggggttgtacgagaggcgaagattaaaatcagttct

SEQ ID NO: 2812 - DNA, 515 bp, Homo sapiens
  CDS 171..458
acttgaaatttgagaagggcaatcagtctggcctcctgcctttctggcctgcaggcccagcctggacaaacaatttaggtggagctcctggaggctggaagcagagaggaggtacctcaccatcctctcctgccagctgttgcagactctgcctggggaactgattaaggatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggagccttcctcgtcatccccctgcaccaggtaaggacacccccaggcccaaacagctctctggaggcagggcaggacagagggaaagtggaaagagcctgggtttctagaaagtcctagccctgcccattactagctgtgtgaccttgagtaagtcatttcatctctttgagc

SEQ ID NO: 2813 - DNA, 832 bp, Homo sapiens
  CDS 235..399
yrwywwkyttwyakcwtkwkwswsywmywkwyymktywrwrrkkkkawwkywktwtwwywryamwgtykkkamcrtktkkkkkkgymwmwywgwrrsymamwtrtwtgyayyrsmmywwryrcwkkkayyrkttcysskgwtwwkrwkkawttwwwkktyywaatrywwmmcwtkrwraswwycwwwgkarkwstwrksrsyasarsakrccyscswgamswkymwrmwrwrgwatgagmkawrascmmrrkyagksktsyksmwmcwtrswkycytkarwtgyycyrkggmwgkrgrwyaskkymwkrwwwcwarmyrystgtrasmwwrrwyytmmmkwwkyawaraawrwwamwwawrracaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcatcactgtaaccaaaatatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcaaaaaaaaaaaaaaaaag

SEQ ID NO: 2814 - DNA, 552 bp, Homo sapiens
  CDS 30..392
aatatattctcttgacccaagtaggttgcatgaacagctcagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagccagtcactaattctacccacggtacatcttctctgtcacagtgatttgagtgtgggtgctatgagaccttccttcttcagaataattctgtctgcaatgaaaaacagtatttgttagcttttaaaatgatagctctgaacttgaatttcctctgcactctccgtgagatgaccagacctgcttgtatatatgcgatgacgacgaaaagtcagaagacattaagtatttcagcatgtctcatttgaaatatgaatttaaaatgatgatgccctgc

SEQ ID NO: 2815 - DNA, 407 bp, Homo sapiens
  CDS 69..233
aaagataaggccgctcgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcttgccgcccggttggatttcgctgagcggcacggctacatcaagggcatcagggaactatgccaccgttatctcccacaaccctgagaccaagaagacccgtgtgaagctgccctccggctccaagaaggttatctcctcagccaacagagctgtggttggtgtggtggctgaaggtgggccgawttgacaaacccatcttraaggctggccgggcgtaccacaaatataaggcaaagaggaactgctggccacgat

SEQ ID NO: 2816 - DNA, 566 bp, Homo sapiens
  CDS 364..546
tttctattgggaagaggcttgtgaccagtacaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaa

SEQ ID NO: 2817 - DNA, 494 bp, Homo sapiens
  CDS 6..158
atgacatgctcccagaatcctggatttggacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcacctggccatcatctgggaacttgctggaaatgcagattttggcatcccgcctaagaccttaaactgaagaagggcctagctctctcttgtaactagcaacagatgcaacctgcatggttcatgcaaactgacctggaagaatggccctggcatttacattttggtccttagatgcagctcagcagcgatctgaactatatcctgggttccagaaaaggcagaggttcttaccgaaagcagggga

SEQ ID NO: 2818 - DNA, 253 bp, Homo sapiens
  CDS 34..201
ctcagcatctggagtagctgggattacaggcacatgccaccacgtctggataatttttgtatttttagtagagacggggtttcaccatgctggtcaagctggtctccaactcctgacctcaagtcatctgcccgtgtcggtctccggaagtgctgggattacaggcctgagccaccacactccacccctaatcaccccttctaataaagacacagctcatgtaggatgagagctaaaaaaaaaaaaaaaaaaa

SEQ ID NO: 2819 - DNA, 529 bp, Homo sapiens
  CDS 142..396
actttttarcacttctgtcaagcatagtraaatttcaacttaraatatcacaagtctaaatcaatcaatgattcatttgtgcatttkactttatttttgagacggagtcttgctctgtcgcccagactggagtgcagtggcatgatctcgtctcattgcaacctccacctcccagattcaagcgattctcctttgtcagcctcccaagtagctgggattacaggcatccactaccacgcctggctaatttttgtatttttagtagagacaggatttcaccatgttggccaggctggtctccarctcctgacttcaggcgatacgcccacctcggcctcccaaagtgctgggattataggcgtgasactgtgcccggcctcatttgtgtatttarattaaaaccttaagactgactttttattcacacagactaggggtgtgcaatcttttggcttccctgggscamgctggaaggagaagaattgtcttgggscacacatwaaaatacactarcactaatgatagctgr

SEQ ID NO: 2820 - DNA, 1035 bp, Homo sapiens
  CDS 57..224
  misc_feature 34: n=a, g, c or t
aagtcgaagcggagatcccggggtcgcgcgagancgcaagcragttggtgggcgctatgctatcacccgaggcagagcgagtgctgcggtaccttgtagaagtggaggagctcgccgaggaggtgctggcggacaagcggcagattgtggacctggacactaaaaggaatcagaatcgagagggcctgagggcctgcagaaggatctcagcctctctgaagatgtgatggtttgcttcgggaacatgtttatcaagatgcctcaccctgagacaaaggaaatgattgaaaaagatcaagatcatctggataaagaaatagaaaaactgcggaagcaacttaaagtgaaggtcaaccgcctttttgaggcccaaggcaaaccggagctgaagggttttaacttgawccccctcawccaggatgagcttaargctctcaaggtcatcttgaaaggatgagactcaaccaagatgggggaccagcaaccccccagggtcatggaggacccaggaccctccaaccttgacacctgtaagacaggatctgccctgtaaggccagccgtcagaatctggccatgaaaacctctttgtagtgcttggctactctgtgatggcaggagggaaccttcagcctgtctggctgactggacctggacaccagggstcggtggacacaagatctattgacgggccttggtagccaccagtgggtgtgtggggcagtggctgtgggggagtaagaatgactgcaamaggsacttcccaacaatggcctgctgttcacatggaccctgagcaaggaaggagggagggaggggcagagtggagtgtcattccagcattcctctcagaagggagagaggttttcaggctggtgccatgcgattggaataaagcaggaggctcatgggtggttgctgaatgaagaacagaatcttggtgctttgtggctcaccacagccatctgtggggcaggcacacacacctcccgccagctccaattttgsactttttccctgcttgattccaagagta

SEQ ID NO: 2821 - DNA, 492 bp, Homo sapiens
  CDS 167..361
  misc_feature 453..455: n=a, g, c or t
gttcgttcgaggggaggcgcgcgagttctgtgcggtggacttgtgctcccgcgaggggcgtgtcctttctcgcgtccgcagtgtccctgagggtccgtgtctacacgcggctgtgaggaaggaaggcgcgtgccgcgtgggacgggctccacctgcctgcggacagatggagggtcactttgttccgagaagacccagacacccgagggaggatgtgaaacggaacgacccgtttcgagtaataacaggatggagatggagtttcatgacaaaaatgaaggtgaatatgatgtggaaaatacaaagatggaagcaacaagctaaggatgctggggcagaaagatggaacctgggttactcatgacatcttgaaactgctgcagccatcctagactggctgcctctagacttaatatgtttagaaagtaaatcccaattttattaaactgrdgnnnsggttatgtatatatgaacacattcttagctaataar

SEQ ID NO: 2822 - DNA, 509 bp, Homo sapiens
  CDS 114..275
atgtttggagatagacttcaagtcccggaccttatccgtgcgccgcttcggtttgcaggtgacctttgcgtgcgggcgccccttctgattgaccctgatgagctgtagctctgatggcccctccttcgggaatgattagggtgacggctggccggggctcgttcgagtggcgcccggccggtggtgacccgaacaggagagcgggacggcgaccattctctcgggrggggcccatctggagaaagtcctctcgcttggtcaaactaggagggcgatagcaccggccttactgcgacgatgacaaagtacaacacaccgtctggcgcgaaggagatgctcgagaaccctttgctgttgttatttttcgcgtgtcctccgaaaccaagggaaatgcggctctgtgggttctgttaacgtcagcatttaataagtgaactctaaatgcattgccccttatggtggccgctggctcctgagttgactcagctcttgcaacgtagctagttgat

SEQ ID NO: 2823 - DNA, 515 bp, Homo sapiens
  CDS 230..502
gagcaggtcgcgtcactgcagctgcgagcgctgcgttttcggatttcggcaatagcttccgaccccgggcttgagtcctaagctgcggactcgcctccccagtgggcatctcgcaggccagccagatgctgctttggggcggagttggactttttatttttttgttgttgttgacgcttattatcttttggaaaaacaggcatagatccccattctcgggacttcccagatgttctgcaactgggggattagaggaatggtgcaccctgggacccaggtggtgccttcgaagtccagggtgttcctcgattttaaccagggaattaccgaaatggagggttttttccccactggggcatttggcttttcagattttgtaacctgctttcccttgttcctcccaccaacaaattatatatattatttatatgttatatataacgtattacatatatgtattatatatatgattacacataatatgtatcattataggaagagttagaaatactgga

SEQ ID NO: 2824 - DNA, 524 bp, Homo sapiens
  CDS 144..374
aaagattagtttgtttaacccttataataatcttatacagtaggctctattatgattcatatcttacagaagagaaaaccaaggtttagaaaatttaaggatcacacagctgtaaagcgtcagaactaggattctaaacccaaatgtccaataattcaaaatcttacctatgtttcatcatacatcactgtgaacccctctctccttgctttttcatatttgcttatttagaaagggaagggttcaactttaacctattgaaattgctaaactcaggcttttctcttcaagatgaagagtttcattgcattttattcagaacttcaagtctttctgactttccttgtgctctttgttttcttgtgaaacttatctgaagcaactgttcatgaagaaacaggcacagggcatttctgaacacttacggaaacttttttttatagtaataacttgtttatgcaagtaacactgttctctgctctaaaatttcccagtgactcctcctaatgaatgaacctaattaa

SEQ ID NO: 2825 - DNA, 524 bp, Homo sapiens
  CDS 195..464
ctacgcgaggaagatggctgcatcccagcagcaagcttcagcgcttcctcagctgctggtgtatcgggtcctagttcggctggcggcccgggtccccagcagcagccgcaaccgccagcacaactggtgggccctgccagagcggcctcctgcagcaacagcaacaggacttcgatcctgtgcagcgttataagatgctcatcccgcagctgaaggagagtctacagaccttgatgaaggttgcggcccaaaacttgattcagaacacwaacatcgacaatggacaaaagagcagtgatggacccatacagcgctttgacaagtgcctggaagagttctatgcactctgtgaccagctggagctgtgcctgcgcctggccatkagtgcctgtcacagagttgtgacagtgccaagcactctccaacgttggtgcccacagccaccaagcccgacgcatgcagcctgacagcctcccctacccacagtacctggcggtcatcaaagcccagatttcctgtgccaa

SEQ ID NO: 2826 - DNA, 469 bp, Homo sapiens
  CDS 94..270
  misc_feature 63,297,335,407: n=a, g, c or t
actaactagcaaacggggactagaaatagggatgctgaaaagcaacggggagagacgcagtsnaacgcacttccggcggtctacgcgaggaagatggctgcatcccagcagcaagcttcagcgcttcctcagctgctggtgtatcgggtcctagttcggctggcggcccgggtccccagcagcagccgcaaccgccagcacaactggtgggccctgccagagcggcctcctgcagcaacagcaacaggacttcgatcctgtgcagcgttataagatgctcatcccgcagctgaaggngagtctacaggtgattggccttaagcagcgagaagcanactggatttggtagtctagaggggcaggccgggggccaggttagtcggagagagcgctaagcagaaagaggnatagaacctgctgttttggcctggctggtgcacgcctgtgttcccagcactttgggaggccg

SEQ ID NO: 2827 - DNA, 476 bp, Homo sapiens
  CDS 199..456
  misc_feature 33: n=a, g, c or t
aacgaaacggtaaccagccctgggaagcccgcnagaggcctcagcggtggccgtccgagcgccgagaggtgagggtgcccccgcctcacctgcagaggggccgttccgggctcgaacccggcaccttccggaaaatggcggctgcaggcccagcctggssragtcctcccaggatcctctgtcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggcgctggcaagacctgcttcagcatggtgcctgccctgcagcaggagctggacagtcggccccagctgcgctctgtgctgctctgtggcattgaggcacaggcctgcatct

SEQ ID NO: 2828 - DNA, 516 bp, Homo sapiens
  CDS 111..323
wrwtgtttatctcccgggacgtgggcagaccttgtaccaggcgagctctcgctttgctagcaaaagagctcctctcttcccaaaccctgctactacgctgtccaccccgtatggtctttgaggtctttgaggtttttttggaattcacttgctggagactacagctcacagaacgccctgggctggattgtgccagctgtagttcgcgaaccaaggacatttcctggaaatgcatgcggccacgtatctgtgacagaaatggcagttctcacgtgcgttacgccccctggaaggacttggaaatacggaacttgagtgagcactgagaggatacagaccctcatcctgggaggagtcactcctcccgcagccatcagagcctgacaaccgcttctcaccagaggcgcttcttagaccctgaccttgcccggctcacccaaagggcaatggccttctttgtatgcaagccagacagtctactgttgtatatttgaattttttactttatttttaata

SEQ ID NO: 2829 - DNA, 498 bp, Homo sapiens
  CDS 155..391
tttagttcttacaggttttggggtaggcagtggagttaggagtgctgttttgcgggcaggggatggatcttacaaagtacattctcaagggtggggagaattacaaagaaccttcttaagcgtgggagagattacaaggaaacttcttaaggaaatgtgtcctgagaatggatcttgtgtacctgatggtccaggtcttttgcagtgtgtttgtgctgatggtttccatggatacaagtgtatggcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcact

SEQ ID NO: 2830 - DNA, 535 bp, Homo sapiens
  CDS 82..372
atagatatattcagtattggagggctatcacagagaaaagaagttagatatatttctaagcataaaactagggcccttgatatgaaatggtgccaggaaggcagattttggctccacataatgaagccctctcttaacacttgttttttcactaatagaaggcctagtgttgaagtcagtgagcctttttctctagaaatattcaaaagatgggtagataattgtccatcacaggcattgtgcaaggaaatctaccatgggagagcaatggagacagagttgcttatccaagggcagtctagcaagtggcagagctggggcgtgagtccaggcagttttgttccagagtccgtgctcttggtcaccttactttgatgcgtatcctccaccagcacactttgagaaacaccacagtaaggaatacgcacacagatgtgacaactgcccctacaaagcaaatcattcctgtcaattatggatacctgtctcatttattgaaaacctacttcgtgccaaggactctggtagacagaca

SEQ ID NO: 2831 - DNA, 421 bp, Homo sapiens
  CDS 79..228
aactgttaaaatagcaaatgaaaatcagaagggaggtgcagtgacagcgaacccactttttccctttggaccccagttatgaagaaaaaattggaaactgaacttgtgacctataagatgaccctagacccaagaggctgggttgaagagagggcacagctcagttctagcacagccaatgccttttacgtgtgtaatttggtcccaagaagacccagcctgcaagcctagtggaatcagaatagagaaaagttctcattctgcacatacagcattcagagcctcgtcatcatacattatagatggtatagcatccagccaggtgctgatgttataaaaaatgatggaatttactcgaggtattttttctcctttgctgcaaatggtagatatagcttgaaagtgcatgtcaatcactctc

SEQ ID NO: 2832 - DNA, 625 bp, Homo sapiens
  CDS 181..588
gactttcgsaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactatatcaaagtcaaatatgactcagtgtgagtggtcatcatcttttgtgacatcccagcagcag

SEQ ID NO: 2833 - DNA, 461 bp, Homo sapiens
  CDS 74..271
gtatagctgcataagctgctcgtagggcacgtccagcatctggtccaggcccacaccgcgattcaaggggtacatgtacagttttgttacactgcatattgatgaagtctggacttttagtgtacccatcacccaagttatgaacattgtacccaagagaaaaaaaggtttaccacagtggctcaaggaaaacggaaccagagtaagacagtttctacttggacttggggaaccagcaaactcattcacttacaatcaagaacaaaccgattaaattgaataaagaatctggcaaatctagctactatggtttggcttagtgtccccacccaaatctcatgtcgaatgtgctggagaaggagcctggtgggaggtgattggatcatgggggtgaatttcctccttgctgttctcatgaatgtgagtaagttctcacgacatctgatggtttaacaatgtgt

SEQ ID NO: 2834 - DNA, 508 bp, Homo sapiens
  CDS 103..330
acgttgcttccggtgcctggctccgtttcctgcttttggttcttacagtagtcggcgtaggccttagattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactggggctcatccacaaatgccttgagacagctacaaggatttccattttatggtaaaccaatgcgaatacagtatgcaaaaacagattcggatataatatcaaaaatgcgtggaacttttgctgacaaaraaaaraaaaaagaaaagaaaaaagccaaaactgtggaacagactgcaacaaccacaaacaaaaagcctggccagggaactccaaattcagctaatacccaa

SEQ ID NO: 2835 - DNA, 400 bp, Homo sapiens
  CDS 99..308
  misc_feature 21: n=a, g, c or t
atttccggtagcggcggcggngaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatsttcattggcaccttcaaggcttttgacaagcacatgaatttgatcctctgtgactgtgatgagttcagaaagatcaagtgtgtgaggggggagagcttgagtttctggcctcattgcctatttgtaaagctgtagcctaaagggctctcccaatgcagcctggtctgaaactgctttaagaagcctctgacccctcttcagggccaaagaactccaaacaagca

SEQ ID NO: 2836 - DNA, 542 bp, Homo sapiens
  CDS 33..230
ttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgawggctttacaggggctgaatataaaagcatttgtacttaaaagaaaaaaaaaaaaaaaa

SEQ ID NO: 2837 - DNA, 467 bp, Homo sapiens
  CDS 100..276
aactgcacagcctggaggatctaggaacctgtagctatctgataggaagccaagaatcctgatttggacttcccgagcgtggtgatcttgtagctgggcatggccttgcacagaatggggagctatgcccagagcgtgtttcaagagctttggctcctgtggggcgtgaggctcttctaccaggatagcttccactcctacctctctgcacctgaacagactcccacgtgcactgctgcaagggtgcctgcagaaggcgacttgtcctccatcctctgaacagacccagtgccctatgtgdcccacggtcatctgtgagtctgaatgttcacaacctaagaaggtgacctgttggcagacggggcaataacatttcaacttcagaggactgttgtgagagtaaatgaggtaattggcctgtcatgtaccaagtggctcaaaatgcagaagctgttattaattacata

SEQ ID NO: 2838 - DNA, 517 bp, Homo sapiens
  CDS 161..490
attccctgtgtgtagcgtctagggcagcctttgccctggttccagcagatgggttgtctcttcatagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgwtcatggagttttgtgttgaggacagcaccgatgtccacgtgcttattgaggatcaccgcattgtgttcagctgcaagaatgccgatggagtggggttgtacaatgagattgagttctatgccaaaagtgaactccaaggactcccaggataagcgctcttcccgctctattacttg

SEQ ID NO: 2839 - DNA, 469 bp, Homo sapiens
  CDS 11..205
cctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaaggacccaaccgcggagtgatcatcaccatgctggtcgccaccgccgtctgctgttacctcttctggctcatcgccatcctggcgcastgaaccccctgttcgggccccagctgaagaatgagaccatctggtacgtgcgcttcctgtgggagtgacccgccgcccccgacccaggtgcccagctctcggaatgactgtggctccactgtccctgacaaccccttcgtccggaccctcccccacacaactatgtctggtcaccagctccctcctgctggca

SEQ ID NO: 2840 - DNA, 414 bp, Homo sapiens
  CDS 130..333
atcgccatggtgatgggattagggatctcctgcccttggtcctaagtgccactatctgtgctgagtttttcaaacgtcagagcagattgaaccattgtggtttcattttccctgattttgatttttcttatggggaacctgtgtggctgcattcaaggtgactcgaagaagccttccaaaaagcgtgtgaaaaggaagccctactctactaccaaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgaaaaaaaaaaaaaaar

SEQ ID NO: 2841 - DNA, 284 bp, Homo sapiens
  CDS 21..182
atttttatatttatatatatatgcwggcccaccagcatccattcctgcagcaattagctaagactggagggtgggccatgttcccttcagrmcaccttgcccattcatcatggactgaaagaaaacttcctttgaaaaggggwtgggggagtttccctggaggtgttcaggcaagaaggaaatgaccrttagaggaaaagatgggcctctctactgttgttaatggctaaataaattattaaattgttaaaaaaaaaaaaaaaaaaaaaaaaaaaaaaaaaaaa

SEQ ID NO: 2842 - DNA, 453 bp, Homo sapiens
  CDS 85..267
tttgtttaccagtccaggcgamgctgtgtcgcggttctcgccgccccgagcgccttggtttgctcccttgacgtgtaattcgtaatgaaagtcatgttttcatttgggaacacggatcggaggtttaaaactggacagtttaagtgtcaacttcagaccaaagaaaataatggtagggaaaacactggacactcagaaatcggtgccgcgtcagagctgtcacggaagatgtttctaatgaacctgaggaaaacaatagcaccaccctaaccagaactaaaaagtggcaagcagccacagttaatgaaactcataggtggcatttagttacttatttagaatgtaggcctagttatggtaaaaatgcaaataagaccaaacctaaggtcatcttgctcgagcaacctcaagcaaaacctacatgatttaagactgactcttgaagcgaagtaa

SEQ ID NO: 2843 - DNA, 473 bp, Homo sapiens
  CDS 216..395
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgctgtagtcccaagtagctgggattggaggtccccaccaccatgcctggctaattttttgtactttcagtggagatgggggttttgccatgttggccaggctgttctcgaactcctgagctcgggtgatccaactgtctcggcctccaaggtgctgggattacaggcgtgasacttgtgcctagcctgagccaccacgccggcctaatttttaaattttttgtagagacagggtctcattatgttg

SEQ ID NO: 2844 - DNA, 500 bp, Homo sapiens
  CDS 111..335
agttacggcgcaggcgcaagataagctaggagccgcgcgagtcgtagtgtcgctgtttgcgggtctccgcgcgggaccggggcgcagggggtcgctgaggcgagggtgtcatgtcagacaacgaggacaattttgatggcgacgactttgatgatgtggaggaggatgaagggctagatgacttggagaatgccgaagaggtcagtattcagcctcaggctcccacctctgcagcccaagctccaaatcgtctgacaggaaggccaggagaatgtcgagatcctcccctctggggrcgaccgcagccaaccagaagcgaatcaccacaccatacatgaccaagtacgagcgagcccgcgtgctgggcacccgagcgctccagattgcgatgtgtggcccctgtgatggtggagctggagggggagacagatcctctgctcattgccatgaaggaactcaaggcccgaaagatccccatcatcattcgccgttacctgcca

SEQ ID NO: 2845 - DNA, 567 bp, Homo sapiens
  CDS 193..504
agtgatttcctctgggttacggcgcaggcgcaagataagctaggagccgcgcgagtcgtagtgtcgctgtttgcgggtctccgcgcgggaccggggcgcacgggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctgggagcgaccgcagccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcastttatatgtgt

SEQ ID NO: 2846 - DNA, 493 bp, Homo sapiens
  CDS 159..470
gataagctaggagccgcgcgagtcgtagtgtcgctgtttgcgggtctccgcgcgggaccggggcgcacggggtcgcttaggcgagggtgtcatgtcagacaacgaggacaattttgatggcgacgactttgatgatgtggaggaggatgaagggctagatgacttggagaatgccgaagaggaaggccaggagaatgtcgagatcctcccctctgggagcgaccgcagccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcc

SEQ ID NO: 2847 - DNA, 499 bp, Homo sapiens
  CDS 162..473
atagataagctaggagccgcgcgagtcgtagtgtcgctgtttgcgggtctccgcgcgggaccggggcgcmgggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctgggagcgaccgcagccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttctgcccttg

SEQ ID NO: 2848 - DNA, 496 bp, Homo sapiens
  CDS 159..470
agataagctaggagccgcgcgagtcgtagtgtcgctgtttgcgggtctccgcgcgggaccggggcgcmggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctgggagcgaccgcagccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttccctgccct

SEQ ID NO: 2849 - DNA, 521 bp, Homo sapiens
  CDS 16..180
tttaattcgttctccatgaaggattttcatttcagtgaaagtcgcagcagaagagggaactttctggagtttttgagaatgccaaaccacatttttatcacacttctttggaaatcaatgcctttgcatagaaaatcaaattcagggaccacaaagaattttcagtgggaatgtctagtctgaggggtctgaggttgtttttactttattgtgttgtttaaatattttaaaaatatctttagcgtttggtctttttttttctgtaaacatttaatttggtctgagaaaagctgaatgtttgggtgtgacgtttgactgaggtggattggggctgcctgtggacattagtgaacaggtggtaggcttcaggaatatccagttttaatcagttgcatttggtacagaattttgagtaatggtgaaaattgttgtctttggaaagcacaakagatacctggaaaggcagttcggctcaggtagctacacataacattgtgtatgattttcacttcaagctgtct

SEQ ID NO: 2850 - DNA, 453 bp, Homo sapiens
  CDS 127..282
aactgtcctatatgccaggggttctcaacctccagtccaagggcctgtaccagggtccatggcctgttaggaaccaagccaccaccaggaggaaaacaaactcagggctcccaccgawdctacattatggtgcctgcagacactgccaatcaggaccactttaaactaaattttcagcttgaaaaaaaaagtttagcctataggaataggactccagaattacgtaagtgctggtttataaaggcaaatgctgagggtatattctccagactccacccagattagtcttcttcattagggattttccccctgtcattttgtattttgttctgattcaccattcactgaggatgtggccctttgggttgtcactaaaaccaaaactctaggttctgggggaaccagcagatgccttgagcacaccgcagagtcaatgcttccttagctatctgg

SEQ ID NO: 2851 - DNA, 470 bp, Homo sapiens
  CDS 258..416
agactggattgggatctacgctgggccacccactagcaggcgtttggccaaggggctcagtggcctcctctgtgcagaaggggaggagactgggacccctcccctgtgacctcgctggggagcagattgcggasagccagcaggcgccacgagccagccgggagtgcaggagggagaactttcctgtggacgtcctgtgttctccagacgcagagaaccctcatcaaccgagggggaggtcacttccgaatccacagatggcgtgtgagtgcatggcgagcgcctccaggacacacttactgttcccttgctctggccagacgccagccggaccctgtgtgtgcgcgccgtgctgctctttgcagctgcctgcaagggttcctgcgaagaccagcaccttggggaagagcctgcgctgaacttgaactcgcagctacctgagtcagacctgtgctttttcacctctacgg

SEQ ID NO: 2852 - DNA, 512 bp, Homo sapiens
  CDS 78..233
atagagtaccggaaaaagctcgagcagaggggtcggaaagggaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttcttgactcttttacatcctcccttttcaaaagggctacttggtgaattgggatgttcagagacaagtttgggattacctttttggaaaagaaatgtatcaggcattcaagaaatgggaattccagaagctattgtctattcaattcaaaatctacctgaagaaatgcagccgcatttttttaagaacattgtcttgacaggaggaaattcccttttcccaggatttagggatcgggtttactcagaagttcgatgtcttactccaacagattatgatgtct

SEQ ID NO: 2853 - DNA, 483 bp, Homo sapiens
  CDS 84..275
gccattttcctccggaagtgcggatcccagcggcggtcgtgtagctgagcagccctggggcttggttctatgtccctgtggctatgtttccagtgtcctctgggtgtttccaagagcaacaagaaacgaataaatctctgacccttctcaggtgcagccagagagacactagcccactgatggacggacagacgtgggcagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaatgagttttgagaagcgggtaagctgtatgttttgtggttttgtttcataaattcatctacaggaagaccaatattgactgaatgaagctttcatttaaagagctaaaatatgctttgtgtttttatatgtg

SEQ ID NO: 2854 - DNA, 522 bp, Homo sapiens
  CDS 76..324
acatccggcgccggctttcggcggaacggtcgccgcgttccatcgtcgcgcggcccttcggggcccgagcccgcaatgtcgggccccaacggagacctggggatgccggtggaggcgggagcggaaggcgaggaggacggcttcggggaagcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaacygggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgc

SEQ ID NO: 2855 - DNA, 527 bp, Homo sapiens
  CDS 259..465
gttagcgggagaggcagagatattcagaggtcttttaggatgtgctaaagggtcgtaagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtattatcagcagggcatggtggctcacacctataatcccagcactttgggaggccaaggcagccagatcacctaaggtgctaaagaacatacagacacagagcagacaggccacctttgcaaccacatggaggtttgtctgatattgaagctaaagaagctaagctggaagacagagagaccaagtctgatgacattgttt

SEQ ID NO: 2856 - DNA, 528 bp, Homo sapiens
  CDS 88..513
ataaatggagcgacgtaatttcgacctgtcctttcccgggagttagcgatccctcaacccctgcamtksgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctmcatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatggtagggccagcctcaacctctatggctttagtctagaaactgaaaggg

SEQ ID NO: 2857 - DNA, 444 bp, Homo sapiens
  CDS 271..426
tgacttaaaacaacaaatatttattatctcacagttgctgtgggtcaatacaagtatagctcaactgagtgcctttggctcaaagtctctcctaaggttatagtccttccagaaaaggactccaccataatttgaagactcagtttggggaggatacacttccaagcccacttgcttgatttttggcaggctttgctcccttaagatattggactatagatactgatttcttgctggctgttgattggaggcctccctcaattcctcaccatgtggacatctctacagggctgtcgcataacatggcagcaggctttcttcaaagcaagtaatccattaagaagagagagagaatgcatgcccaggatttttcataacctaacccctgaagtgatatcccatatgtctgtctggttccatttaatgtgactgagttgataattc

SEQ ID NO: 2858 - DNA, 496 bp, Homo sapiens
  CDS 179..343
aattagatgaaagctttgcataggctttttccccaggaaagggtagctagtcaaacatggaattttttgctcgaatttcaaggggcatgggaagaagtactatcttcccctaggagcaagttaattattaccggaatggagaatccgagagacttaattctgcgaacccacaaagaagatgaccggaaaggaaggacatgactgtgtcagatcagtgctagagctgcctgcccacctgtttgactcaggtgaaattctttggtacagtcttaacaaggagttgtggatcattggaactaggtcttggttctatttgagtcatctgtttttctccagagacgagtaaggtagtcagtgaggagccttctggctgactgcacttttgcatttcttgacttttaaaaatctccccttctcatctcccacttaaaaatctttgaaacaagtagattgatggacactacagaaaagcatcaaaatttcattcttagttttg

SEQ ID NO: 2859 - DNA, 488 bp, Homo sapiens
  CDS 119..334
ctaagaaaaattcttctgccttgagattctgttaatctataaccttacccccaaccccgtgvtctctgaaacatgtgctgtgtcaactcagagttaaatggattaagggcggtgcaagatgtgctttgttaaacagctgcttgaaggcagcatgctccttgagagtcatcaccactccctaatctcaagtacccagggacacaaacactgcggaaggccgcaggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaaagcctcttgcagttgagacaagaggaaggcatctgtctcctgcccgtccctgggcaatggatgtcttggtataaaacccgattgtacgttccatctactgagatagggaaaa

SEQ ID NO: 2860 - DNA, 510 bp, Homo sapiens
  CDS 219..398
atccatcttaggaggtacagactacagggggccgtggcttcctcttaaccgcggcagctgctgataaatactgtactattaacagtgaggcccggcgtaatttccttattagagggcttctttacgtctcttcatcccaaactgggaaatggtaattgaagaaacccttttctttcaaaaatcccaggcctgtaccctgtctttaggcagcgtggtgtatgataggagcgtttttaaaaaatagtttgatcagcagtgagggcataaagagctgcttctggaacctgcagcaccaaatttctcttcaggaaactaacagacttggttgcaatacggttggtgagacagatatcaattttttttwaaatataaaactccctgcctgtaatcccagctactagggaggctgaggcaggagaatcgcttgaacccgagaaacggaagctgattagctgggcgtggtggagtgcacctgtagtcccagctacctaggaggctgaggcaggagaa

SEQ ID NO: 2861 - DNA, 486 bp, Homo sapiens
  CDS 225..455
  misc_feature 336: n=a, g, c or t
aaatcccaaaatatgtggaagattaaacaacttctaaataatacatagttcaaagaaggaatctcaaaaacacttaaaaatattttgaaataaatcaaaatgaaaatacagtttatcaaaatttgtgagatgtagtgaaaccagagcttagaggggaatttattggattgaatgcatttattagaaaagatgaaagatccaaaattggccgagcgcggtggctcatgcctgtagtcccagcactttgggaggccgaggggggtggatcacgaggtcaggagattgagaccatcctggctaacatggtgaaacctctctctactaaaaatacaaaanattatccgggcgtggtggtgggtgcctgtagtcccagctacttgggggtgccgaggcaggagaattttgtgaacctaggaggcggasttgcagtgagccgagatcgcgccactgcactctagcctgggcgacagagtgagactccatccc

SEQ ID NO: 2862 - DNA, 490 bp, Homo sapiens
  CDS 161..412
attgctgttatcaggggtcattcggagggtgccgaggactgcaaaggaaataaaacatgcctggaaaagcactgagtgagatgatcatgtgaaataagaacattatcagagacagtgaatttctcatggaagaaacaatcagcactccacaggaaggcaaatgcagggtcttccccagaaagcccaagccctgtctcagttgtggccaactctcagagatgtaggtggtgcaggtgctattcgtaacctcagcccatccaagagcatctggagaagggcttcagggttgatcttgacttctgcagagtcaaccaccagagtccttcagatccatgcctggcacagcattcctctgaccctgactgacattccccactcatctctgatttcagaagccggacacccttggagataaagactccatggcaatgcaaaatgatcacctgaaggccaatcagggtcaacacagcttttctagactgcagaaatg

SEQ ID NO: 2863 - DNA, 599 bp, Homo sapiens
  CDS 243..575
taagatagggtataarargcagggtggcgggcggaaaccggtctcattgaactcgcctgcagctcttgggttttttgtggcttccttcgttattggagccaggcctacatcccagcaaccatgtccaagggacctgcagttggtattgatcttggcaccacctactcttgtgtgggtgttttccagcacggaaaagtcgagataattgccaatgatcaggggaaaccgaaccactccaagctatgkcgscctttamgggaacactkaaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaatsgataatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctac

SEQ ID NO: 2864 - DNA, 495 bp, Homo sapiens
  CDS 173..322
ccaaacagcagcttccggagtcggaaggagctgaggaagaagactgactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatgggaggatattccaggaagaggacataagtatcgccttrvatttgctgttgahgdwattatacaaaaacaagttaaggtgaactgcacagctgaagtactttacccttcaacgggacaagaaactgcaccagaagtcaacttcacatttgaaggagaaactggaaagaatccagatgaagaagacaacacattttatc

SEQ ID NO: 2865 - DNA, 497 bp, Homo sapiens
  CDS 4..162
ctgatgaaattccacaacgtgtgcctgctggaggcgtacaactgggtgaaagcccggcgacctgtcatcaggcccaacgtaggcttctggaggcaactgatagactacgagcgccastytttgggaagtcgacagttaaaatggtacagacaccttatggcatagttcccgacgtctatgagaaggagtcccgacacctgatgccttactgggggatttagtgccactgaagcctgcgtcasaccccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttggaacagtttaataaa

SEQ ID NO: 2866 - DNA, 494 bp, Homo sapiens
  CDS 238..405
tagataagcaatatgaacccttaccccaattacatctgcatatctgagatttctttcagcattttatgattaattagatcactcaaattagtaatgattatcattgttaatttaaaaaatggtggcattacaaagactaggacgtataatggtttttggtttagaaattggaaattgaccaccaaaaaacaagaaactcactaagtgacttggaaaattattctgcctgtatatattatggtcttttctcaaatggtgaccagagtagcactggcagtggaatcacagactgtgctccctagacatagtgattcctgggccaagctcagaactcatgaaccggaatctcagggtggggaagcgtggaagagcagaaaagtgaagatcgaaaatagtaatcttcaatgagactttccatttagccaactgtcattacaaattctgtagttaagcacttattattgcggaagtacaatatgaagtgcttttagagt

SEQ ID NO: 2867 - DNA, 539 bp, Homo sapiens
  CDS 160..333
aactggtttacgtctgttctttgtgttgctatagacttgttgtttgggtttgtgttatctttttgacctgcaggactaatagtaaaagtctgtagcttcagttatagactaagattactactctgccagaaatagtgaataaagaatcaactgggtgggatgaatcacgtttcacttgtgctgcccaggctggagtgcagtggcactatcttggcacactktggcttatgtctcgggttcaagcgattctgctgtctcagcctcccaagtatggattacaggacaaatggaaggaaagatttttggaagcagcttcttgtgtccgacccgctgtgatcagctgctactcccaggtctggggttagatggctttgtgactttccttctctggatggcattttgctttcctctgtaaaatggtgtaatgaatgagatgacctctaagcctctttccatgtctgtcactggactgtcctcttatgtagccatttaagttttctaattaaaaaaaaaaaatttaaaaaaaaaaaaaatgcgaa

SEQ ID NO: 2868 - DNA, 713 bp, Homo sapiens
  CDS 468..617
attgtggcatatctctgggcacatcaaagaagtggtgtaatttttctctcattccaggactctagtctcagtagggattgtgacatatcactgggcccataacctatttcatgtgattctagtatcctgcttgggccctgcttacaggaaagattgtgacatttggctgggcccatcacctagttaatgtgactctccttttcttcctgtgccctgccctcagtggagattgtgacaaatttctgggccaatcagctgtgcaatatgactctgctctttcctgggccctgctatcggggagcattgtgacatattgccaggctcagcacctaggtgaaattgtggcatatacctgggtccagmtcasaggcacaakratgactctcttacctggacacagccagtgggaratattttgayttytgtagccaggcttaggccacaggtggtttggtgactctcaaaccatgattcagcagacctgtgaggctgtgagttccctatcagaacacaatcggcagccaatagatgaaaaaagatgcaaagaagacacatttgctttttatgcacacatcacttccagtcactatgttgagcagagtcagtgtgaggacaattgagaatagcagttttctggcaggasagccacttctcagcagaagatgacacaataaaagtataaatctttcatgggatggctcacatattttcag

SEQ ID NO: 2869 - DNA, 476 bp, Homo sapiens
  CDS 49..201
caaaatattggtcaaagtctaaaattatacagcaagaacttcattaagatggagatggatggttctatttcttctaggggtcctcatcctccttccccctccccaaggtcttgtatgatcttacattcttctatcattcaattctgggttataaacatgaaaagattgatagacctgatagttaagaaagtaggaaaatgttgatttggaaaacaacatttgaacctcaatcagcatatagctaaaacataaatttcagtaatttatgaagttgcagttctcaacaatgaaagtttgaaacaaacattaggaaatgttcaccattgtcagtaatctgagaaacacaatttaaggtaacctgagcttaccttgtacctgctaagcaacaaaatatttttcacaaataatgcttgctgctgatgagattgagtttaaattgatagcccctttggaagttaatatcacaataatcatag

SEQ ID NO: 2870 - DNA, 531 bp, Homo sapiens
  CDS 189..455
ctttttccgcttccggtgtcccctacagtcatggctgccgccgtcgctgctgccggtgcaggggaacccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttgg

SEQ ID NO: 2871 - DNA, 468 bp, Homo sapiens
  CDS 189..455
ctttttccgcttccggtgtcccctacagtcatggctgccgccgtcgctgctgccggtgcaggggaacccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattg

SEQ ID NO: 2872 - DNA, 496 bp, Homo sapiens
  CDS 177..368
  misc_feature 447,456: n=a, g, c or t
acatttctgtatggtgcaagatatgtgcaatggctagtactatgtgtcasttgtctaggctatactgctcagctgtgtggtcaaacagtagtctagatgttgctgtgaaggtattttgtagatgtgatcaacatttacaatcagttgattttaagtaaagcagtttaacttccataatgtggatgggcctcatccaattagttgaaggtgttaagagaaaagaccaaggtttcctggaaaaggaattctaccacaagactaacataaaaatgcgctgttcccaagacaacccggaaggaaaagggacccatcaaggaagttccaggaacaaaaggctctccctaaaagaccgccgcttcaaaaaaacctgaggaatggagtgggccaacactatccagccactctgaccagccgaacgaggaactcaatcaaaatgagccatagcgngaccacaanggcaatgagaccaccaccttctccagtctctcttcggaca

SEQ ID NO: 2873 - DNA, 524 bp, Homo sapiens
  CDS 180..338
acttacttctggggctaagcagggaactraactctcattgtgaagccatcctcaagccacctgcctacccttttatagtcattaaaatgtccctaggaatttggacttgttttgttccaaaggacatggtctcagggatcaacctaaggaacactagtgatgagcttctttaggtttgaatgcccggcatcatccsttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggtcctgttgctccttcacacagacctggatgccccagagcaaggtcttcattcatggtcctgagcaggtgccatgggattgggctctgggcactgacttaacggcac

SEQ ID NO: 2874 - DNA, 486 bp, Homo sapiens
  CDS 93..257
aagaaggaggaaggaacagaaggctaagtggcttttgggttcccctcatcccaaaatgtcctctcagggtcagccaggagccagcagccagcatgaagcgcagtgagggcaccagctccaggtgcaggggacaccagctctgggacaccctctctttcctttcaggacctgctagctgggacaggcctgggcagcagggctggtgctgcttcctgcagtggccacaggtctcaccacggagatgttggccaggcccatagagggcgtggcccggcactgcacactgcttcctctccatggcacactgacatggctgctgtcaagctgggatggtcgtgtggcccccttgacatcggtcaggcccttgccccaggcagctgcagctaccagccagaagaaggtgaaggagacagtcacacagaagtcctggtaggagcagagggatgggaaatacactcagaaaggccccatgaaaaaaaaaaaaaa

SEQ ID NO: 2875 - DNA, 494 bp, Homo sapiens
  CDS 93..257
  misc_feature 487,493: n=a, g, c or t
aagaaggaggaaggaacagaaggctaagtggcttttgggttcccctcatcccaaaatgtcctctcagggtcagccaggagccagcagccagcatgaagcgcagtgagggcaccagctccaggtgcaggggacaccagctctgggacaccctctctttcctttcaggacctgctagctgggacaggcctgggcagcagggctggtgctgcttcctgcagtggccacaggtctcaccacggagatgttggccaggcccatagagggcgtggcccggcactgcacactgcttcctctccatggcacactgacatggctgctgtcaastggatggtcgtgtggcccccttgacatcggtcaggcccttgccccaggcagctgcagctaccagccagaagaaggtgaaggagacagtcacacagaagtcctggtaggagcagagggatgggaaatacactcagaaaggccccatgaaaaaaaaaaaaaattncgaaany

SEQ ID NO: 2876 - DNA, 486 bp, Homo sapiens
  CDS 110..463
ttttggagtccacccggcgcctggtttccccggcggcgtctcccaacaggctgccgggaccaaagctggccccgcgggtgcctggcctgtgggcagccggaccgacacgatgtggcggctccgctgcamggccaaggacggcacccatgttttgcaggggctgtccagccggacccgggtgcgggarctccagggccaaattgccgccatcaccgggatcgcccccggcggtcagcgaatcctcgtcggataccctcccgagtgcctggatctcagcaatggggataccattctggaagacttgcccatccaatctggtgacatgctgatcattgaagaagaccaaaccaggcccagaagttcacctgcatttactaaacgtggtgcttctagttacgtcagggaaactttgcctgtgcttaccagaaccgtggtccccagcagacaactyttgcctctttactagtgtgtactatgtcgtcgaag

SEQ ID NO: 2877 - DNA, 706 bp, Homo sapiens
  CDS 380..595
  misc_feature 543,589,592: n=a, g, c or t
agaaaccaggcggcgcgttcccggtggcggcgcctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtggggaagactgaggaggaggcgaacagcttgctgaggagatgaacatcgccttctacaccagccggactgatgacatcttgctgcatcaagatgtggatctggtgtgcatcagcatcccccctccactcacccggcagatatccgtgaaggctctaggtattkgggaagaatgtggtttgcgagaaggcagcaacatcggavnvtgcttycgggaaggtgacagctcgsgctactaccgcagctcatgngmnmggtagggacgtgctgcgcttcctgctgcttcgtgcgcatgaacagctgatttcggacactatgtggavcggtgatgatctgtgatgcccgcatctactcagcagctgctgagc

SEQ ID NO: 2878 - DNA, 531 bp, Homo sapiens
  CDS 153..359
cattttgtaaatgttgattgcacatgtggtcacattattgttkagactgcttttatgtgacctgtagtctcccacagaacctaaagtaataagctggcttttctgtgatagccacgtttgcstatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagag

SEQ ID NO: 2879 - DNA, 502 bp, Homo sapiens
  CDS 177..488
tggatctcctttcctcttctcagacccgggagcgtccgggacgcgasccggagctggggcacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgyccaggaaacataaccagaaggattcatcaggattcatttttgatttgcagtccaataccgtactggcccagggaggagcttttgagaacatgaaagagaagata

SEQ ID NO: 2880 - DNA, 482 bp, Homo sapiens
  CDS 268..474
agatttccccccattggattcttagccaagcaccaaatgtctgaacctgcagtgcggtaacatggcaacagatgtcactgttatccataataagagtagtcctggtgcagtaatcaggaaaggaacccatatagaatgggttgttgtgaaaatgtgaaatgaggaagtagagaactgaagtggtagtggcccttgtatttgctgtcaaggagaacagagattggttgtaacgttcagaaggagagcaagaggagcccaaagtagtagatgggcagtggtaccttccagttcagtagaaacattgttgtgtcgctgggtggatacatttcttcctttggaaccaagacctctgagccaacacagcataaggtcatgaggatgggaagcagaaatttttctagtggatcactaaagatcactcatcctgggagataccatcagccacgttatgagactactccagcagttctgtggtgaggaag

SEQ ID NO: 2881 - DNA, 575 bp, Homo sapiens
  CDS 133..552
aagagaggggagcttcggagttatggggggaccacccttccatttaataactgagaaagccacgggaggggacttgctgggctcacagccagtgatccctgccctgtttccttatggggactgcggtcagaaatggggagtggggcagaaactgtcactgtcacggtcctgtttagagaggaaggtcggagaaaccagtgccgtggaaggctctggggcgttgacaggcgctgtccccagctcaccggctctatgaccctggaagaatggaaacttcgtcagagcagggacgtgagggtgaactgctcacccgggcaccgctggcgaccggaacccagctccctccgggctccgggagaggcggcctcagctgtgtgctggtgctgccctccagcggcgctgggtccccatggcacctggctttctcctgctccccaggggccttttcttctcccgcccacctatcaccagccgccaggcaagtctctgtgtgactctagggtgaaggtggagggaccttgcctccgaggattcatcccacccggattccgatgagtgagggacctctctggcac

SEQ ID NO: 2882 - DNA, 543 bp, Homo sapiens
  CDS 243..434
gagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatacttaaaaaagtmvavvakhgacgaa

SEQ ID NO: 2883 - DNA, 456 bp, Homo sapiens
  CDS 85..258
  misc_feature 451: n=a, g, c or t
attagagacagaaaacgagagagagttcaagctgaggaacaaaatgaacagtctacgtagaggctccggtttggtccccaaggcatgaccaggagaggctgggaaagcccagaattgtgtagcctgaccttgaggcggggggaaaagaagcacacggattgcttttctcttttgttttcttccaagggcctagagccacaggtgtgcttcttgcataatgggcaaaggtctctttgggttcagaacctgataaagtgttgacattttcatcaccacaacaatggcttttttctgtagtctcttagttgataaatgaatatgctcagcacaaatatggattaatatgtacatcctagatgtgattcaataaatcacaaagatcactgcaagtatggttaccaattgtgagcaatcatagtctaccttacctgctcctagggaggtttgcamncttcc

SEQ ID NO: 2884 - DNA, 560 bp, Homo sapiens
  CDS 347..556
gtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctmmtggaggaaaggcagtcgggactgac

SEQ ID NO: 2885 - DNA, 478 bp, Homo sapiens
  CDS 169..381
aacgcgactcccgaggygsggccgcccccttggctggtttggatccgggtcagtcgggtgccgagatttgggagagacgctctgaactgactgccccgcatcaccggagcgtcccagctgcgaggagtgtaaacaggaacatcgataagtagtgtaaaaacttgcacaatgaaatccgaagccaaggatggagagagggagagtctacagactgctttcaaaaaattaagagtggatgcatcagggtctgtagcatctctgtctgttggagaagkcacaggtgtcagagcaccagtsagaacagcaacagatgataccaaacctaaaaccacatgtgcatctaaagacagttggcacgggtctacaaggaagtcttcacgatgagcagtkagaactcatcgtcgtcgacgttctaagtctcctgtccttcatcctccaaagtttatacattgcagtacaatagcgtcttcttccagca

SEQ ID NO: 2886 - DNA, 338 bp, Homo sapiens
  CDS 63..242
ctgccttctcccacgtggcctcacccctcccacaggggagcttacttgctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggacacacctcactgaggctccactgaccgccgggttacacctgctccttcctggacgctcactcccttgctcgctagaataaactgctttgcgctctctaaaaaaaaaaaaaaaaaaaa

SEQ ID NO: 2887 - DNA, 503 bp, Homo sapiens
  CDS 97..297
tacgaaagaaaaagagatgataagccaaaagaaagtaaagcaaaacgaagaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaa

SEQ ID NO: 2888 - DNA, 551 bp, Homo sapiens
  CDS 173..484
atatctggtccttgttcccgtctggataccagcttccttcagcagcgcaggcggtggtccctgaggcccgtggaaggagtcaaacttgcgggaattttgcagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctg

SEQ ID NO: 2889 - DNA, 467 bp, Homo sapiens
  CDS 202..432
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttccccattaaatggtcttggcattcttgtcaaaaatcaggctggagtgcagtggcatgatctcggctcattgcaacctccaccttccagattctcttgcctcagcctcccgagtagctgggattacaggtgtgcaccaccacgcccggctaacttttttatttttaacagggacggggtttcaccatgttggccaggctggtctcgaactcctgaccaacatggaggaaccccgtctctactaaaaatacaaaattagctgggcgtggtggcgcat

SEQ ID NO: 2890 - DNA, 482 bp, Homo sapiens
  CDS 37..348
  misc_feature 330: n=a, g, c or t
accttcgcttttttaggggaacggggatagttcgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaarccacctaaacaacgtakantttttgttctgcagggaatgagtcagctacacttttacaggttctatttggagtttggatgtcttcgaagcattcagacataaattccgcttgcctccaccatcatctgattttctagctgatgttgttagggctacaaactgaacaaagat

SEQ ID NO: 2891 - DNA, 489 bp, Homo sapiens
  CDS 48..455
aagtcggagcgaggscttggcggasagaacggattgcagggtcagccatgtcatctgagcctcccccaccaccacagccccccacccatcaagcttcagtcgggctgctggacacccctcggagccgtgagcgctcaccatcccctctgmgsggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcacaggcacaagcatgagactggtctggacatgtcatcaagctcctag

SEQ ID NO: 2892 - DNA, 499 bp, Homo sapiens
  CDS 68..406
gacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttgaagtactttcccggctgggtgctgtggctcacgtctgtaatcccagcacgttgggaggccaaggtgggcgaatcacctgaggtcgggagttcgagaccagcctgaccagcatggagaagcctcgtctctactaaaaatacaaaattagccaggcatggtggcgcgtgcct

SEQ ID NO: 2893 - DNA, 459 bp, Homo sapiens
  CDS 58..393
aaggatcaaggccatggacacgcaaaatttagagaagacagccataaagattcagtcatggtggcgtggaaacatggtacgccggacgttactgcaggcagcactcagagcctgggtcatccagtgctggtggaggtcaatgcaggccaagatgttggagcaaagacggcgcctggcactaagactctatacctgccaggagtgggcggtggtgaaggtgcaggcacaggttcgaatgtggcaggcccgcagcggttcctccaggcacgccaagcggcctgcatcatccagtctcactggcgctggcatgccagccgaacccgaggcctgatccggggccactatgaggtcagagccagccggctggagcttgacatcgaaatcctcatgacctagggcgctgacagagccaaggaggctggatctctcttccaataaagacccttactgaccataaaa

SEQ ID NO: 2894 - DNA, 547 bp, Homo sapiens
  CDS 22..204
aattggtgaacatgtttcagcatgaattttagagcggacgcaaacattcaaaccacagcactagcactgatgtcagtcgttagtagaagaaatccagaaggcagaacctctactcacagcttcacgaacagagcaagtcaaacttttgatacagaggttgcaagagaaactcggccagaacagcaatcacacgttctatctttttaaggttctcaaagcacatatattgccactgactaatgttgcacttaacaaatcgggctcatgctttatcacaggaagctatgatcggacgtgcaagctctgggacactgcgtctggagaggagctgaacaccctggagggccacaggaatgtggtttatgccatagcattcaacaatccttacggtgacaaaatcgccactgggtcctttgataaaacttgtaaactctggagtgtggaaacaggaaaatgttaccataccttcaggggtcatacagcagaaatagtgtgtttatcatttaaccctcaaagcacattggtggcgactggaagtatggacaca

SEQ ID NO: 2895 - DNA, 459 bp, Homo sapiens
  CDS 69..326
  misc_feature 25: n=a, g, c or t
cgtttcctcctccctcggcagccvnggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaacagggtcttgctgttgcccaggctggagcataatggcaccatcatagctcactgcagccttgaacgcctgagcttaagggatcctcccgcctcagcttcctgagtaactgggactacagggatgcaccacctcacctggctaagttttaatattattattatt

SEQ ID NO: 2896 - DNA, 644 bp, Homo sapiens
  CDS 310..513
ttgcttcccgagggcggcacgagggctgggcggtggggtgcgggtgcccgggtgaggggcggagctgggggcatggcgtccggagcggctcgctggctagtattggcacccgtcaggtccggggctctccggagcgggcctagcttgaggaaagatggcgattgkctccgccgsrtggagcggctcaggccggagcctgggtaccgtcgaggtcagtcatcgttacccgcagcggcgccattttgcccaaaccggtgaaaatgtccttcsgccttctccgtgtgttctccattgtgatcccctttctctatgtcgggacactcattagcaagaactttgctgctctacttgaggaacatgacatttttgttccagaggatgatgatgatgatgactaacaggaattacagaaaggagaaagcactaactgaagaaaatggtgatgctctcagtttctctgccttccctatcagcagaaaggctcggggaaggccctcagcctsccsagtctggtgaagcttcctgtatggtccatgaccgtattccaccccaggctctgggaggctccctgagatgtgctgtccactaagcactgcacaaacaagcaatcaaattatgaataaacataataaatatcaaaaaaa

SEQ ID NO: 2897 - DNA, 463 bp, Homo sapiens
  CDS 10..216
attgtttttatgtatgtaggcaccatgggtggcagagtatgttttctctcatggtttttcccttgctattttcctattgaagtcaatgcatgcctgtactttctctcaaagagaagcagatggcaaaatagaaagttaaagtcacctgttttgggttttaaaaagccaaaaaattttagagaaattaagggattctcagttatggacagactgccctgaagtaaacaaaatggactatttstcctaaactggaagagacatctggggstgatagaggggtaggtgtgaagaaagatctattctsttsttcctggtagstctgctaaggaggccgaaatgtacacaggtcaactggcgttaaggaaagcaagtggaagactacgggtagcccaagcagacactggataagactatctaaggggcttgttcagcctrgatggtgmtkacctgaggtaacctgtgt

SEQ ID NO: 2898 - DNA, 527 bp, Homo sapiens
  CDS 7..357
aggactatgggaggctgccctgtacggaaaagaagaagaaatggcagtaaagagggcaaccatcattccacccagcccaaaaggaataagagaaaccctatctttcaggattctcaagatacagaggtattttcatggagtgataatgaaaggagcagcagccgcattaatatcccagagagagcaagtggaccagaaggcaacttaaaccagattgttactgaacccgatgcaaactttccccagttcttgcatgaggggtatgtacccatgccaarggyyttwamcyccmatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaa

SEQ ID NO: 2899 - DNA, 511 bp, Homo sapiens
  CDS 81..353
aaaaggacaatagaggcctcgggagcgcgcgcgtcgccgggacttctccccctcccagcccgcaacgtgcgcgcgcccgtatgcaaataagttcgattcaagagaattttgtgccgggagccgcgcgtgcsagagggaaagcggaatctacaccttcccggccagcggtagtaactgcagaactgcaggagactatctttctagacaaggcagttgaggaggagggagcgcttgagggggactggcctggcgtgcactccgcacctcggggacattattgcgcgtggaacggctgcttttggaaggcacaacttcctgaatggaccatgactcccaccaaagatccctgtctctgattcaccaaacagcttcaaccctgaaaccaggacgagaagttgacaacatctgagtggacagctaattgacctaagacttcagaccagggaccttaagaaaacatattgtagatagacagatagatgattgatgatagtgtcagaagaaagagaaa

SEQ ID NO: 2900 - DNA, 486 bp, Homo sapiens
  CDS 40..456
  misc_feature 24: n=a, g, c or t
aagtgaaggtggaagcggccgcgncggcagcaggccaccatggcggastgrcaggaggtgsagatcacagaggagaagccactgttgccaggacaracgcctgaggcggccaaggaggctgagttagctgccsgaatcctcctggacsagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttggatatcagacccatctctggaccagcttgcagacatgatcccttgcgtcctgcagtacctaaatttctcttacaataattggagttcggtgttggagctggagcc

SEQ ID NO: 2901 - DNA, 284 bp, Homo sapiens
  CDS 34..201
ctcagcatctggagtagctgggattacaggcacatgccaccacgtctggataatttttgtatttttagtagagacggggtttcaccatgctggtcaagctggtctccaastcctgacctcaagtcatctgcccgtgtcggtctccggaagtgctgggattacaggcctgagccaccacactccacccctaatcaccccttctaataaagacacagctcatgtaggatgagagctaaaaaaaaaaaaaaaaaaaaaaaaaaaaaaaaaaarrrgaaaaaaaaaaa

SEQ ID NO: 2902 - DNA, 721 bp, Homo sapiens
  CDS 99..704
ctgcgctagttgtgacgcatactatagcgctgttttcctgcactgataaacgaaaagcaatccaccaggtctcggcagctaactttccggcactacttatgcccgagcgtgtcgctcccagtgcgcaagtgcagcaggtggctgcacgggggggcgcgggaggaggaggaggaggaggaggaggctggggtggggccggcggcaagtgctgtgatgcggttccggggaggggccgtcgggtagaggctgaataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgkgacggcatccgagtgggtcatgcagtgctggccatcaatggcatggacgtgaatgscaggtacacggccgacgggaaagaggtgctggagtatctgggtaaccctgctaattacccggtgtccattcgatttggccggccccgcctcacttctaatgagaagcttatgctggcctccatgttccactcgtgtgagctctttgaccagaacctgaagctagctctggaggtggcagagaaggctggaacttttggacctgggtcataggctgaacctgttat

SEQ ID NO: 2903 - DNA, 269 bp, Homo sapiens
  CDS 34..201
ctcagcatctggagtagctgggattacaggcacatgccaccacgtctggataatttttgtatttttagtagagacggggtttcaccatgctggtcaagctggtctccaastcctgacctcaagtcatctgcccgtgtcggtctccggaagtgctgggattacaggcctgagccaccacactccacccctaatcaccccttctaataaagacacagctcatgtaggatgagagctaaaaaaaaaaaaaaaaaaaaaaaaaaaaaaaaaaa

SEQ ID NO: 2904 - DNA, 506 bp, Homo sapiens
  CDS 199..354
tactttctttctgtgggcactgagttttgtaaactacgagttcaaattttcaccttgtcagtttacagtcaaatttatggcttctccgtagcctgtgtgtcacttttgtggcgtgtgttttgtgttatctcctttcctgcttctgttttacttccctacctcttgtttgctttcttctttttcatttcagtttaatgcatgctatctttgtctcgctgtagtttgtgtatatttgaaaactttcttaaatgttctctggaacaaggtgaggtaagtaatcttcatttatttggtatcgaatacaatcctgagtgtgttacctttgttttacataaggggaaccagccacacagctaataaagttgcaggactcaggttcagcttgaggtttctcctagaaagcccaggctcactctcccagctgtgccctgttctctcaagaaaccaacagatacactccgcacactcctcaacaacccatgacgctccacacacacacacacgat

SEQ ID NO: 2905 - DNA, 474 bp, Homo sapiens
  CDS 139..303
aatcccatcaaacgtgaaggattactctaaatcaaagtaccgtctttacttataatatacatattgttatatctaacagtcaggaacacaattagcagtcagaaattacagaaaggctataatattgttttttactttatgtttaatagatattttgtgtttaaaacaggtatccaacactcacagccttccagtgatacattgcttttggaagtattgaaacaagtaaaagttagtgatatggtggaggataaattagaccttcctgaagaggatataacagctagagtaaatgtgtatgtataaatatttaaaattattttgttctgagaaaggggattgcaaaatcgtggaaaagatttgcttgaaattctaacaccatgtatttccagggtccaacagttaatgctgtatcagctgttaggattttatcagtattaactgagattattgaggaaggcttcttagaactgg

SEQ ID NO: 2906 - DNA, 387 bp, Homo sapiens
  CDS 108..374
caaaaattagccaggcgaggtggcaggcgcctgtaatcccagcttttcaggaggccaaggcaggagaattgcctgaacccaggtggcagaggttgcagtgaggcgagatgtcaccaatgcctgtcctagagcgaccactaaagaaaagaaagccaggcgcggtggctcatgcctgtaatccaaacactttgggaagccaaggtgggcagatcacgaggtcaagagatcgagatcatcctggccaacagggtgaaaccttctctactaaaaatacaaaaattaggcctggcgcggtggctcacggctgtaatcccagcactttgggaggcggaggcgggcagatcacgaggtcaggagatcgagaccatcctggctaacacggtgagg

SEQ ID NO: 2907 - DNA, 523 bp, Homo sapiens
  CDS 175..507
aagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatggactatggctatgtacagaccacatccacggagatgctgaggaatttcatccagacggaagctgtggtcagcaagcccttcagcctctttgacctcagcagcgttggcttgkttggggctgagacacaacagagcaaagtggccccccagcagtgcagccagycgscccgtcctgkccagtcgctctgaccagagccaaaag

SEQ ID NO: 2908 - DNA, 539 bp, Homo sapiens
  CDS 267..533
ctgtttcccaggctggagtgtagtgatacagtcacagctcactgtagcctcgaccttccaggctcaaaagatgctcccaccacagcctcccaggtagtgagtagctggtactacaggtgtgtgctgccacacccgactaatttttttgtagagacggggtttcgctgttcccaggctggtctcaaactcctgggctcaagtgaacctcccgcctcggcctcccaaagtgctgggattcctttctttatttctgtagaatctattttatggttggcattttgggggaagatttcgatgggttccacattcttgctttagttgttgtagagggatttgggtgtttctacccaaggcattggtctagcttttcctacaatgaacctatctttggaggttcaagctccccaccttcccccactgtggtgacctgtggccacttgcagaagggatggtgcctgacccactgccctagccccacgctatgcaccaaacttgttctccccgtctggtcagggctgggggtctttagagactgacag

SEQ ID NO: 2909 - DNA, 293 bp, Homo sapiens
  CDS 32..235
ctctccgccagaccgccgccgcgccgccatcatggacaccagccgtgtgcagcctatcaagctggccagggtcaccaaggtcctgggcaggacggtttctcagggacagtgcacgcaggtgcgtggaattcatggacgacacgagccgatccatcatccgcaatgtaaaaggccccgtgcgcgagggcgacgtgctcacccttttggagtcagagcgagaagcccggagttgcgctgagcttggctgctcgctggggtcttggatgtcgggttcgaccacttggcccgatggg

SEQ ID NO: 2910 - DNA, 471 bp, Homo sapiens
  CDS 287..460
ccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttcycttwagagttggtgtaaacatgcsatgtaataaatgatttcsacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatattt

SEQ ID NO: 2911 - DNA, 531 bp, Homo sapiens
  CDS 177..521
ctcaaacagtcgggaagaagcaccgtggctgctattatctgctctccgcgcctgacccctcccaggactcgtgatgccaaggccgctgcgagcgcttacgaagagtcggggttgagccccagctgagccgagggctcgcactcttctggtctcccaggcccaacccacctgaagaaatgagtggtggattggctccaagtaagagcacagtgtatgtatccaacttgcctttttccctgacaaacaatgacttgtaccggatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcawtgctattgacaatggaagagcagctgagttcatccgaagcgaaactactttgataaatctaagtgttatgaatgtggggaaagtggacacttaagttatgc

SEQ ID NO: 2912 - DNA, 475 bp, Homo sapiens
  CDS 64..354
aaggagactgttgccatggtgactcagagttgaggccaatggcggctccaccatcctgtggctatgattcctgaacttgtggtctcctcagttgatgaggtgaagaaagaaagcctggagaattatgcacgagcttctcactgtctcagcccacaagtaacacacctctttccctcacagcccacactggctggaaccaatcacatagccctgcctaactgcaagggaggccagaaagtgcaacactttctcatggtcacgggtgagcacgaaacatctctccaaatatgggttgggaagattaagagactagtccagaagaaaacagtctccagggagaaatatatctgggaataggaatcgagaaagcaaccaagagagcagaactgagtggatgagaggaattgtcagaccacatctgcagctctgattagtcaaatccgaaatgtgcccgttgatctattattccgtggaa

SEQ ID NO: 2913 - DNA, 483 bp, Homo sapiens
  CDS 22..225
atctttggcaatgatttgcagatgacttccatggttcccaacgtggacaaatcacaagaagctgccctcccttggcattggaacccactcctccccagatttctctgtgtggatccttcttccagttactgtcattgggaagctgagccactaacacctaggtggggagtaagaatattttctttagaactcgagcttcctccaatggaacaaatcctgccaatttgaaattcctccagctctccaaaacaaggaaaccgtatgcttaattaccaaacatctgttgccgagaacaccccctcgcctttgcagctctgatctcacggtatgaattttaaaatctgtcagcaagggatcacaaaagctccgggagcaaagagctgctcatgttaacctctgaaccagataatctaacagtaatccattcagaackaatcaaacatttacagaaccgcaccggcatcctggcaaacaattcgtcaa

SEQ ID NO: 2914 - DNA, 571 bp, Homo sapiens
  CDS 174..335
aagggaatctccgggcggggtagtgcaggcgccgggtttcccgcggtccgagctggcgcgggcggaggagaatcgctcttaaagggccagcgcacacgcgttcttttgttccggggccgcaggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgaggcagaggttgcagtgagccgagatccggacaccgcactccagcctgggagacagagcgagactccctctcgggcatcaccatggccgtcatttcattcacatcagacacagcggcctctatttggtggtcacaacttcagaaaacgtttctcccttcagcctcctagaactgctctccaggttggccacccttctgggsgattactgtggctccctgggcgaggggacatctcccgmaatgtggctctg

SEQ ID NO: 2915 - DNA, 495 bp, Homo sapiens
  CDS 236..469
  misc_feature 98: n=a, g, c or t
tttcccagacctttccttcccacggcgctgctctgtaattagatgtagttccctcagagcggaccaccgagagcccaggccaaggccgaaatggcgangccttcctctgcatctgggcagcctgtgatgcaccagacatgaaaacccctcatggaccattccggagccatgccagaaaattacccttgctaattacaatgagataaagagtacttctgtgccaagcagcaagcctatgctatctctacagcaactgtcagggaaaaagcaatccagagtcgcattaaaagagagaactgtaagtattgtgctctctcaggaaattgaaagaaaattcacatctttacttttgtcttccagcagatgtctttaccttggtggatgcsctttctgcctgcagatgggtcaggtagcggagggctggctcaagcaacaaacgcacttgaattccccgattctccaatctctctgaagaatacttaatcttaatgatat

SEQ ID NO: 2916 - DNA, 453 bp, Homo sapiens
  CDS 174..356
actcactcacactgctggaaggttaaagtcgacttcacgctagtttaaggaaatatctgacgctgataaccatgtcccaagcactgctctaagttcccaatgtgtccggaattggtgggttcttggtctcactgacttcaagaatgaagccacggaccctcgcgttttagactatgctaaaaacagcctcaggaccttcagcactgatcaacaatcctgggcatgggctgaccgacagttttcacccagagagtgaagatcatggaggagccatcttaaattctgcccagcgcaggctcccaggaatcctaatgtcacgatctcactgcagccaatgtgacaaacacagcagtaattaagtctagagagctaaacacacctcaaaaagaattgtctcttggtatgagtggaatggaataaaatacatggwaacccaaaaaaaaaaaaaaaaaa

SEQ ID NO: 2917 - DNA, 368 bp, Homo sapiens
  CDS 33..296
agtgtttaccagcacttgtttactaccttgcgatgatatttacagtgtatttttgggtatggttttggggttatttggttgttgttaaaatgcctgtggtcccggcactttgggaggttgaggcgggtggatcacctgaggtcaggagttcgagcccagcctggccaacatggcgaaaccctacctctactaaaaatacaaaaattggcctggcgtggtggcaggcacctgtagtcccaactacgcaggaggctaaggcaggagaattgcttgaacccgggaggcggaggttgcagtgagccgagatcgcgccaatggcactccattcagcttgagtgacagaggtgagactcccatctcaaggtaaa

SEQ ID NO: 2918 - DNA, 236 bp, Homo sapiens
  CDS 34..201
  misc_feature 110: n=a, g, c or t
ctcagcatctggagtagctgggattacaggcacatgccaccacgtctggataatttttgtatttttagtagagacggggtttcaccatgctggtcaagctggtctccaantcctgacctcaagtcatctgcccgtgtcggtctccggaagtgctgggattacaggcctgagccaccacactccacccctaatcaccccttctaataaagasacagctcatgtaggatgagagctaa

SEQ ID NO: 2919 - DNA, 575 bp, Homo sapiens
  CDS 94..498
agtgcccgccggccgcttccgctcccggcgcaggcgcggcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggg

SEQ ID NO: 2920 - DNA, 454 bp, Homo sapiens
  CDS 38..208
ctttgaatgagtagaattgtactgcaaactaaggaagatgatgattctacagttgaacaacctacagatgagtgggagagaagcctgtggtggcctgggagtatgtcaacagcatccaacaggtggtgctgaaggagagagtggagtcagcaaaaacaggacggagccgtcagacaaaacttctaggaagaggggcaacgaggcaggctaagggaggtgagggctgcccgctggttgagacagactcctcaataaaggtaataggatgtgagaaagatggcctggcgcggtggctcatgcctgtaatcccagcactttgtscaagatgggcggatcactttaggccaggagttcaagatcagcctgtccaatgtgatgaaaccccttctctgctaataatagcactttgggaggccgaggcgggtggatcatgaggtcaggagatcgagaccac

SEQ ID NO: 2921 - DNA, 492 bp, Homo sapiens
  CDS 62..268
agataattctaacttcctgtcagttgaagacgataattctaacttcacacttaattaaaagatgttgtctcagcttggctctgcgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaaaaaaaaaaaaa

SEQ ID NO: 2922 - DNA, 518 bp, Homo sapiens
  CDS 79..402
ttcctacccggaggaccacaaccacgacaccactggctttaaaatcaaagcctggtccctagcgaagaaagcgctttaatgtgctcctcccgctcccgggtgcgagattcctgcccagctactaggccacgactggctggtacaggacgagaacgtgcgcggggtgatcaccatgaacgaggagtacgagacgaggttcctgtgcaactcttcacaggagtggaagagactaggagtcgagcagctgcggctcagcacagtagacatgactcgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacatccacatcaggcctgggcagctggatgttcttaaagagttccacaagcag

SEQ ID NO: 2923 - DNA, 504 bp, Homo sapiens
  CDS 224..472
tgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgtgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaaccagctgggacattcaattcgacaaatagtacaaggctgtaatatattatgtgctact

SEQ ID NO: 2924 - DNA, 615 bp, Homo sapiens
  CDS 326..490
aatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttcaaaaaaaaaaaaaaaaa

SEQ ID NO: 2925 - DNA, 514 bp, Homo sapiens
  CDS 136..285
cccagtcccgctccgtcctcctcgcctgccaccggtgcacccagtccgctcacccagcccagtccgtccggtcctcavcggcsygvcggscggsscmasccscvacggcagccatggracgccatcaagaagaagatgcagatgctgaagctggacaaggagaacgscaatcgaccgcgccgagcaggccgaagccgaccaaaraagcaaagytgraggaccgctgcaagcagctggarggaggagcagcaggccctccagaagaagctgaaggggacagagggatgaggtggaaaagtattctggaatccgtgaaggaggcccagraggaactggagcaggccgakkaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcg

SEQ ID NO: 2926 - DNA, 483 bp, Homo sapiens
  CDS 88..276
atcgacgaagcagaactgcactttttttgcattcaaatttttattcaaagtttagtctctctccttgggtttcccctcttttatgaaatgatcaattttggcgaagagcccccagaaagcaagatagaaaagaaatatgctctttaccgtggccgatcagcaacgaaccaacactgtcctcatctaattctacgtcttccacactgcccagtaacacaaataaccagagcgcagacgccaagaatccttccaagtaacgcagctaacagaccaaggtgacagttctgacttcttggggggttttccaagtacatacgtarcattataaacaagcctctatgttgtgcttacacaactcactcaagggatttttgttttcacaagtgaaaacgtttatgaaatgctagcctgcgaagcgcttcaggaaccatctagtgagatttccctcccaagacaggcagctttctcacataccgtggaggc

SEQ ID NO: 2927 - DNA, 577 bp, Homo sapiens
  CDS 270..431
ttttctgttacttttgactttttaaaaggaaggttaattttaattttagttaatttatcatcaaggcattataacccaaaagggttttttatagtgagaggctgagtgatctttgatgctattctgtgtaaatgtaaagtgaaatctcctatttaagctatattgaaatgtatattttaaatgattattttcattaaggatttaatatttgggagttttttttttaattaccttaagtaaatttttttatattaagattctatcatgatatggattttggttttcaaaatattcttttcctagccataatgtctgctttttatttacatataattctagaatattcgagtgcgaacagtaaaaggccaagattatctttcaaaaacaggggcaaaattccatggaaaaatggaacagaaatttttgttagttgactgccagaaagtgatgtacggttcttacaggtaagatcattgtgtttaacttcagtgttatcaatcgttttgatgatttattagtttcaaattttaatataatcagttaagctttttcttaaaagtgaaaaaaaaaaaaaaaa

SEQ ID NO: 2928 - DNA, 489 bp, Homo sapiens
  CDS 213..422
agattcttaactacgtgtcttacagcaaagttgcccatgggaacaaaggctgtagggtgtcattgatcttgtaatammaccmccwtattkgatgggtgaatcttattagcactcctttgaaaatgttccagtatggagtcagttgctgataaagaggaagttcacagctaggaatccgaagttaagatttctcaattgccgcctgggcactcatgcctgtagtcccagcacttgggaggccaaggtgggcagatcacctgaggtcgggagttcgggaccagcctggccaacctggtgaagcccccccatctctactaaaaatacaaaaattggccgggtatggtggtggctgcctgtggtcccagctactcgggaggctgaggcgggagaatcacttgagcccgggaggcgggaggttgcagtgagccgagattgtgccactgcactccagcctgggtgacagagcaagactccatctcaaaaatagaa

SEQ ID NO: 2929 - DNA, 474 bp, Homo sapiens
  CDS 278..454
ttgtgacattgctttctttttgtttttgctgttgttttctgctgctgctgatttagaaatgaaataagctaactcttaattttaacctgtttgctacctaaaatggtaatcatcttgatgttctttcaagcaggtcccagagatcttaaaatgatccggaatcactgagtccacagttctcttttctcttggttatgtatagatggagagtggtcttggtgttatattagtgtatgattcgtatttgtttcataattaacttcgaagtgaaaaattgatgcgagasaaaggtttatttggtttccataactatttactaattttatgcttgccagattttaagattaaactgtttgccatctctttttttttttcttcccataaaacctttggccatctacagtcacttttcctcaaatcttatgctgtaattcaaactgtatattctttttgctgattgcttctgtacctctt

SEQ ID NO: 2930 - DNA, 466 bp, Homo sapiens
  CDS 207..461
aattgtcattttgactcagtagcaaactcaccagttttccatcacataatccccttggagaagccttaaaggaatgttacaccatccaaagtgacctctctgtgcagcttttatgattttggcaggaaaacaagcaagaaaggagtgggtgcagtgggagatgatgcaggaagctgtgagcaccagaagtgagactattacagaggatgtggaatacgggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacagcatatgactagaa

SEQ ID NO: 2931 - DNA, 709 bp, Homo sapiens
  CDS 25..210
actctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaatataaaaaaaaaaaaaaaaaggc

SEQ ID NO: 2932 - DNA, 581 bp, Homo sapiens
  CDS 341..490
gaagctgatccacttataccagcaggggccttgcctgtagggtctactgcttctcagcctctggtgccctttgagcctgtctgagtaggcccacagccagaatcaaatagtgatgttatcttcctgattcacagaaaaaaatatggctgaatttttacttcaatttttctataatttcataaataccctggatgcttgctactgatagtctgcttccaaatgttggccagatggcaaatgaatgaagtagcaaacaaatagtattttaaaaaatcaagaaaaactgattgtgcttatttttagcagatttgttctattcttcccccaaacccccatccacatgtattctaacaagcagagttggggttttatattggaaacaagacaacattccatcttgtgtctctcgctcagtccatgcctggacctgtacctttacctctgcagttgccatttgatgttctgggcagctcacccacctggtgggttgtaagggttgcattgctctcttctgtcgtcctagtctaatcgtggatacagatttcatcagagaacaaaaatacataaactcataaacatgc

SEQ ID NO: 2933 - DNA, 530 bp, Homo sapiens
  CDS 117..305
ggattgaggcgccgcatttttgctgcccggacgcggagakgaaggctgagagagtcggagacactatccgcttccatccgtcgcgcagaccctgccggagaccgctgccgctatggatgatcgagaggatctggtgtaccaggcgaacgtggcccgagcaggctgagcgatacgacgaaatggtggagtcaatgaagaaagtagcagggatggatgtggagctgacagttgaagaaaggaaacctcctatgctgttggcatataagaaatgtgattgggaggctagaaggagcctcctgggagaataatcagcagcattgaacagaaagaagaaaacaaggggaggagaagacaagctaaaaatgattcgggaatatcgggcaaatggttgagactgagctaaagtttaatctgttgtgacattctggatgtactggacaaacacctcattccaggcagctaacactggcgagtccaagtttttctattataaaatgaaagggggactaccacaggtatctggcagaatt

SEQ ID NO: 2934 - DNA, 486 bp, Homo sapiens
  CDS 180..437
aattatttgtttaaaatgtggcgacctgttctctcatttggttaaaaaaatattgtgggatttccctgggaaggtaaaagatgattaatattcgggagccagctgccaaggtggactcttctgttcaccttctaacttaaaagtgcacttcattcaggaacatccagtcatggataaaaatgagctggttcagaaggccaaactggscgaagcaggctgagcgatatgatgacatggcagcctgcatgaagtctgtaactgagcaaggagctgaattatccaatgaggagaggaatcttctctcagttgcttataaaaatgttgtaggagcccgtagtcatcttggagggtcgtctcaagtattgaacaaaagacggaaggtgctgagaaaaaacagcagatggctcgagaatacagagaaaaaattgagacgtagctaagagatatctgcaatgatgtactgtctcttttggaaaagttcttgat

SEQ ID NO: 2935 - DNA, 471 bp, Homo sapiens
  CDS 123..407
  misc_feature 427,445..446: n=a, g, c or t
tttctattataaaatgaaaggggactaccacaggtatctggcagaatttgccacaggaaacgacaggadaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagngraaccatctctgascannccctcctscccatcccaccctttgg

SEQ ID NO: 2936 - DNA, 464 bp, Homo sapiens
  CDS 101..394
attattctatatataaaaaagaacccgaaaagcctcgcgttttttctcttgtgttttcctcacttttctttttctcaaactgcaaaattttagtgcctgaatggcgaatggggaaaaggactggccggagagtgaggcacggaagggaggtctgaaagtgaatttttcaatgcctagtttacccttgatgtcgcattccatcttaaatggccactatgatgataatctgagcagtaatattagtcgattttcctgctctacagtgcggcttggagaagtcttgggaatcaaacggcatgaacttagattcctgttacacaacttttcaatgagggaggaggatatcgaatacctcactcagtcttcgggaatggagccttcaaaaacacttttgtgaggccgggcgcggtggctcacgcatgtaatcccagcactttggaaggccaaggcgggcggatcacgag

SEQ ID NO: 2937 - DNA, 515 bp, Homo sapiens
  CDS 25..252
ttttctttctgacctaatctcctaatgaatacggagacctgtgcaattccaaccaacactctgctcttttcttccttcatagctgtcacacagaggaaacccaagacagcaacatattctggaagccaggagctgctaaagtgtttcccacagtggctgaagcattttacattcccacctgcgatgcacaagagttccagtttctccacattcttgccaatatttattttttgtttttttctggaattgttatagccatttttgttggcataaagttgtacctcattgtggttttgattggtattatcctcatgaccaaggatgctgagcatcttttcatgtgcttgttggacatttgtatgttttctttggagagatgtctcttcaaatcctttgcccattttgaaattgtgctgtctgttttcttattgttgaattgtattgtttttaatatattctggatacagaaccctacgaataagtttatatttgtatatatgtaaatatgtatgtat

SEQ ID NO: 2938 - DNA, 772 bp, Homo sapiens
  CDS 53..676
ctttccagccagcgcaatctttgcggtttctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaatataaaaaaaaaaaaaaaaaggc

SEQ ID NO: 2939 - DNA, 278 bp, Homo sapiens
  CDS 44..262
taatcctgcaatcacttctgaccaggagttagatgataagaagatgaagaagaaaacccacaaagtgaaagaagataaaaagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaagactctaccgtgtcagcggaataaaactgaccaagac

SEQ ID NO: 2940 - DNA, 687 bp, Homo sapiens
  CDS 25..210
actctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccaaaaaaaaaaaaaaaaagg

SEQ ID NO: 2941 - DNA, 493 bp, Homo sapiens
  CDS 81..359
gcactggagctgggagcaaaaggaggctctcstgagaggagggccagttcagccgcagcaggaggactgacaggggcctgatggaggagttggtggggctgcgtgagggcttctcaggggaccctgtgastctgcaggagctgtggggcscctgtccccasatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgaggcttctcccagagcatcacgccctcctctggagttctggaatcccggagctgaagaccatgttggcgggtgtgatcttggaggactacctggatatcaagaactttggggccaaggtggtgggcctctcctgcaccctggccaccggcagcaccctgttcctgggcaaagtgggcctttcgtgc

SEQ ID NO: 2942 - DNA, 518 bp, Homo sapiens
  CDS 11..268
  misc_feature 501,513: n=a, g, c or t
aagaaggtggatgtcccagctcaagagaagagagtacatttgccctttcttgacgtttgtttcattcaagccctcaaagaattggatgatgcctgactatatcagtgagggaggatctttactcggtttatggactcaaatgctaatctcttctgaaaagaccttgacagacatgcccgaaataatgttttaccagctatctgggcatcccttaacccagtcaagtggagacataaaattagccatcacaccacggaaaaggaatgattagtttttataactaagaatatarattgccttcaatttctgtagagtttgcaattatgcaaagcttaactatttttggcagaaggggaatcataccctgattcaagagttccagtggtaagtggacaaaaagcatacaccactttccatgctttcctttgtcagtcctcagaactggctcaatcagtggccacagtaatrrcarcttggctscatcctttcagatgctctctngagagagatttnggaag

SEQ ID NO: 2943 - DNA, 509 bp, Homo sapiens
  CDS 163..345
agattagcctattctgggcatttcatagaactatatcaactagtgtgtgtcttttgtgttggcttctttcaccaagcacagtgttttcaagtccattttgtggcagcaggagggatcacagcttccttccctttcagggttccacagtgttccaccgtatggatggaccacattaccttatggatggaccacatttggctcatccatatgcccaccagtggctgctttctgggcattatgactaacactgatatgagactggtgttttttgcaaatggattacttaaaggtgtcttgaaggggtatgatactgcgatatgcacctttcactgcctggaatcttcctgagttttgtcttggtcgagctgccttccatgtacagccccctctgaagatgttggaaaggaggagaaggaagaggaaagcagaggggatcgccccgcagaggccagcctgcagcctgggctccatgcacctctggctgctaacgggatccacctcgggtcaag

SEQ ID NO: 2944 - DNA, 465 bp, Homo sapiens
  CDS 23..364
aggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggtgagccgcagccccgtcccgccctgccggascccagtaccagcttcgaggcccacctgagcctgctgccctgacccgtggccccagctgagcacgcaggcttcctggggttctcccagggtcggcggcagagcctccctccagggcccattgtgttc

SEQ ID NO: 2945 - DNA, 543 bp, Homo sapiens
  CDS 120..410
attgcctgcctgagtcacgtgtcagggggaagctggaaggcgtcgttctcctttcccagctctcctgcctgtccgccatgttttcaggccgggtctggcttggtcttcccccgtaagaaatggccggggagctccaggggacccaggcgccgtcgcttcggcggactgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtggaacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagct

SEQ ID NO: 2946 - DNA, 402 bp, Homo sapiens
  CDS 43..321
  misc_feature 91,292,352,359: n=a, g, c or t
atgttttcaggccgggwctggcttggtcttcccccgtaagaaatggccggggagctccasgggasccaggcgccgtcgcttcggcggastnggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatntccctgttggaacaatgcccccaaggacttgaaagaggagattcatattcgactctccanggttcangatatcaagkatgagccccaactccttgcagatgatgattcta

SEQ ID NO: 2947 - DNA, 538 bp, Homo sapiens
  CDS 132..317
taagttttcatatccatttttacttctcattatgaatcaataaattggttttctgaatttaactcttggactagagattctgctcttgtgtgccgagaattagtttgcagagacccaggtctgcagccatcatgaggactcaacttcgccacacctcacggaagagccccctgtcttctccccagtgctgtgtgatgcagattccttttacagcctgcctgcctgcctccctccctccctctctctttccctttttccttccttccttctttgaatgttacttttttccttctctgaattgtaatacagacatatggtaaatggcataaacatggcacacgttgataagtaaggaaaaggagactcccctgtaagtgctcatgacctcaacaccaggtcatgaaatggaatattaccagcagcctggggttccctgtgtgcccccagctgtctgcagtcatttctgtctcacttgcctctaggtaacaactattgtcaccttagactcattttcttgcgtttctttatggttttagct

SEQ ID NO: 2948 - DNA, 498 bp, Homo sapiens
  CDS 22..408
  misc_feature 482: n=a, g, c or t
ctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttmtcctggggctcagagtgttgtactcgtaaaacaaggatcatcgatgttgtctacaatgcatctaataacgagctggttcgtaccaagaccctggtgaagaattgcatcgtgctcatcgacagcaacaccgtaccgamagtggtacgagtcccactatgcgctgsccctgggccgcaagaagggagccaargctgactyctgaggaagaagagattttaaaacaaawaacgatctaaaaaaaattcagaagaaatatgacataahwnaaaaaawvaaaaagct

SEQ ID NO: 2949 - DNA, 505 bp, Homo sapiens
  CDS 18..209
acacacggcgcgacaagatggcggtgagcgcgcggcggaatctggaagcgggggggcgtggagctcgggccgcgctccaggtctcatgcgctctgctttccccgcaggataaggagaagaagaaaaaggagagcatcttggacttgtccaagtacatcgacaagacgatccgggtaaagttccagggaggccgcgaascagtggaatcctgaagggcttcgacccactcctcaaccttgtgctggacggcaccattggagtacatgcgagmccctgacgaccagtacaagctcacggaggacacccggcagctgggcctcgtggtgtgccggggcacgtccgtggtgctaatctgcccgcagaacggcatggaggccatccccaaccccttcatccagcagcaggacgcctagcctggccggggggcgcggggggtgcagggcaggcccgagcagctcggtttcccgcggacttggctgctgctcccaccgcagtaccgcctcct

SEQ ID NO: 2950 - DNA, 540 bp, Homo sapiens
  CDS 95..397
agttaaagatggtgtgtccagagtttgttccttctgatgttcggatgtgtccggagtttcttccttcaggcacacgttcctacttcgacttcagatgttgccaaggagaataaagcacaaaggagaattgtctcttgtctgcatagcagaacaaagaatatcgagcttacagtttgcctccttgagagaaccacatccagatcttgtggagatgactcttcatgacctggactttaaattggatacagttattagagaagatttgagttgtcatctttggggagaggacacgatgttatatgagaagaaaagtgaaagagaagcagttgtgaagtcagaagtgacatttccccgtagtcctaagtggtgctctgaaacttgttctcatcgctggatgtaagaaaaagtgattttcccttttctacccgaagcagctaagagactgctgtggtttctcatgttctctttcttcatcggccatctaggtgttaagttcattgtatggtgacataaacaagaaataactttcatttgtttaaa

SEQ ID NO: 2951 - DNA, 506 bp, Homo sapiens
  CDS 179..472
attcatccctgtcccagcctcaaggggcttcgtctctcctggggaaggggctgttcagagctgggatttcagaccccttcggctgggagttcctcccgcggcctccaagggcggccagggcacgtcctgaggccgccctcccatcccagcggacatctacgacaaagtgtcgggcgacatgcagaagcaaggctgcgactgtgagtgtctgggcggcgggcgcatctcccacagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcakggctggcctgctgctcctgcggcasctctggtgacgtgctgtccaccaggccttggagacaggct

SEQ ID NO: 2952 - DNA, 525 bp, Homo sapiens
  CDS 102..476
agcattccccgacggattggtcgtcgctctcgcaggcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagc

SEQ ID NO: 2953 - DNA, 272 bp, Homo sapiens
  CDS 34..201
ctcagcatctggagtagctgggattacaggcacatgccaccacgtctggataatttttgtatttttagtagagacggggtttcaccatgctggtcaagctggtctccaactcctgacctcaagtcatctgcccgtgtcggtctccggaagtgctgggattacaggcctgagccaccacactccacccctaatcaccccttctaataaagacacagctcatgtaggatgagagctaaaaaaaaaaaaaaaaaaaaaaaaaaaaaaaaaaaaar

SEQ ID NO: 2954 - DNA, 519 bp, Homo sapiens
  CDS 190..486
atgaaaggctgagagtggagaattaagtcataaggaaatgatcaaacctagggaaaaataagtggctataaaacactgaaagatagtcacatccacatagcgtgtatcatgcaacagacccgtgctcttagagggaggtagtgtgtgtcttcccatggcaaataatttttacaatactgctcatgtttaatgtgtgtctacagggcatgctgttgtctcaaaattgaaatgtgcatcttaggtatcagttcccagcctcagactcttctcaggcaggtggaccggatctcagctgcagaacatagtgagtggccaaacctacacagcccagccagtagtgtgctttggggtgattgcaaggcagcaaacagtggggacaagttttgtctggcatttgaaaaggtgttatcccttactttccacatttctgaattggattcttgttccctggtaaacaccagatattataaacagagcatgctgttatgacattgtgcttctatatacctwtttgtataa

SEQ ID NO: 2955 - DNA, 395 bp, Homo sapiens
  CDS 3..215
  misc_feature 381: n=a, g, c or t
ccatgaacccaaagatccaagaaactcaaagagctccaagaagaataaatattgattcaggccaggtgcagtggctcacgcctataatcccagcactttgggaggccgaggtgggtggatcacaaggtcacgagatcaagaccagcctgaccaacatggtgaaacctgtctctactaaaaatacaaaaattagctgggcgcagtggcatgcgctgtaatctcagctactcgggaggctgaggcaggagaattgcttgaaccagggaagcggtgggtgcagtgagccgagatcgcgccactgcactccaacctggtgacagagcgagactccgtctcaaaaaaaaaaattaaaataaataaatactgtttcaaggaaasccnccccaaaacttttc

SEQ ID NO: 2956 - DNA, 251 bp, Homo sapiens
  CDS 34..201
ctcagcatctggagtagctgggattacaggcacatgccaccacgtctggataatttttgtatttttagtagagacggggtttcaccatgctggtcaagctggtctccaactcctgacctcaagtcatctgcccgtgtcggtctccggaagtgctgggattacaggcctgagccaccacactccacccctaatcaccccttctaataaagacacagctcatgtaggatgagagctaaaaaaaaaaaaaaaaa

SEQ ID NO: 2957 - DNA, 257 bp, Homo sapiens
  CDS 34..201
ctcagcatctggagtagctgggattacaggcacatgccaccacgtctggataatttttgtatttttagtagagacggggtttcaccatgctggtcaagctggtctccaactcctgacctcaagtcatctgcccgtgtcggtctccggaagtgctgggattacaggcctgagccaccacactccacccctaatcaccccttctaataaagacacagctcatgtaggatgagagctaaaaaaaaaaaaaaaaaaaaaam

SEQ ID NO: 2958 - DNA, 462 bp, Homo sapiens
  CDS 203..433
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacmaaaattcaamcaaacaaaaacctgtcctttccccattaaatggtcttggcattcttgtcaaaaatcaggctggagtgcagtggcatgatctcggctcattgcaacctccaccttccagattctcttgcctcarcctcccgartagctgggattacaggtgtgcaccaccacgcccggctaacttttttatttttaacagggacggggtttcaccatgttggccaggctggtctcgaactcctgaccaacatggaggaaccccgtctctactaaaaatacaaaattagctgggcgtggtg

SEQ ID NO: 2959 - DNA, 590 bp, Homo sapiens
  CDS 380..532
cgtttgcagtcagcatcctagtggaaagagcaatgcacttgagcttgaaagatcaagaatcaaatctgactcaccttgtacaggtgtgacacagaggaggtgtcagctaatgttagcttaatacacctgctgggctaagtttttattaacataaaaaattttacattgcttaagggggaagtttccatccattcactccaggccaaagggagagcacttctcttaaccagatggagataattagaatgattgcaatggaaaaaaatctaaagtacgagtcaggaaaccgtggttcttctcaatgctagttaaccagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgctcggtggactctccccacttctctctggcttccagtttgtctgtg

SEQ ID NO: 2960 - DNA, 271 bp, Homo sapiens
  CDS 34..201
ctcagcatctggagtagctgggattacaggcacatgccaccacgtctggataatttttgtatttttagtagagacggggtttcaccatgctggtcaagctggtctccaactcctgacctcaagtcatctgcccgtgtcggtctccggaagtgctgggattacaggcctgagccaccacactccacccctaatcaccccttctaataaagacacagctcatgtaggatgagagctaaaaaaaaaaaaaaaaaaaaaaaaaaaaaaaaaaaaa

SEQ ID NO: 2961 - DNA, 371 bp, Homo sapiens
  CDS 124..288
gtagtttttcgccgtcgaggagttcctgcagagcgggctcaccccgcccggttgccattagttacccggacgcacctcccaccccaccaccggacggagtctcactttgtcacccaggctggaatgcagtggcgagatctcggctcaccacaacctccgscttccsagggttcaagcgattctcctgcctcagcctcccaagtagctgggattacagagcatgagatgatgcctcaactgatcaccaactctgcagaggcagtcactgatactatcattttcatctcctaattggattcctaggcaaaagtggacatattcaacctacaattaaagatgcttatattttacaacccaaaaaaaaaaaaaaw

SEQ ID NO: 2962 - DNA, 499 bp, Homo sapiens
  CDS 143..355
aactcttccagggaacaacatctcactcgggcctctgatattgtaactgtgggcctttaagaaacaacggaaacccaactgaataaaaactgacctcctttgtggctgccctgatggaaggggctcaggagcaacagccttcatggtgcccaccctctgggccagaacaacggatgccccacatctgagtttagtgcctccaagaaccacagctgcccttagaagagaaaataacacacagagaggacaccgtctgaagacacagacacgcagagaagatggccatgtaaacaacakgcagagactgaagttttgtgctggaaatcaaggaatgcccagggctactagaagtggatgagacaagcaaggctcctctcccacaggcttgggagggagcacggccccaccaacatgcaattcccttttcaaatgctgagggctgacacgctactccctcaaccaggggccaaatatttgccttaaaaatgaaactaaagta

SEQ ID NO: 2963 - DNA, 539 bp, Homo sapiens
  CDS 94..465
atcacgtggacgctactcgctatccccggcctgttggcttcttccgcgctggagtatccagataggcgacacgcggcgggsgctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaaaaactcccacggaatcctcagagaggaagaaattataggaaatcggagagcaacaatatgtttatctgaaagatggagatgtgattaagactgagggagccactctaagagttctatatacccctgggccacactgatga

SEQ ID NO: 2964 - DNA, 499 bp, Homo sapiens
  CDS 80..286
cttttttttcataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtgggaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggct

SEQ ID NO: 2965 - DNA, 452 bp, Homo sapiens
  CDS 273..443
atacatatattaactcattaaggatcactataaccttatgaggtagggactgttaacttcattttaagaagagactgaggcagagagtttaaataatctgctcaaggtcacatagtaagtcagccatcaggcaaagatatgaactcagtctggctctagaatctgtatttttaactacaataatggcacaattggataaagaagatatatatcagacaaatattcactgcagccttgtttttaaagtaaaaatttctgtttgacgcaagataatggattgtcaaaaaggaggcaatatggcaaacggaagttgtttggacctgaagtcagaagaatcaagttcagctcactttgattctgatgggatctaccaaagcatgtttgttgatatgatcaatccaaaagagaaggtgagactgatgaacaggaggactggagtcttgtagtaggag

SEQ ID NO: 2966 - DNA, 452 bp, Homo sapiens
  CDS 76..384
aaagagctctgggccactgcgaagattcaaaagctccaaaaacctactgtagacatcgaagaaccaatatatacaatgggccaacaatccagtgtccgcaggctgaagaggagcgtcccctgtgaatccaacgaggccaacgaggccaatgaggccaacaagacgatgccggagaccccaactggggactcagacccgcaacctgctcctaaaaaaatgaaaacatctgagtcctcgaccatactagtggttcgctacaggaggaacgtgaaaagaacatctccagaggaactggtgaatgaccacgcccgagagaacagaatcaaccccgaccaaatggaggaggaggaattcatagaaataacgactgaaagacctaaaaagtagcaagaagctacatccctcaaacttcggcaatgaaaataaagtttgagaagctgaaaaaaaaaaaa

SEQ ID NO: 2967 - DNA, 451 bp, Homo sapiens
  CDS 227..385
ctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaggaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgcaaaaaaaaaaaaaaaaaagy

SEQ ID NO: 2968 - DNA, 575 bp, Homo sapiens
  CDS 116..286
agattgttggaagacaatggaagtctagtagctgaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcagcacagtaaagggcatacatttcctgctttcaccaattaaccactgaattgctattttttccttttggcagatagctaggtttctggttcccccacagtaggtgttttcacat

SEQ ID NO: 2969 - DNA, 520 bp, Homo sapiens
  CDS 66..305
aggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacaaccaagttgtattgttagacacactggaacaagagatttcaaarttwaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaa

SEQ ID NO: 2970 - DNA, 631 bp, Homo sapiens
  CDS 260..481
aggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcaccctccccagacgacgatctgggatctagcaattgggaggcagcagacttgggtaatgaagagagaaaacaaaagtttcttgagacttatgggtgcaggaaagaaagaacatactggtcgtcttgttataggagatcacaaatcaacatctcactttccgaaccgggggaagaagacawwkwaaattaatgaagaactggagtctcaatatcagcaaaattatgggacagtaaatttatcagggaagatatcggcgacattgtggacttggcttcagtgaggtagaagaccatgatggagaagggtgatgtggcttggagatgatgatggatgacgatgatgattcacctgatcctgaaagtccagatgattctgaaagcgattcagagtcagagaaagaagaatctgctgaagaactccaagctgc

SEQ ID NO: 2971 - DNA, 491 bp, Homo sapiens
  CDS 310..462
tcgacaccttctgccctctgscctgccttggtgaccaaggacagtgtagcaggtaggtccctggtccctgcccccttatacctaccattgcacagatgaacagcgcttcagggaggagcatgggttcaggtacatgtggcacctgccctccctggccgccctttcactgctgactccatacagggcaagtctcttatcctcagccacgagttctcccatgggcttccttcccaagccccctagagggaacacaactgcagaggatgtgaaactgcatgcgtgaagtaaattacaaagaacactgagctgatgggtggatcgggcttcctgcggctgccacctctgaaacaatctaagttgagcatcatggagcatagttatcccaaggccaaggcattttccacactacaggagatgaaagccagtgtgactcacccagccactgtggaaatagaacagcactgaccacacacagtcaggatacagcgcca

SEQ ID NO: 2972 - DNA, 477 bp, Homo sapiens
  CDS 181..369
agaatgtaaaaatgaatggccacttccaggtatggctgagaagggtgaaaatgcatgcacccacagacacacacacacaccgtggaaatgaggaaaagttacttctctctgttgtaaatttaaatgcagtccagagtagtgaaggccgtttgtaaggtctgctgagctaatggattcataatgacttttaaagcttcactcggtacatcctatgtgccagacactgcgataggttctggagataacadsagtgtccaagaaacaacagtgtccaagaaacaggactttccctcaaagagcttactgggtaagccagcaagaccagcagacaaacacagctgcactgggggagagcctgctgaagctgcttgaatctcaacactgtcatacccgccatctcattatctacagccacatctaaaacccacatgaaataccaagtcacacgcggctctgggaaagacattttacagagac

SEQ ID NO: 2973 - DNA, 468 bp, Homo sapiens
  CDS 116..280
gaaaaggtgctttgaaaagtgactctcacgttagcctttggttgctgctcttcttacacatcacgagtaaggccctcctcccctcagcgaagactctacgaatcaagaggccaggatgagccttgtttcccatatgaatagactctcacttagctgggaaagccagaggaactccatctggccccttgatttacaagacattaaggggtccttacccaacccgcttcctcaagcagttaacctgtgtaagcagatcctcagcatttcaaaggagcccaattaactgacaaggtactggaacaatgtatgaagttcccaggattttgctcaaaaaagataacaacataaagccttgagtctgtgtccggcatagcatccatatctaactcttatgaaggatttagagccccgcacctggttccgttgctttttttgtaaccatttgtcttttaaattgtttatttctct

SEQ ID NO: 2974 - DNA, 517 bp, Homo sapiens
  CDS 48..347
acggaggcgcgaccgggccggcgctggggtaagaagcctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggaggagaaggagaagcggcgcctcgaccagctggaacgtaagaaggagacgcagcgcctactggaggaggaggactccaagctcaagggcggcaaggcgccgcgggtggccacgtccagcaaggtcacccgggcccagatctaggacacgctgcgccgagaccatcagctcagggaggccccggacacagccgagaaagccaagagccatctggaggtgccgctggaggagaacgtgaaccccgcgtgctggaggagggcagcgtggaggcgcgcaccatcgaggacgccattgcagtgctcaacgtggcg

SEQ ID NO: 2975 - DNA, 611 bp, Homo sapiens
  CDS 304..549
  misc_feature 511,514..515,574,578..582,584: n=a, g, c or t
atacagattctctctctgcatcatgaggggctgctgtctggggatgggggaagagtggtgtaggcaattcaagtctgcctttcctatcctcttcagtgcctctttccttaatatgatgtggagaaataggaacacttttacactgttggtgggactgtaaactagttcaaccattgtgggaagacagtgtggctattcctcaaggatctagaactagaaataccatttgacccagccgtcccattactgggtatatacccaaaggattataaatcatgctactatgaagacacatgcacacgtatgtttattgcggcactattcacaatagcaaagacttggaaccaacccaaatgtccaacaatgatagactggattaagaaaatgtggcacatatatgccatggaatactatgcagccataaaaaaggatgatttcatgtcctttgtagggacatggatgaagctggaaaccatcattctcagcaaactatcgcaaggacawaaaaccnawnnwccgcatgttctcactcatagcaatctctatctgtgaacctgtagtcaattcagagttnmcannnnndncgttctgttacagagggagtttagatt

SEQ ID NO: 2976 - DNA, 470 bp, Homo sapiens
  CDS 187..399
aagttctaggtgcagcttatcttccatccggctatgacttccgcaagacaatccacttctttgcatttctgtctatctccctgaaagaagacattggtgattccccaggtctcctacaactctgaaattttgattccaggcaatccatggggcagactttttatccttatttgacagatagagaagatgtcatggccctgtaagtcaagagaacaggatggccaaaggcaagaagaaaaaaaatttttagcagtgactccaggaacaccaaccccacagctcaaggaatcaggccaacctaattctaagagacctgggcagccatctggccctaaacccccagatggcaagagcaagggcctctgcaaggtcgaacgcctctcaagaagcagagaggattgaggcccacgtgtcttgactttccagcacttttactgcctggggcttggtctgctcaagatgtcagccca

SEQ ID NO: 2977 - DNA, 398 bp, Homo sapiens
  CDS 192..353
gatcagccgggcatggtggcaggtgcctgtagtcccagctgcttgggagactgaggcgggagaattgcttgaatccgggaggcggaggttccagtgagtcgggatctgtgtcggtgcactccagcctgggcgacagcctcttccccacacctagtaggtgtgstacacctccctttgccagtcatcccgcsatggatggggagcctacttggtgccctggcaaacctgtttacactaaggagatgcccacagggagcgggaagctcccaaacccgtcagtcattctccagcagagacctttgctcttggccaggtttgaaacgatgttcaacctcgcyacgtcaatgtctcagtaaaagacactatagatagttatggacaatacactccaagaatac

SEQ ID NO: 2978 - DNA, 517 bp, Homo sapiens
  CDS 297..494
gtagaatttggagggacacaaatcccagcaccatccaatcttatcctatcctatccttccctaccctatcctatcccatccgcatcttatgtcattgtttcaaattactggttgcaacccaccaaatgatgttatgacccratgagtgcgtctaaatcctaagttctgaaagctgttcttagtggtacattcccagaaagccatagttgttggtaatcagtgcttagtgtgtatttgctgcaattggcagggctcagcatggtgtcataccttgggatccagagtgcccccaggccatgtggggacaggtaaggagaaagaaattaggagcttccaagaatctggttacccagaaccctgaccccactaggaggaatacaggatcacattttatggcctcttgtctttgtgatggcccatgttcgtgggggaccttgaggctaggtggtcctagagacccagtgggcagcgtggccctgaacttaagccagcattaggtcaggagggtttagaaggc

SEQ ID NO: 2979 - DNA, 491 bp, Homo sapiens
  CDS 20..463
acagccctcaagacacaccatgggcccagaggcaggtttgctacacagcagcgacgacgcaggcggcgccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagccctggtggccaaagaaaggtccccggtgggaaaacgaacccggctagaagagttccggtccgattctgcgaa

SEQ ID NO: 2980 - DNA, 484 bp, Homo sapiens
  CDS 35..331
gaggtagcatgtgtgccgcttccaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcgccttggtgccgggagcaaccgactgtaagatgtgtacctccctacgagcaccggcccggaatgcagtrtgctgttacaactcccccgccgtcatactacccatatccgaaccttagatgggacacaagtcacttcaagaagtctggtggtcccagagaaacaactatgttatccatcc

SEQ ID NO: 2981 - DNA, 577 bp, Homo sapiens
  CDS 247..513
tcctaccaaccgttcttattgctggcggcctgaggagcccatcatggcgacgcccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctwwvaaaaaaaaaaaaaaaa

SEQ ID NO: 2982 - DNA, 555 bp, Homo sapiens
  CDS 60..434
acccggaagccgcggttcctaccaaccgttcttattgctggcggcctgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacatatggaactcataggttttcataaggctcagcaacagcctcaccaaggactccatgaatatcaaagcccatatccacatgttgctagaggggcttagagaactacaaggcctgcagaatttcccagagaagcttatcgatas

SEQ ID NO: 2983 - DNA, 507 bp, Homo sapiens
  CDS 75..227
gtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatggggatgagtgggaggaagccctttgagaaggggagccggccctgtcatgcgcaggttttccactcatctgaggaagagccaggggctctgaattttaagc

SEQ ID NO: 2984 - DNA, 501 bp, Homo sapiens
  CDS 202..369
aaagatggccgatggcggtcgggggtgctggtgggagccgcgtgtccagcgggagggacctgaattgcgtccccgaaatagctgacacactaggggctgtggccaagcagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtaccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttg

SEQ ID NO: 2985 - DNA, 783 bp, Homo sapiens
  CDS 575..769
  misc_feature 622,666,767: n=a, g, c or t
attcagctgggagcatccgcagactcacgtctccaaaaaccaagctctccgagtgagcaattcctgtccctcttaagggcttacaactctaagggggtccgcgtgagagggtcttgatggattgaggaagcataggccctcctctgtgtggagtctctcgctggacctggaactcagggatcctaggcaggtcagctggaagggaagacacgcctctccacaccaagcctgaggttcaccgcgaaagagaggccgccaccctgccccaaacccgccccaacctgctcctccagcagagccctgtgttcttcctggctgaggagtggttccagcaaagcgggctcttccacgtccttcagctcccccagtggcgccggatctaggaaaggttgtgccttttgctgaaactctggggttgacaggagctcatctaacaggctggaggtgagtgcagaggagagccccggctcctggagcggttgggaggtgcccggttggctggcatctgtgcttgacgcggaggcctccggggtcacgagctccggaggtgaaggtgccccgtcttcgggttcccatgccgccctggcgacctgcggctccaggcccaccacggactccggtnggacgtgggtggcgcaasacacctttcccctgtgactcagcttnaggggccccaaggtgtcccactgagcacgcgcccagcaggccatcgcgctgcgggttctggtcttcctgtcatttgttggggttcggaggccaccagggantctgaggatgggagat

SEQ ID NO: 2986 - DNA, 502 bp, Homo sapiens
  CDS 63..467
aacagcggcctctgacaccagcacagcaaacccgccgggatcaaagtgtaccagtcggcagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggacgagctgcatcactcaggatggaacacctgcagcagctgcttcggtgatagcaccaagtcgcgcaccaagctggtgctgcccagtctcatctcctctcgcatctatgtggtggacgtgggctctgagcccggcccccaaagctgcacaaggtcattgagcccaaggacatccatgccaagtgcgaactggcctttctccacaccagccactgcctggccagcggggaagtgatgatcagctccctgggagacgtcaagggcaat

SEQ ID NO: 2987 - DNA, 342 bp, Homo sapiens
  CDS 115..288
taaatatattaaatatgtgtattatattaaatacagtattaaaaaaaaaagattgaggtggccaggcgcagtggttcatgtgtgtaatctaagcactttgggaggccgaggcagatggatcatttgaggtcaggaatttcagaccagcctggccaacatggcgaaacccccactctactaaaaatacaaaacttagtcgggtgtggtggagcgtgcaggtcatctcagttactcggaaggctgaggcaggagaatcccttgaaccgcggggcagaggttgcagtgagctgataccgcaccactgcactccatcctgggtgacagagtgagacctcgtctcaa

SEQ ID NO: 2988 - DNA, 272 bp, Homo sapiens
  CDS 34..201
ctcagcatctggagtagctgggattacaggcacatgccaccacgtctggataatttttgtatttttagtagagacggggtttcaccatgctggtcaagctggtctccaactcctgacctcaagtcatctgcccgtgtcggtctccggaagtgctgggattacargsctgagccaccacactccacccctaatcaccccttctaataaagacacagctcatgtaggatgagagctaaaaaaaaaaaaaaaaaaaaaaaaaaaaaaaaaaaaar

SEQ ID NO: 2989 - DNA, 478 bp, Homo sapiens
  CDS 195..350
ttaaaaatatttcttatagtctcctaacatttgtctctagcctttgcctttgtacaatcacagatatcctatggagatttaaggatgaaagccctgagttgttcttgggttcttggatctggactacttgttatcttatgcttctcacttctggctaaaacttgcacctcttcttctcttagctargccccaaaatgaagatttccttcagaagtcttgttagcagaattatttatcagtcacagagagaaaaatctgctatttttctaagtaagagtctcgagaagcagagtttttgtcttgtcattgagaggagtcagcagtcttgttctgtaaaggaccagagatggtaaatactgtcccactcagctctgctggcgcagtacagcagcagcagccccagcacagctgtgttcctgcggagtcccctttacaaagccgctgacccctgatgtgaamatttgtagagcagcagagt

SEQ ID NO: 2990 - DNA, 482 bp, Homo sapiens
  CDS 244..411
  misc_feature 10: n=a, g, c or t
acgcagtgangtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggccggctgaggcagagcaccgtgaaggccaccgacctgcactccgccgcctgcacacatcctcctggcgagctgacagcagcagggcctcactcactcgtgtgcaccgccargcttatgcacgactctaccccgtgctgctggtgaagcaggatggctccaccatccacatccgctacagggagccacggcgcatgctggcgatgccatagatc

SEQ ID NO: 2991 - DNA, 549 bp, Homo sapiens
  CDS 180..515
gcgacgcagcgcctgccagtgacgtcgtgggctgcagcgcaagcacccaacgcatctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgaatgacttgcatgtggagcgctaccgacagttctgg

SEQ ID NO: 2992 - DNA, 541 bp, Homo sapiens
  CDS 195..428
  misc_feature 28: n=a, g, c or t
tgcagcgcagagcacccaacgcagtgangtaccttgatctcctgcgtggcctcgtccctggtcttagttccaccgggcagcgggagtcaggaccgcctgtcctcagacccctccgcagcgactgtggcggccgcaggttgcacgccagggcctgtactgaccamctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgccatagatctggacaccctgtctcctgaggagcgccgggccaggctgcggaasgtgaggctcagctccagtcgaggaaggagtacgagcaggagctcagtgatgacttgcatgtgt

SEQ ID NO: 2993 - DNA, 476 bp, Homo sapiens
  CDS 202..432
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacmaaaatcaascaamcaaaaacctgtcctttccccattaaatggtcttggcattcttgtcaaaaatcaggctggagtgcagtggcatgatctcggctcattgcaacctccaccttccagattctcttgcctcagcctcccgagtagctgggattacaggtgtgcaccaccacgcccggctaacttttttatttttaacagggacggggtttcaccatgttggccaggctggtctcgaactcctgaccaacatggaggaaccccgtctctactaaaaatacaaaattagctgggcgtggtggcgcatgctgtaatc

SEQ ID NO: 2994 - DNA, 499 bp, Homo sapiens
  CDS 295..477
agtgcctatgaagggcgakgggtgtggtcacagggcgggatctacgaaggatgcaggggcgaggccgggtctctgcaggatgtgcggtcgcgggtcggagtctataaagattcctaggtcaaaacaaagcataaacaatcaacgccaacagaaaaatcttccgaagaacaattacaagaagtaactcaggaaattttcccaagaggcaatccagaagagtttgagtttcgatcagcttgtaggactgagacaggagcagaacattgctggaagaaattcacaatacagaccaggatgaagttatttccccaaaagagaggttcgaggcaagtggtcagctccccgttgaaaatcattgtagcagacaaataccgggaatgtaataaattggagaaaagtttgtctctgggcacaaagcctgttgtacctctgagggacaggccaggaaagwgagccagtggatggaggatgggtggctgatgctttccatgtgagtcat

SEQ ID NO: 2995 - DNA, 509 bp, Homo sapiens
  CDS 202..459
atgacttccagagacagaggaaaggctgaaggttgagttgattaccagtagctcacgatataatcattcatgcctacataacacagctttcataagaacccaataggacagggttcaaggaccctctaaagaatgccacacctatagaggcatggaaactctttgccactttcatctgactattgatctatatcctttgtaatgcctcttataagaaatgggcagattctagcagtgtttgtgagaaaaactgatggatcctgcagattaactatggacagccaaatattgagtaaagtgatgtctacaacagcatcagctatgcctgatatggtgttaattcacattgtgaagttccaaaatcagaagatgatacagaaagattgctctggttgcctggtttctgaagaaatcgtgtaccctgtctggatagtgtcttacttcctatccacaaagttgtgaaataatctggaattaaatggcaacctaaacaaaaaaaaaaaaaaatg

SEQ ID NO: 2996 - DNA, 466 bp, Homo sapiens
  CDS 39..371
  misc_feature 450: n=a, g, c or t
agaccgatttaaggctgcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcagtcgtgcgcaaattccggggccacgcagggaaggtgaacacggtgcagtttaatgaagaggccacagttatcctgtccggctctattgattccagtatccgctgttgggattnccgctcacggaggcct

SEQ ID NO: 2997 - DNA, 486 bp, Homo sapiens
  CDS 178..414
ctctctgccgtgggcctgcgagaatcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcagtagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggccctggtacagaaccatgactggctgctgaattctgaaaaccaggacttggttcaacatttaaatttgatagttgccctgattcccattttgggtttgtgaaaagtgtatgtatttaaatttgctgtaaaacataatcactaataatatgcaataaatattttcttgaag

SEQ ID NO: 2998 - DNA, 546 bp, Homo sapiens
  CDS 120..431
  misc_feature 344: n=a, g, c or t
taaagattaaaacataatgtaagattaggaacatcaagttaaaggtaagctcattaaataaaagagaattgaagactctagagaaattagcatactttaaattcatatcatctcccttgatggcttcttggttgtactgggggacatgggttaatccagttgggagtatgtatatccaaaagattgtaaatcaaacctacttattcataggttccattcttatctgtgctactgtgttgcaaatgaaaagtaatgaacatatttgcagtaagcaagcaaagttatgtacctttggtctatgggaaaattggaaaattgcagtttaccttatatatatatatytnahttctgttggtctatgggaaaattgggaaattgcagtttccttacatatattttatttctgttttgcaaaatctgctttcattaagtaactgttttacaaataaaaatattccacatgtgcagtgtaggcttctaagaacttttatgttgataatgacctaacattccaattgttattaataaaataaggatgatacaatg

SEQ ID NO: 2999 - DNA, 345 bp, Homo sapiens
  CDS 104..271
cctaccccctttctaggtaaccgctttatcttttatcaccataaagtagtttttagccaggtgtggtgactcacgcctgtagtaccagcactttgggaggctgatgcaagaggattgcctgaggcaaatagttcgagaccagcctgggcaacgtggtgtgacctcatctctgcaaaaaattagctgggtatggtggtgcacgcctgtggtcccagctacttgggaggctgaggcaggaggattgcttgggaccggggggttgagactgcagtgagccatgattatgcactgcactccagtttgtgtgacagagtgagaccctgtctcaaaaaaaaaaaaaaaaag

SEQ ID NO: 3000 - DNA, 482 bp, Homo sapiens
  CDS 291..467
caagaaaagtcacatgccatagccatggtattgcacatcattcatcttgcattctttgagaataagaagatcagtaaatagttcagaagtgggaagctttgtccaggcctgtgtgtgaacccaatgttttgtttagaaatagaacaagtaagttcattgctatagcataacacaaaatttgcataagtggtggtcagcaaatccttgaatgctgcttaatgtgagaggttggtaaaatcctttgtgcaaactctaactccctgaatgttttgctgtgctgggacctgtgcatgccagacaaggccaagctggctgaaagagcaaccagccacctctgcaatctgccacctcctgctggcagatttgtttttgcatcctgtgaagagccaaggaggcaccatkggcataagtctactcacttatatctgtttgtctggaacataacccatgtttgtttttacaacaaataaaattgatcttga

SEQ ID NO: 3001 - DNA, 584 bp, Homo sapiens
  CDS 110..271
acttaaggcgcggccaccssgctgcgcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagagagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcg

SEQ ID NO: 3002 - DNA, 483 bp, Homo sapiens
  CDS 248..439
aagagttcctggcccggtgcacctgagaggtcgctctccgactcccgcgctggaccctcttgcgccattgaaccccctgatccgggggcctcggaccccagggctcaggaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctggacatgaatgactgagcaggctcatcgccccttgtccacagctcccagggacagaa

SEQ ID NO: 3003 - DNA, 518 bp, Homo sapiens
  CDS 336..515
  misc_feature 482: n=a, g, c or t
tccctcgggtaacggtcgcgagaggccgcttgcatgaccctgacatcggcagcgggasgrcggccagactctcttggaagtttaggatatttcacagttctgaatgttagccactgaaaatgccagtagatgatgaagcctctgaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgataggtaagaatgggatttaaaaaaaatgtaccaaatcagaataaccttatttgcatacgtttatcaacttatccaaatagtgtcatagttactgatttgaattattattattttttaacctatcatcaagaatgttcagggaggctgggcgcggtngctcatgcctgtaatcccagcaccttggtaggctga

SEQ ID NO: 3004 - DNA, 393 bp, Homo sapiens
  CDS 85..300
  misc_feature 299: n=a, g, c or t
gaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcasaggaacmnatgaaacagcagcagtagcagcagcagcaacagcaaggtgtacttccacagactgttccttcacaaccgtccagtagtactgtccctcctccas

SEQ ID NO: 3005 - DNA, 557 bp, Homo sapiens
  CDS 141..536
gacgtcataggtaaacaggctctgtatccgtggcagcggccgtggcaggctggctgggtacggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaatttcgctttat

SEQ ID NO: 3006 - DNA, 388 bp, Homo sapiens
  CDS 203..361
aagtgggagcgggcctggagtcttggccataaagcctgaggcggcggcagcggcggagttggcggcttggagagctcgggagagttccctggaaccagaacttggaccttcwcgcttctgtcctccgtttagtctcctcctcggcgggagccctcgcgacgcgcccggcccggagcccccagcgcagtcccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccmaaggaggtgatggtggatgacaggctagtcacaatgcagatatg

SEQ ID NO: 3007 - DNA, 548 bp, Homo sapiens
  CDS 127..453
acatgtctggttccgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtactctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctggaaaaaaaaaaaaaaaa

SEQ ID NO: 3008 - DNA, 513 bp, Homo sapiens
  CDS 127..297
acatgtctggttccgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccagacagagtctcggtctgtcgcccaggctggagtgcagtggcacgatcttggctcgctgcaacctctgcctcccaggttcaagtgattcttctttttcttaaaaaacataaagctctaaaatacaaaaaaaaaaaaaaa

SEQ ID NO: 3009 - DNA, 491 bp, Homo sapiens
  CDS 114..284
cgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgaggggtgagg

SEQ ID NO: 3010 - DNA, 507 bp, Homo sapiens
  CDS 153..413
attcagccagagcaggtggccgagccagctgggctcgtccccaaatactttcagggagggacgctaggcctaggacccggggtctacagccctgaggggagggggcagaggatgcagccttggaaagcccagtacctgacctcctgctccagatgcctggcttctccagggcaccccgatgggtggctctgccaccccaggacactggactggggccacccttacagaaccggttcgaagccaaacaatggcacgtcgcagtccagctgagccggagsctcagcagggatcccatccaggatctcacattctacgtcgttgtcattgtcttgcctcctgaggctcctcttggctgtgaccacttctcggacttttattttgatgaaaatattttgatgaccctgasaagtttttgagaagtcctggtttggtgtcttggaggatactgctatactgggaatttgtttcgtgttgttctcatgtttagacagggggttatgggttttt

SEQ ID NO: 3011 - DNA, 704 bp, Homo sapiens
  CDS 25..462
aaacggtgtttggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttcttttgtcttacttgtcatttgaaggtgcaactaaaagaaacagaccaaatgtgcaggctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatat

SEQ ID NO: 3012 - DNA, 505 bp, Homo sapiens
  CDS 120..401
agcagcagctgcagcggcasagcggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagagccttgcagcctcccaatatcacctcctattaagaacatatcctggagccggctgacaaaaccaaaatgtggtttgcagagttcctgctccagcatcacgaaagagagtaaaggtggatttggaactgaggcggastcccacctccatatacagccattgccagtccagacgccagtggtattccagtaataaactgccgtgtgtgccaatcactaatcaatttggatggcaagcttcaccagcatgtggttaagtgcacagtttgcaatgaagctacgccaatcaaaaac

SEQ ID NO: 3013 - DNA, 557 bp, Homo sapiens
  CDS 135..293
aaggccgggcaaccaaaatgttcycgggactattctgtacttaaccctggtttctgcttaggggacggtgggacaatatgcatatggatgtctatgtgggatttgttgcaagagcacaacacaccccttgacctatgcaagtgccagastgtctgagcccagcttctactcctgttaatgatcacaggagcctcatacacaaccattgtgcatggcggctggagtatggagtagtaaatggtatccagaaaggcaggtctacggtggcatgggatttcctggtacttcttctttaatagaaactatcttcacagatcatgacatcaggtcagctgcagttctcactgggaccaataaacaatagaagcaacaaccataaagacttaagaggacaaargaaaccaaacctcactgtgtgtcttcaagatctgttcacatagttgcaggaagttgctgtagacaaagtacattactaaagaatgaagccacccaggacatcacagcaacgawagaactatttctggtactgtggaccaggtgagagcacactgtagaaa

SEQ ID NO: 3014 - DNA, 467 bp, Homo sapiens
  CDS 46..432
  misc_feature 406,425,449: n=a, g, c or t
agttttgatctaggagaagatggtggcctgaaagtggatgatcatatgcacacatcccttcctgatatctatgctgccggtgacatctgtactacatcctggcagctgagcccagtctggcagcagatgaggctgtggacccaggctagacagatgggatggtatgcagcaaagtgcatggctgcagcgagttcaggagactctattgacatggatttcagctttgaactgtttgctcatgtgacaaarttttttaactataaggtkgtactgctgggaaaatacaatgcacagggcttaggttcagatcatgaattaatgctgagatgtaccaaaggacaagaatacatcaaagtcgtcatgcaaaatggacgaatgatgggagctttcttaattggtgaaactngatttagaagaaacatttngaaaacctaatcttaaaccaaatngaatctttcatcatatgg

SEQ ID NO: 3015 - DNA, 338 bp, Homo sapiens
  CDS 3..215
  misc_feature 193: n=a, g, c or t
ccatgaacccaaagatccaagaaactcaaagagctccaagaagaataaatattgattcaggccaggtgcagtggctcacgcctataatcccagcactttgggaggccgaggtgggtggatcacaaggtcacgagatcaagaccagcctgaccaacatggtgaaacctgtctctactaaaaatacaaaaattanctgggcgcagtggcatgcgctgtaatctcagctactcgggaggctgaggcaggagaattgcttgaaccagggaagcggtgggtgcagtgagccgagatcgcgccactgcactccaacctgggtgacagagcgagactccgtctca

SEQ ID NO: 3016 - DNA, 513 bp, Homo sapiens
  CDS 277..495
catgagccaccaaaatggtggtgttcgggtatgagkctgggactaagccaagggattcaggtgtggtgccggtgggaactgargaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaacatgatgctttgaagacatatgcatcca

SEQ ID NO: 3017 - DNA, 469 bp, Homo sapiens
  CDS 182..445
tacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgcgggagagtgatgagagtggagaaagcgcccctgatgaagggggagagggcgccgggccccccagtctatccctcgctctgctagctatccctgtgcagcaccccg

SEQ ID NO: 3018 - DNA, 531 bp, Homo sapiens
  CDS 354..509
attcattacactactcttgccaatcaggaaagattattggttcgcattaggaaaaagattttaaaggacgttttaaacaataagcctttccgcttaggccttcgttaatagcacaactgaattagaacagtccattccccaaagactgcacttaatcatgtcggttttctgcatcattttaattgctgttgacttttcattgacatttagcatagatttttgctcatttttgttttttaaagaacgatactgaaagacaagaaaaatgctatcagaggactacaaacctacaggagttgagtttcagtcgtgaaacattataatcattttctgtgctttccatatttccttgaatgagaatgtattatttttataataagagaaaatttttaaaggaaaagaagttaaaaaaaaaaaaggcctcacttgtaaggwagggwatggttttttcaagtctcaggcacgtaaatgacaagggactttttaaaaaacaaaaaaacactgccatttaaagctgactggtaggatctt

SEQ ID NO: 3019 - DNA, 610 bp, Homo sapiens
  CDS 129..281
atctcgctctgtcctgctaagaatctgcctgcctgagtgatgcagccaggctcccttgttccctggggcaaggaaccagtagagggatagggaatcacagtgtttcccggctgcaagggcccttggagatggttttacagatgaggaagcagagtccagagaaaggaagtgatctgctgggaaccactgtacttttcacacaagcaactttccaggcatctgctatgtgctgtccacaggatggcgaggggactatcctaaacatcctgccattaattagctgaacagcccatctagtaaacaagaccgatggttgaggggctggaaaagaggaggagtcagcaagttgaaagtcacaacagaccagcccactccctcagataaaagaaaggcacatcacagttgtcacatcagcaggctagaaaagccatcccattcctgcggtaggcattctgtcaaagaaaaagaaatctgcaatgaattatcacatgaagtcaaacaaggaaaggaggcaaaaagcaagcagarrkywcttcctgttttgtagactctgctggctacaatctaatagaatgcttaatctgaatatttctggtggcaaaaaaaaaaa

SEQ ID NO: 3020 - DNA, 466 bp, Homo sapiens
  CDS 73..249
ttacttgcctgtgcagactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatghhgggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctaaaaaaaaaaaaaaaa

SEQ ID NO: 3021 - DNA, 530 bp, Homo sapiens
  CDS 161..439
actcatggtacaaattactgtattagtcagggttgtagcaggaaacagatggcacaaccaaaagtaatgatcaaagagggtgtaggcaagaataacaaaaatctatggagatggtgcagcagcttaggctaagcaagagcaagatctttctacttctaaaatgaaaaggcagggaaaagttgttcctgaacccatgagatgtatatatggagaaggctatgtcagaagctgtgatgctgaggaacacagctatttccaagccactgcagggcaggaagggaatcatcatgactttgtaccatttcgtattggaatttcttctgtgaagcaaaaacagtcccaaaatgaaggatcttcaggtgtcatgggaacggcagatgacattaaatcattaaagttgagaatagtaaattgcctctgggttggtttggaatcatcctgagatggaacctaaaagacaaaagcagattaccttattgttatattgcatgttaatcttatgatcaatttcataatcatgaaaataagta

SEQ ID NO: 3022 - DNA, 436 bp, Homo sapiens
  CDS 82..393
ctctgcacctgaacgggagtccaagtagctgcatagccagtaggccttcctgggtggaagacattggggataacctgtactatggacactaccacgggtttggggacactgctgaaasatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactggcttgttttgtgcatgagtagggcttactaagtgcatagatgtttctacagtgaggt

SEQ ID NO: 3023 - DNA, 494 bp, Homo sapiens
  CDS 200..391
taccaaagatcactggctatcttggtttgtgtttttgttactgcttttattaaattcttgctgatgacacatatcctgaaggatagagatgctattagttttaggctaactgtgaagtgaataatatgcataaaatatcaaagatcaagctgggagagaaatgtgaacaaatttataatccctcttgtagagcataaaaatgacccaggaaaagaaagtattcaatctaagggaagagggaagcacaagttttgaaagtgttggcagtttgttctcacccagtttcgggggaggtttccttctttatctctgtgagcaccttcagaatggcatcagaaatgttttaatacataactcagtgtattcctcaaatcattttaggggggatctgtaattcctattgaatgtacaacatgactatactatatacattcaatttatatcaacatgagttctcaattgcctatgttcatttcaacgtcaagttcatatag

SEQ ID NO: 3024 - DNA, 488 bp, Homo sapiens
  CDS 134..469
atagggaggcggctgaacaaggttgtgggggtaggaagctagggttagaggcaacccgtgagctagaaccccgaacgtggtcggttggagaaaatatgtccctccggagcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaatccaggtgagcagtcgccgagccctgagcagttcataaacaacgcggagcaggg

SEQ ID NO: 3025 - DNA, 582 bp, Homo sapiens
  CDS 114..491
aactcctctcaccggcccctggaaagggttccaagtcctttagtacccgacgctgtctgggaattccgggcgtttcggctccttggtcgcagaggcaggaggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctgg

SEQ ID NO: 3026 - DNA, 355 bp, Homo sapiens
  CDS 20..217
caaagggtcccgctgcaaaatgacacaacacaaccaacatctgcaaacagagaacacccagccaagagcacaggctttgsagckggcagatcccaaatcatcacttcaggcctgctcgctggtccctggacctcgggaacatcgctttgctgctctgactttcattcttccctgcacagagaggtcacgatgcctcttcccggggctgcgaggaaaatgatctgcactggcgtgasagagaacctctcctcagcggtgctcagtacaggtttgctgcagggatctaggcagcaaacggggctgtcctccggagcagtctctggagggcagatgcagtccaccctctctgagcccc

SEQ ID NO: 3027 - DNA, 807 bp, Homo sapiens
  CDS 513..713
attcaactgaagatgtgttactctgtactcactctcttagttcttaagatctcacagacctgttggcaagtatactccaggacagcaggaggagacagcatgagagaagagaagcagctgaggtctttggttctcacaggtatctcctttcctcacactcaatgactttttccaacctcattcaacatgtaaattgagagacagaatagaattgtgcccaacactgcctacccactacccactatcgatttgctccttacactaatagaacccccattatgtctggtgtgatgatgtacttagttaaactacttcttcccaaactctcttgcatttatgcacaagcacgtgacccagttttgctcaaagagacgtaggtaaaagttgctgagtagtactcccaggaaaggtttttggttttgttttgctaaagggaaagacctggcagaagtgaaccctttgattcttttctttaactcttatcctattattttgcctgggacacggtcacaatgttgagaggtggagcagccactatctggccatctgaggttggcagaaccagaagtgaaaaacagtctatattcctgaatttcctgagcaaatgcatcaggactaggctgcctatctcaaaacttcttatttatggaagaaaaataaagccttttgtgcttaagcccctggagtctggttttgttctatgcagccaaatgtaatccaggctgatggaaagtaattggaagaatgaacagcttattaattgcaattattattwatatwattycyctataccccttgccagaatat

SEQ ID NO: 3028 - DNA, 254 bp, Homo sapiens
  CDS 57..218
  misc_feature 179..180: n=a, g, c or t
agaggcccaggaaagagagagaagaccaaccaaggggtggctggagtcccaaggccatgaactttcaggaaaatgtgamcctggccatggsccttgttcaccatcctgacctccatctatttcttcaacaaggctcagcagtgagaagacacaggacctccccgcacaagagccctgcnnctccctctgccatcgctctgaggccagataaatgtaactgaatccgcaaaaaaaaaaaaaaaaaaaaaaaaaaa

SEQ ID NO: 3029 - DNA, 533 bp, Homo sapiens
  CDS 114..464
actcttaggttaaatcattcgactccttccttccttgcagcaaaaagcaatccgccgtcgagcttcgttcgtctctcagaagaagctgcaaatatggcgacasgtatcaaccaatgaaaccagggaaggctggtttggaagagccactcgagcagattcacaagatcagaattactctctcctccaagaatgtcaagaacttggaaaaagtgtgtactgatttggttcgtggagctaaggacaagagactgagagttaagggtccagtcagaatgcccaccaaggttctcaagatcactacccgtaaagctccttgtggtgaaggaaccaacacatgggacagattcgagcttagggtacacaagcgagttatagatcttttcagctctcctgatgtggtcaagcagatcacctccatcaccattgaacctggtgttgaagttgaggtcaccatcgctgactcgtagatcaacccttctgtggctttgttatctcttttcaaattctcttaagaaacaatcttcttttcccgt

SEQ ID NO: 3030 - DNA, 505 bp, Homo sapiens
  CDS 123..356
aggagccaagggggcgagcaagctcggtggctgggtgggttggggcgttccgcgcgcccttcattgaagcggcggtggccgggctgggcgccggtagtggaaagcgacggcgcggctggaaaatgccagtccattcccgaggggataagaaggagaccaaccatcacgatgagatggaggtggactacgccgaaaatgaggggagcagctccgaggacgaggacactgagagctcgtcggtctccgaggatggagatagctcagaaatggatgatgaagactgtgaaagaagaagaatggaatgtttggatgaaatgtccaatcttgaaaaacagtttaccgatctcaaagatcagtaagtagtgactttagaaggccattgtcactgaatctcaaccttgtcacttgtatactagcacaagagcaactagattcagtctcagctgttttgtattttatgcgacagaccaatttgaaagaggcttcaactattgtttgtctacta

SEQ ID NO: 3031 - DNA, 520 bp, Homo sapiens
  CDS 85..234
ataaatagcttagctaccgatgactctgcctgttttagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcagacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaacagccagggacagat

SEQ ID NO: 3032 - DNA, 585 bp, Homo sapiens
  CDS 248..418
taacatctttattcaggctattcccagatctcttctgaaatctgtaggtccttggtgctggctccgtctcaggtgagtttttcttcattaagtgcactactcatgtgaacataatactacagagaattgccttctctgtgatagtgtttgtgctttggagtacatgtatcaaattcatctgtgaaggaacctgggaaatattatgaatttagtcataatatttataagtaacttatgtttgtaagtaatgtttataagtaaccaatttttaaaaacagtttttaaggccaatatatttgatgttgttactgctattaaatcaaggttatcagggctgggtagggtagctcatgcctataatctcagcactgcgggaggatcgcttgaggctgggagtttgagaatagtctggacaacatagcaagatcgtgtctctacaaaatattaaaaagatatccggggctgggcacagtggctcacgcttataatcctaacactttgggaggccaaggcaaacagatgagttgaaatcaggagttcgagaccagcctggccaacatggtgaaaccctgtttctactaaaaa

SEQ ID NO: 3033 - DNA, 420 bp, Homo sapiens
  CDS 144..368
  misc_feature 293..295: n=a, g, c or t
gaatattcggagaggagtcctgagagttgacttgtgttaaagtagcactcgtagagagcaacaccatatagtacagttttgggggtttttttcttttttttttttgaracggrgtttcactctgtcgccctggctggagtgcaatggcgcgatctcggctcamagmaacctccacctcccgggttcaagtgattaycctgccgmagcctcccgagtasctggtattamaggsgcccgcmaccasgcccggmarattttttgwatttttagtararacggggtthcactgtdcnnngccaggccagtctcgaactcctmacctcgtgatccgccctccttggcctcccaaagtgctaggwttacaggcgtgacaccaaacccggccatagtacagatttttaagatgaaggatcactagtt

SEQ ID NO: 3034 - DNA, 573 bp, Homo sapiens
  CDS 295..477
gactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggat

SEQ ID NO: 3035 - DNA, 522 bp, Homo sapiens
  CDS 219..446
gtaaggcccaagatggctgtcttcgccttagtactcgtgtgaagttgaaggggggagactagagaaatggcagggaactcttaaccgcgcaggtaggcgcctgtgggactgggtgcctctggcgtgcagaagcttctctcttggtgtgcctagatatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtga

SEQ ID NO: 3036 - DNA, 375 bp, Homo sapiens
  CDS 56..340
accgctctgccagccccttgcttccgctagtgcgagggttttgcccttcgtaaagatggccgcggaggcttttggagccaactgggagcgcagtacgcgttttctggagcatgggcagaggagacaggaacaagcgtmsatccgtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgtttgagatttcacaggtcactattgtgggggatcatc

SEQ ID NO: 3037 - DNA, 462 bp, Homo sapiens
  CDS 67..366
tttattaactcacagggggctaatggtaggaagttttctacagttagttgttaagtgggcctctccatggagaagtggagggagcttatgttaccgcagctggcttcagagccaataactagagggcaagagggagctagtaggtccagcccagactcaagagaagaatttatgaaagggcgtgaataccaagaggcaggtcattgggggccatctcagaggctgcccaacacaggctactctttggcccccgatgattcatgttccttccaaatgcaaaatgccccgtcccaagatctccaaaagtcttatcccattataggattagctcagagttcagaaccttatcatctaaagttccaggtgtaggtaaggcttttgggtgtagttattttattacagctcctagcacacttctagtgkgtatactaatgcctcttctgtatagttcacttggaaata

SEQ ID NO: 3038 - DNA, 584 bp, Homo sapiens
  CDS 395..553
atatggaccacgcagcgagcccgggggtccaagcggcactcctggggtgcagagaatttgtgacagcctagagaacagaggaaatggttttgaaaaggcaaatggcagtgcctgaaccataaggcacaaggaatgagcccctcatcgtgagagtgcatgtgacaggagcaaaggaagcggcastcaggaaagacaaggtcactgttcttgctcccatgacggtagcacttgttagagcaactgagtgacgtgcataattctctccaaaggttggatacaatattgtgaagatgtccacactacccaaaatgatctacagattcaatgagatctctatcaaattttaactgtcatttcacttggcagaaatacaaaaaacatttctaaaacttatatggaatctaaagtgactctcaggagccaaacaaccttcaaaaaaagaaataatattggaggcatcacactccttgactttataatgtattacaagattacagtaaccaaactatttagtactgacataaaggcagacacacagacaaatggaacagaatagagcacagaaataaactgtcatatatatg

SEQ ID NO: 3039 - DNA, 483 bp, Homo sapiens
  CDS 226..432
agttcagattaggcatttccggcccagggggcttggctccccgcggcacgggatttagcgttcgcgctccttcccttcccgtggtcgagccgagtcctgacctgagggctgcatcaagatcttgtcattccacatcgtgtttcctttgaggatgtggctgtacccctctcccaggaggagtgggactgtctgatccctgctcagaggggcctctacaaggatgtgatgatggggacctatgggaacctactctcattagtaggtgaatggttaagcaaactgtggtacatccataccatgggatacgactcaacaatcaaaaggaactgcccagacttcaccacgatgcaatatatgcatgacttcaagcttccaaacctgatgtcatctccaggctggagcggggggacgaaccatagacccctcacatcctgagaactcaggggagctggagctggaggcacaagagagaagagacggggt

SEQ ID NO: 3040 - DNA, 409 bp, Homo sapiens
  CDS 204..365
attttccggcccagggggttggctccccgcggcacgggatttagcgttcgcgctccttcccttcccgtggtcgagccgacaccagagcctggtccgctgttctcagctgtttgccgtctgcgcaggacctcataggtgggcctgggaaaacgcagtccattgtctctcctggccaagtgcactgccacagtcctggctttcacatggtggcctcaggatgctgtcatcccaggggcctcaggaaggcctctcttgagacatggagaggtcctgacctgagggctgcatcaagatcttgtcattccacatcgtggtttcctttgaggatgtggctgtacccctctcccaggaggagtgggactgtctgatccctgctcagaggggcctctacaaggatgtgatgatgggg

SEQ ID NO: 3041 - DNA, 524 bp, Homo sapiens
  CDS 180..389
gagagggatgggcgtggctaatatgaaagctgcatctttactagttagctaccatgcgtcattatttatcaaaagatatatgctgcttaaacacaaatacgttttaaaatatattttaggcagtagggttttgggtttttttttttgcaagttcttttggtgagtaaatttagtgataaatgatttttttttcttttgagacagtttgctctgtcgcccaggatggagtgcagtgcagtggcgcgatcctgcaacctccgcctctcgagttcaagcgattctcctgcctcagcctcccgagtrgctgggattacagacgcgcgccaccccacccagatgatctttttaaatgcaaaatgccatcgacgcagaaaatcaaagaatcagcttaagttccagaaaaaagaaaaaccamccaaatgaacaataagacaacaacaacaacaacaaaaaaggccttttgggattttggatgatattgcatcaaatccatacattaacctgagagacgagcgacttcttca

SEQ ID NO: 3042 - DNA, 504 bp, Homo sapiens
  CDS 209..475
gattaggtcttagtcttttggcgagcctgtgacctggactgtgaactttcagtgctgctctttttttccccctccttaggtggtacagggcagccttccaacatgtgaaaaactagaggacccttgagctgggtatttttttccccaggcagataagactctgataaaacctcaaggtttctgctcatggatctctgcttcagacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagccaaccaacaacagtttggaagaaaataaatctttaaaggaacagaaaaaactga

SEQ ID NO: 3043 - DNA, 486 bp, Homo sapiens
  CDS 90..278
aaaagagaagtataagactaggtctttatatttgtaagttacttacactctagatatcaaacgaaatgtaacacacatgaagtgcttcaatgctgaataggttggtacaaactcaagtgcgtgaggaacgcmagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaaaaaaaaaaattssgraaars

SEQ ID NO: 3044 - DNA, 491 bp, Homo sapiens
  CDS 141..326
cctgagaaattttgctacagcagttctaaaaggcagagagagcatcttatattttctgtattctgataatttgaaatctgaagtcttgttgaacctggagggtctgcccctcccagagttagccaactcctagagacattatgctttcaaatcatacttgcccacagtgtgcttttcaaagcaaccaattcagagtccacacctcaaccacctcctttatcaggccttcatactacgggaccctatccactcaccctaatcacccaagtaccatgcaatcagggatattccctggactccagcacctgctaaaattattcgaattttagccaatcaatttagaggtttattttgttaaagttaagaaaagtggccaatgacacagcctcaggaggtccagcttaattttatgcattttagggagacagaagttacaagcaaagacataaatcaatgcatgtaagctatacattggttcacggggcacggtg

SEQ ID NO: 3045 - DNA, 519 bp, Homo sapiens
  CDS 88..273
aagtttccttccaccactctaggccagcagtgacataattcaaaagcgcaagtcattgaaagcagttctgcgaatatgtagcttttgatgatcaggagtaaatttagagtacccagaatattgcatgttctgtctgcccatagtcaggcttctgataagaatttcacagcagaaaactctgaggttgtagtctctagtaggacagatgtgtcgccaatgaagagtgatctgctcttaccaccatctaaaccgggatgcaacaacgttctcaattgaagatcagggagccagtcaggaaatgtacctgaggtatgctgaggaagaccgtgcaggatggcatagtcaatccaacaataagaaaagatttgaaaasbggaccgaaattctactgctgtccaattgaaggctgccccagaggccctgagagaccgttttctcagttttctctcgtaaaacagcactttatgaaaatgcatgctgagaagaagcacaaatgtagtaagtgcagcaattcgtacg

SEQ ID NO: 3046 - DNA, 477 bp, Homo sapiens
  CDS 75..236
ccattttccctttttgttgaatttcagagtaagttgcagacatctgttcactttctcctcagtctttcacattcatgtcagtatttgtttttttttctttcagggtaaaattcacaaacaatgaaatgcagaggtgtcaagtgtactctttggtgagtctgagaagtacactcactaatgtgacccaaacccctttcaagatagagaacatggccaggcgcggtggctcacgcctgtaatcccagcacttcgggaggccaagggcagatcacctgaagtcaagagttcaagaccagcctggccaacatggtgaaacccatctctactaaagatagaaaaaattagccaggcgtgatggcaggcacctgtaatcccagctacctcctgaatcggagaatcacttgaacccaggaggcagaggttgcagtgagccgaaatcgtgccactgcactccagcctgactgtgggcaaaacagc

SEQ ID NO: 3047 - DNA, 691 bp, Homo sapiens
  CDS 136..354
ataaacttgctacttccgggccatctgcatgcagtgtatgacctgtgtctggtactagatgacaagaatgtacgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgcgactcttctttttaaaaggaaactatgtggaggacgatgcaaaaacatatttatcttagtttgctctgctgtagttctgttatttatacttggtgttgcttgtcatggacaccggtgaaacatgccgtaaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccaaaaaaaaaaaaaaaaag

SEQ ID NO: 3048 - DNA, 465 bp, Homo sapiens
  CDS 177..359
actcactccctccccaacccacacgccatcaacctccagaccctctcgccgtggcttagaggtgtctctgacaacgtggcacactgggaaggccttctttcctgctaccaatacaaatgcattctgaatttgatatgtcattaaatgtaaaaatacagccaatttgaaacaagcaaatggaaattcccaggaaccaaaaacagaaagaaaaatcagagctgccgcagtgctgtccctgcagacagaatttgggagaggtactcagagtcacctcctgtgagcctatgcaagccagcttctgcacaaccctggttttagtccagccttctgcagaattccacattaaacaggatgaagaataggttgttagcagactgaggtacttggggcaacatttcgtacacaacaggagggagaaacgactccagatccagcaacaatggctaagtcaaacagtggctgcag

SEQ ID NO: 3049 - DNA, 563 bp, Homo sapiens
  CDS 38..262
agcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaaccagctcgaatatatggatgtgggatctttagctctgtatgaaaaagctgatatcaaggggcctgaagacaagaagaaacacctcctttattggtgtgtcctcagatcgaggactgtgtggtgctattcattcctccattkkvtaaacagatgaaaagcggaggttgctacactaacagcagctgggaaagaagttadmgcttgttggaattggttgacaaaatcagagggcatacttttataggactcattctgaccagtttctggtgggcattcaagagtgg

SEQ ID NO: 3050 - DNA, 515 bp, Homo sapiens
  CDS 183..455
  misc_feature 141: n=a, g, c or t
aaatgaakaraggcatgacactgagattgaaggctagttctacttcagaaccacagagacatgagcaccagcaagtttgaggttggataaggatcttcagaactcctcagcttcagatggtcaagcactgcttchtccmwncttcaacggcatctctagcatgaagaggcacaacagagtccatgccttcacctcctctggccaactctaatcatgaatctcctgtgaatcagctgggaaacatgcagaatatgagattggggccctcattcatactaactggaattttccttggcaatggtagaacagaagcttctccattctttacagatgaatttgctttaagtaagatcttcccagagtacaaaagaaatttattcggaaaatttcaaactaatatcctttgcaaggtgagctacacctctgagaggagctcctggaaattaccagatacttaatgttgscagctgttacagatggaggtgatgcaccttgatgatgcataagtactgagc

SEQ ID NO: 3051 - DNA, 642 bp, Homo sapiens
  CDS 183..461
aaatgaataaaggcatgacactgagattgaaggctagttctacttcagaaccacagagacatgagcaccagcaagtttgaggttggataaggatcttcagaactcctcagcttcagatggtcaagcactgcttcctcccttcttcaacggcatctctagcatgaagaggcacaacagagtccatgccttcacctcctctggccaactctaatcatgaatctcctgtgaatcagctgggaaacatgcagaatatgagattgggggcctcattcatactaactggaattttccttggcaatggtagaacagaagcttctccattctttacagatgaatttgctttaagtaagatcttcccagagtacaaaagaaatttattcggaaaatttcaaactaatatggccttctcactggaactggatccaccatcccttttgctcagtgtcgtcttgtttatgttttagatcctttgcaaggtgagctacacctctgagaggagctcctggaaattaccagatacttaatgttgccagctgttacagatggaggtgatgcaccttgatgatgcataagtactgagcctgaatcctacaaatgggaaaaggtgctcatatcagacttatgcattagatatcaactaca

SEQ ID NO: 3052 - DNA, 751 bp, Homo sapiens
  CDS 104..562
ttctagggtttctccactccgaatgatcgtgtctctagccaaaaatatttattgacctggttggtctcttggcttcctctctttgtccaacgtagaagagacaatggaacccctctaccaggctgggtccattctcatgacggtgaataccctacaggggaaaaaaatgatagagagtggcctccagtctggagacttttccctgtcccagtcatggccctcctgcctcccaccacccgctgacttggagatcctgcagcagaaggtggccggggtgcaacgggaactggaggactttaagaaagaagcattgaagtccattcattaccttgaagacgccttctgcgagatgaatggagccctggtgcaacaggaggagcaggcggctcgcgtgaggcagcggctaagggaggaggaggaccgtggcatcgtgcgcaacaaggttctcaccttcctgttgccgcgcgagaaacagctccgggagcactgcaagcggctggaggacctgctgctggacaggggacgtgacgccctgcgtgccaccaagaagagccaggctgactgaacctcgtgggtggcactagccaagcaccaagttgaagattttttttaacggaaggagaaaccccaagtccctacccccttgctttcccttcctcatttccattgctttccttctgcctaaataacaccttgctgagaggcaaaaaaaaaaaaaaaaaaaaaaaataaaaaaaaaaaaaaatgcgaa

SEQ ID NO: 3053 - DNA, 787 bp, Homo sapiens
  CDS 147..782
aacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagcctcatttggtaagtcttccagaataaaa

SEQ ID NO: 3054 - DNA, 486 bp, Homo sapiens
  CDS 257..418
attatctcagctccttccccagcagactaacataaaagaaaactaaacatgcttatgctacagcactacaaatatttctctactggctcccattttctacagggataaattgacttcagttagtcattatggtcagtatgctatatagtatggcctctttgaagattcttttatcctgtgaaaagcaggaagaaaccctacacacaatgattttatacattactgcatgaacacagcgttttaaccatgaggaataatgcactttaagattcatcagccttgtattagtaaactttcaggctggctgagaactttacatggattctctcctgaacccaagagctgtccctcagatgaatcctggtccgtggtgcattccctcagtggtaagaagatgatatttacaccttgcatggaatagagaatttactaaatggaaaaagacaactcattggatagcctgtacactcccacagactggccaaa

SEQ ID NO: 3055 - DNA, 561 bp, Homo sapiens
  CDS 53..367
  misc_feature 192,198..199,395: n=a, g, c or t
cattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtccacctctgtatgatgatgtgaaagtgcagtttttcttctncgahannwccctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatncgattaagtatagctcccccttccccttctgggaaagaattatgttctttccaaccctgccacatgttcatatatcctaaatctatcctaaatgttccttgaagtatttatttatgtttatatatgtttatatatgktcttcataaatctattacatatatatagr

SEQ ID NO: 3056 - DNA, 503 bp, Homo sapiens
  CDS 118..273
ctcatttttctactgctcgtggatttacgcgcacgttggaaccgaagagagctctgttgttgcaatgttcagcccacaagagcttactggtgaaggaatgggamragacccatcyttatgcaaagccagcgttacagtaatgttmcagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctgaaccaccagtgatgaatt

SEQ ID NO: 3057 - DNA, 468 bp, Homo sapiens
  CDS 261..446
  misc_feature 446: n=a, g, c or t
gttgatgtgaatgttctttatgttctacataataccagtcacatgtaggtaaatgataacttaaaatgtggcaaatgtaacaggagcttctgcttccacccaagatgaataaattgggacaagaattgtcctcatgctataaacaactagaaaaatgaaaaaaaaatgtatgaaacaacagttccagatgttggagaaaggacagaggaggatatgctgccagagaaaaggtattctccaagcttggcagctcaaatgaaatgkgtcagcaggacaataatggcaacgtaggaccattaacaaacagagtcaaacaaatagcaatagcttttcaataccatcaaaacatatttaataactcctcatcaaaggacttattatgtagtaatagcctcacaagaacatcaccttcaaatactgaggataacaatgaaatgttttcccantaaaagaacactgaaattaaaa

SEQ ID NO: 3058 - DNA, 558 bp, Homo sapiens
  CDS 140..403
atattctatactggcaagttctagaccgtttgggcagactctcatctcttactgtataaagagtggagagatccttggaatgaagataaccaagatgacacattgaaaaaaatggcagatctttcccttggactgtaccatgtttaaaatgttgattccttcttgggatcgaaaattaggaagtctgtcttggtgccaccaaacctcaggtacgcaggagacaagcctctggccaaggatttcattctcatcatccaggctggagtacgatggcgtgatctcaggccattgcagcctccacctcctgggctctagcaattcgcccacttcaccctcccaaagtgttgggattataggcgtgaaccaccacacctgggcaaattgccagtacctcttaatatcctaggaattaaagatctgatctaaaatttaaagttttaagatgtgctcatgcttaattaaatatgtataatgctatgtaaaattttcaaagtatttctttatgcttaggaaataaactaaaagatagaaattgaaaaaaaaaaaaaaatgsgaaaa

SEQ ID NO: 3059 - DNA, 481 bp, Homo sapiens
  CDS 229..444
aacatagatgtaaccgatccagagtcctgcagccgggtaacaggggagtgccttcgatgtttgcacaacactcagggcgcaaactgccagctctgcaaaccaggtcactatggatcagccctcaatcagacctgcagaacttacaggccagtgtccgtgtaaattaggttacggcgggaaacgttgcagtgagtgccaggaaaattattatggtgatccacctgggcgatgcattcaagacaaatcatgcagctaaatgaacaactgaaagcagtgtatgaatttcaagatctgaaagatacaatagaaagagcaaagaatgaagcagacctcttacttgaagaccttcaggaagaaattgatttgcaatccagtgtccttaatgcaagcattgcgggactcctcagaaaacatcaagaaatattatcacatatcatcatctgctgaaaagaaaattaatgaaactagttcaccattaata

SEQ ID NO: 3060 - DNA, 494 bp, Homo sapiens
  CDS 188..391
aacttctcccatgtagttcctgagtgcaggactctcctgaagaaggggcgtctaaaaggccagcccatgcatcttgttcagaccaggctgctccatctccgctaagcccagggatccacttgtgtgtctttctgggataattgtctttagtggcagcctgggcctcggggaaggaagggcatgaggaatggccccggctgggatgtcaggggcccaggacaactcctgtctctaccaggaaattgccccctcttttcagaggctgccttgtcctaggtatctgatgtcctgcccttggcagttttcaactccagatgtaggtctgactcctattaggctaccatttctttgtgggaagacagaacctcgtcgcgacatttctcagaagccatgacatgtccctgcggctggaggctttcaagggtggcccaggaggctcaagggcccggtgtggcctgcaaaggaagagaacagctgttctcacggaaggatcc

SEQ ID NO: 3061 - DNA, 523 bp, Homo sapiens
  CDS 135..341
acagggttccgagcatgtgctggcagttgctctttggagcacccacttcacttctcccatgtagttcctgagtgcaggactctcctgaagaaggggcgtctaaaagaacctcgtcgcgacatttctcagaagccatgacatgtccctgcggctggaggctttcaagggtggcccaggaggctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgctggtcctgatttttcaatagtgtccctaccctgaagctcttccattggtcatcatggagttagctaacagcccagggaactggtctcttttcccttttcccttaccacctggaactcacctggaaagggcaatcagctggctctatatcagacgccaccacctggtctttgaagtttctgtcctacsagtgccacagct

SEQ ID NO: 3062 - DNA, 537 bp, Homo sapiens
  CDS 149..355
  misc_feature 413: n=a, g, c or t
acttctcccatgtagttcctgagtgcaggactctcctgaagaaggggcttctaaaaggccagcccatgcatcttgttcagaccaggctgctccatctccgctaagcccagggatccacttaacctcgtcgcgacatttctcagaagccatgacatgtccctgcggctggaggctttcaagggtggcccaggaggcctcaagggccggtgtggcctgcaaaggaagagaacagctgttctcacggaaggatccaaagggttcaaaggcgaagggtgccatctgcttccccactgattcagaagataaacaggagaagtgtcctgtttcacscatattgctggtcctgatttttcaatagtgtccctaccctgaagctcttccattggtcatcatggagttagctaacagcccanggaactggtctcttttcccttttcccttaccacctggaactcacctggaaaaggcaatcagctggctctatatcagacgccaccaccttgtctttaaagtttctgtcctaccagtgccacagct

SEQ ID NO: 3063 - DNA, 470 bp, Homo sapiens
  CDS 116..286
ttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaag

SEQ ID NO: 3064 - DNA, 519 bp, Homo sapiens
  CDS 93..431
ccagggccagcgggcttcaggagggggacgcgcctgtcccgggctccaggctacgggcaagaccacagggctcctgacctttttcggcatatatgtcaccagagctatctggaatacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaataggggccatggtgctcccccaggggtcctggcccccgccagcagcaggcaggtgcmaggctgggtgctgctcagtcccccttcaatgacctcaaccggcagctggtgaacatgggctttccgcagtggcatctcggcaaccatgctgtggagccggtgacctccatcctgctcctcttcctgctcatgatgct

SEQ ID NO: 3065 - DNA, 494 bp, Homo sapiens
  CDS 20..382
acttaaggttgtcacttctatgcctaatgattatctcattggttccaggacattgttaccatttacctccactggatatctattttctttcaaaaagcacaatcaacgtgccttttccctgattttctctgccaaacatatcagattgtgggaggtttatggatacacagtacttcacaggcaacctgaaagtcccaatttgggccccgagtctgctggagaaaagagaaaggctaagaagcagcctaccttacctgtggctctgggtctgaggatggccaggagaacagagagcaaagcagagccaatgcaagacctctggccctggaagccgaaggtctctcacaggtcaacgcaggatctactccatcatcatcttcactagcacacccagttcgattgaggagccttgacgtgggatattgatgggatattgagagaaaagagaaatggtgaatcaagcactaatctcaaagcttctgcacagaactact

SEQ ID NO: 3066 - DNA, 456 bp, Homo sapiens
  CDS 171..380
agttagtagttggtcccagtcagtaacactctgggagggctcaggccacatcaygaaatgtgacaggatagccttgaactcatcaattgctgggggcacctcaaactcaactccaaaattgatctaatgaactttcccaaaccacattcccttcttgcatttctgagagaatggattcccattcatctgactacagtgctaccctgaaagcagatccagagactaagattcacctgcaggtgattcatttgcaaggtaagctgtcatcagttggaggtaagcrgaagacagtagagagtacagagccctggactgtgactcagaggatgagcaccagatccagtttgctgtgccacagtgtcctgaagattttcctcagataatctttcatctctttgttcctgagactatatattagaggattacagagtggtgttatcacagaatagaacaagt

SEQ ID NO: 3067 - DNA, 561 bp, Homo sapiens
  CDS 222..392
taaaaactttaatgggtaactagtagacagtaacactctgggagggctcaaaccacataaccaaatgtgccaagataatcctgagctcactattgtcagtcctgaagattttcctcagataatctttcatctctttgttcctgagactatatattagaggattacagagtggtgttatcacagaatagaacaagtggatttttatctgagatctacaacttatgaagaatacaaatgatgtatattcttttatactcttcatgtatggactagaggggcttgcacataagaaaaaaatggctgagacccacaggaacaaagaaacaggacaggagttagatgcagagaagagatttcaacaaaagtttggaaaagatgctaacggtagcatatgagtcacagacagaacattggcacctttgtttaagaaactgaatgttaatgtcacatctgcctttggagattacaaatgaaatggctacctttctactggraccctgaccagaagcctgccagttagtaagctggcttaagagatcaatctaaaatttacataaggct

SEQ ID NO: 3068 - DNA, 463 bp, Homo sapiens
  CDS 23..259
  misc_feature 445: n=a, g, c or t
gggttcccgttccccgcggascatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagabscccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccangttccagctgagtggctt

SEQ ID NO: 3069 - DNA, 513 bp, Homo sapiens
  CDS 112..282
tttgcagccttgacctcctgtgctcaagcaatcctcctgcctcagcctccagagtagctgagactacaagcacccaccaccgcgcctggataatttttaaactttttagagatggtatctcactgtgttacccaggctggcctcaaacccctggctccaagcaatcttcctgcctcagcctcccaaagtgctgggattacaggtatgagccaccatgcttcgccttgtgagctaatttgcaagaatggaacaatgaagactcctagacctactcacctgccttaaagatatgctattgtcccccagagaggtggcaaaatggtttgtatttttgtcttaagccttggacttttaaaatcctggattttgatgtgtgtgcagaagagaactaagatagcgtgcttgagaccgctctcctttaaaaggcctgcttgcaagagtagcctctgactggcatctgggaacttggatcttgagagagttgccaccattctctaactttgctgtgctgct

SEQ ID NO: 3070 - DNA, 484 bp, Homo sapiens
  CDS 121..417
agttagctgccttggggaggggaggaagaccaccagagcccagggtgggggcgaggcggctcccggagctcccctgcccctcccagtcctcacctcctcctccctgagtggcctggtgggatggaaggtgtctgtggccggctgcccagaacaccaagaagggccctcttcctccttgaacttgagccagcccctggcgtctttctcggggccagagctttgcctctaaatggtctttgtttgcagacgatctgctgtgcagatcatgaaccgtcgccgcagtgccagacagactcttcatccggaccggccgtcccactgggtcccctcaggaaagcgcagaagccggggaccccaaaccgygtccagctcctcccaaccgcccttctcggagccgcgcacttggtamcttgcgtgtgaagaactcacsgccgtgttgccaggaaactgcggggagcagcctttgtggtctcacatatgcgta

SEQ ID NO: 3071 - DNA, 473 bp, Homo sapiens
  CDS 69..422
gttgggcggccggtagctgttgctgttgggggacccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaacaaaatttgttaacccagaagatgttgccagactgatatttaggtaaaatgaaaagaaacggcacattctgtattggggctcag

SEQ ID NO: 3072 - DNA, 452 bp, Homo sapiens
  CDS 16..240
acactggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagsagccatgaggcccgtgtgtttcgaagcattcccccagaggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggaca

SEQ ID NO: 3073 - DNA, 506 bp, Homo sapiens
  CDS 81..392
aaagtagattttaaaaggtatgtcatcaccaacccgccctatgagtttgagctcggccgacggacctgatcttctgcttaatgcagtttgaccacaatgccggccagtcccgggccagcctgtcccattcctcccactcgtcgcagtcctccagcaaagaaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaaga

SEQ ID NO: 3074 - DNA, 484 bp, Homo sapiens
  CDS 94..345
agttacaagctgaaccactagcgtctgaaccctatacatctgaagccgggatgaaattcaggagttctattcccccttctccttttaattgtcatggtggtgtctttcgaccctagcagagaatatgtggtcgatattagaatcacctggggagattttacaaagcatctatgcttgggtttctttggagccaatagaaaaaaaaatgaagaactgtgtacaatggtgactaaagagcctcagcatgacttccgcccctcagcgccatctataacctgttttaccatgtcggatcccgtctggagaagcccaccgagtgcaggtgaaccagggaggcgaagtccatagaaacagctgtcttgggggtccgggaagagtttaacactggaatcacatctgcggaaaccgggaactggaagcaaattgaggatgcggccagaagggaaaatcaagtttttcaagcaatgaggttcggccttggctt

SEQ ID NO: 3075 - DNA, 459 bp, Homo sapiens
  CDS 240..410
agtcatgaaatgtgttcagggaatttccattaggatcacttcactcctgtctccaaagtggtgaaaaatgggaaagctggaggtgagatggagacatatcatggtttataagaataatactgtgcttctgtaaagtgtcggccaggcacagtggctcacacctataatcccagcactttgggaggccgaggcaagtggattgctttgagccccagagttcaagaccagcctggggcaacatgacaaaatcccatctttacaaaaaatatttgaaaattagctgggcatggtggcttgagcctgtagttagagctactcaggaggctgagtgggaaaatcacttgagcctgggaggcgaaggttgcagtgagccgaaattgtgccactgcactccagcctgggctacagaatgagaccctatctcaaaacaataacaraaacacaataaaacagtgttac

SEQ ID NO: 3076 - DNA, 500 bp, Homo sapiens
  CDS 34..204
ttccatggctaacaaaccctggcccctttacatatgagctctggaggttcgcctggctgcctcaggcttgcagaaggctgccccaatcacagagcctgggtaaggtggaacaagaggcagccccactcggcttttctgattgcatcccacctgtttctgagtgtgttggtttggtttaattcttttagggttggakttggaaagtgaaaaccctagacacttgctgtggaatgtttgcctggttgtattggtgtgtccctcttcttcactggcatgtcgctttcaagtgtaccaaaggacattttgttctgttgaaagccacaggaccaaaaggaaaatattgcaactatttgcaaacatacttccctacctatacaagcagccatatactaaaaagcactaaacaagcacaaatgaacactaaatagccttataccaaaaagcattcttgtaactgtcagggcatggtatgaattccttcctctttaagcagcaactta

SEQ ID NO: 3077 - DNA, 495 bp, Homo sapiens
  CDS 109..285
agtcatagatgtgctttttttaaaatcctggtttttttaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctga

SEQ ID NO: 3078 - DNA, 419 bp, Homo sapiens
  CDS 57..299
  misc_feature 239..242: n=a, g, c or t
gaggggtggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccmcacaacawrgaaacvgwrhvnnnnartgatrtgctcttccvvgctgtgaagcacacatcatccccttcaycctggatgaaataggcgccgayatkgaggacagacacatkgtggtgtcctgcgcggccggcgtcaccatsagctccattgagaagaagctgtcagcgtktcggcmagsccccagggtcatccgctgcatgw

SEQ ID NO: 3079 - DNA, 456 bp, Homo sapiens
  CDS 22..231
ttagaaaaggtaaaacaagaaatggaagaaaagggcagcagcatgactgatggtgctcctttggtgaagattaaacagagcttaacaaaactgaagcaagaaactgtagagatggacattagaattggcattgtggaacacacactactccaatcaaagctgaaggagaagtccaacatgactaggaacatgcatgccacagttattccagaaccagcaacaggcttttattaaaacatactggttttcatgtttctgattagttgggttttttatatcaaactatatttcatgktgcatagattycaaamcataattttatgttcaatgggtatttttttacatatacatactcacatattatatcatggtgattatgatggttaaagcctttacactgaatgtaatgtttaataaagaaattacaaattctcactttctaaaaaaaaaaaaaaw

SEQ ID NO: 3080 - DNA, 500 bp, Homo sapiens
  CDS 279..428
  misc_feature 473: n=a, g, c or t
aattcaataattcaatagagtctccatacctgcactgtcttaggtgcagggagataccatgataaaagggcagacaatgttgctgccctcaaggagctgacattctagtggaggaagacagatgcaaaaaggaatgtatgcccacatcacacaactaaattgtvvcatgatggagttcaacaaaatatggatacagagagcaaggtttgagggtaaatttaaccaagaaaagaacagagaaagatccagtgcaaaaactcataggaaatgrtcrattcatgccvagtgatkgaggactagrggaggagaggwtrrgagcattggttcatacacgatggtctaggtctcctaccccaagagaacttgcaacaaagcccaaagtacaacagccacgtttaaagagaagattccatttcagccagacaacatgattcatcatatttatttaatattgttaatttgaattttatwanrtctgtactgatgtttgtatttaattt

SEQ ID NO: 3081 - DNA, 566 bp, Homo sapiens
  CDS 105..299
gccaccctcagaggcgagctgtggaagccttgactcttagggccgttttagaacccgggcctcggaccggcggggtttctgcacgtggaaccggaacatctgagatgatcgcaggccctgtggagtgtggggagcgcgggggttctttcttccctcgaggcccgtgccagggcttactccaaagccagtgggtccccagtcctaagccaagcagtcccgggggaaaacgcttctcatcgccgtgggagcgcggatcdtggaagtggctctgggctttcttgggcgaggctctcacagagtagatcggaaatccattctgctggcccgccccacctcggaggacggactaacggacctgagttcccggccctatcttactcttctcagcttctcagcttggctcagctcagaggaagaggaatcactgaagtctcagagaagtctccactcatcccttcctcaccttcacatcagccttttctttccttctagaagtcatcactgactcaaggatataagtttgatgactgtcttttccactggtgtgacacgatctctgtcgacag

SEQ ID NO: 3082 - DNA, 529 bp, Homo sapiens
  CDS 56..277
ttcctgaggatgtatttatatgagatgtatgtgttcttaatagagaaatagtggtatgcatgtgtatcttctaattattcagttgtcatgctgtcaaaatagtagtgatagtatcattgcatgtcgtacccaagatggtcactatagttttcaatttgtgttattttcatttctttataagtgttataccatgagctcagctcctaaatttggctggctttgtttttcatttgctttagaacttatgtggcatgacatagctcgattgtatgagatttaacacttattatgaaacaaatcttgaaatttgttttcactggtagagctgatctagatttgatgagcagattgagagacgcttctattggagcaattcttgtaattaaccagaggtatctagttgttgtataagtgcactgagttagatcttaaaagtttgatcaatcattccaaaccatttcaaatatgaatattagaaagttcaacttagaagcttcccttttgtgttttcatgcattcaggtaaagtc

SEQ ID NO: 3083 - DNA, 463 bp, Homo sapiens
  CDS 249..434
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttccccattaaatggtcttggcattcttgtcaaaaatcargctkgaatttscaktggcatgatctcggctcattgcaacctccaccttccagattctcttgcctcagcctcccgagtagctgggattacaggtgtgcaccaccacgcccggctaacttttttatttttaacagggacggggtttcaccatgttggccaggctggtctcgaactcctgaccaacatggaggaaccccgtctctactaaaaatacaaaattagctgggcgtggtg

SEQ ID NO: 3084 - DNA, 528 bp, Homo sapiens
  CDS 214..453
aaataagatctatagaatggaactagaaggacttgcagatagcctattgtgggaccacaccttgtgatcatactcaagacgttataggaaatatcattcgaaactggaatttccagggatgtttacaacctactacagttccttgacaattagaaggacagttttctcctgagcgatgaagataaattcaaatgaggaaatagttttagaaacatgaactccacttccctccacccccaagaaaatgagcacatacttttcagtagtgattttgacaatgttatttattactctacagttgaagaaaatgaagcatatggtgtgcaaacacttttcaggtccatggatgtggatacaagaagtttttttgtgaaaaacatctcagttctatacttaaatgcctgcaaaacagctgctgccactgtacaatatgcaattcttggtggcatttggtagcttgaaaaaaaattggtactggatgtactactgatgtcataggaattaattatrctaccaaacagttgctga

SEQ ID NO: 3085 - DNA, 279 bp, Homo sapiens
  CDS 61..255
caagacacctgccgagcgtctgcggggagcttctgcgggggccgcttccaccctcagcggatgataatctcaagacaccttccgagcgtcagtcractccccttccaccctcagctccaccctcagcagatgataatatcaagacacctgccgagcgtctgcgggggccgcttccaccctcagcggatgataatctcaagacaccttccgagcgtcagtsactccccttcsaccctcagctcbavcctcagcasatgataatatcaagacacctgccga

SEQ ID NO: 3086 - DNA, 513 bp, Homo sapiens
  CDS 25..231
atcattgagaggaacaatcgccagatgctgccagtcattaggagtaccactggaggagactcagtgcagacctgcacaaacccactggacaccttcttcccctttgatccctgtgtgctgaagaggtcaaagaaattcattgatcctatttatcaggtatgggaagacatgagtgctgaagagctacaggagttcaagaaacccatgaaaaagttgttctggagaatcatgtagcgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttccgatggttgccggctcccctctcaggacaacccagatgtgcacaaagtgcgatggtaagaaca

SEQ ID NO: 3087 - DNA, 392 bp, Homo sapiens
  CDS 144..320
tttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggaaaaa

SEQ ID NO: 3088 - DNA, 398 bp, Homo sapiens
  CDS 144..320
tttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggaaaaaaaacaa

SEQ ID NO: 3089 - DNA, 402 bp, Homo sapiens
  CDS 144..320
tttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggaaaaaaaacaaaaaa

SEQ ID NO: 3090 - DNA, 406 bp, Homo sapiens
  CDS 144..320
tttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggaaaaaaaacaaaaaaacca

SEQ ID NO: 3091 - DNA, 400 bp, Homo sapiens
  CDS 144..320
tttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggaaaawaaacaaaa

SEQ ID NO: 3092 - DNA, 396 bp, Homo sapiens
  CDS 144..320
tttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggaaaaaaaac

SEQ ID NO: 3093 - DNA, 490 bp, Homo sapiens
  CDS 43..240
agtcccaggtttgaccgtttctcaaaccgtgccttcccatttatgctgcatccgcgccctgaatctgaaattggtcgtcctgccacgccgcctcaccgcggtataaggtcgtcccatcctgaatggccggtgcgcagactcaattgcgactttgaggctgtcagcgccacccggcaaccttccagtgaacaggattctgggtttctcaaagctgtaattggagggccactccagaggtgttaaagctccagcacttcgagcctgcctcgtgggaaagtcttaggctgagtctgtaggtgtctgcagttaagaagccagcggtctgcatatgattgctcaggggtggtggctkggtccaacagcattcactacaggcctkccttkaataccacctagcgcagtgctccgcatatcacaggtatkggaagctttkgattcataagctcagtaaattaaggaatttcacattatgaactcaatttgagatggg

SEQ ID NO: 3094 - DNA, 505 bp, Homo sapiens
  CDS 253..411
attatgaatgttttgctgaaggcagaaattaaccttttatggaagttttgtcccattaagtctagttacttgaatctggactgattttctttctgatgagaagacttttagccaatgttttaagtgcttgaaaaaaatgttctggtcttgactgcctgtgagagccttcctggtggaaacagaattgttagtcagctgtcatctccatggtgattttttaaggctaagtgctgaaccagatttcttttcattatgggagtgaaaatgaactcagcggattttctccccgattcctctccattttctgttttcagacttctccatcatgttcttgtgcctggcagtgttaaggggctactatttggttggaagaagcctttggaaaagttgttgaagagtcacgtgcacaagtgatgtgctgagcagactggatcttgcctgatggccagaaaattaaaacaacactgaaattaataaaaattcaaactcccaaaaaaaaaaaaaa

SEQ ID NO: 3095 - DNA, 552 bp, Homo sapiens
  CDS 213..410
gaacactggttctcaaagagggggatccccagctcaccagcatgtgttgtcacctaggaacttatttagtcaatgggaaccccttcaagttggctcttttgtctttttggcatgtcccatcatatttggagtcttaagaatttacatcttggttatctgctttcggcattccactctcctagcgacggcttcaccaccctgatgttcagctgatgttcagttctagagcaacccatttcctacctccaattgctgattctacctcattgaggacaaaggaaccagatacttcgttcaatccagagacacttcaaccttacagcagtgcaaagataccaaagacaagctgcctgggttcaaatactcttttcaccaccattaactcattgttttgctttgtctatgtaatttaacctctttatgcctcattttcttaggtataaaatgggattaatagtacaacagaagattgttgttgtaaggactaaatcagctaatacttatataatgttcagaacaatgcccagcattacagatatattacttctgtgt

SEQ ID NO: 3096 - DNA, 508 bp, Homo sapiens
  CDS 17..484
gggtggttgtgagctgatggagactgtaaatgaaccagaaacaggtgaagtgagcaaagatgcagtcattgtaaagcaggagaaaaataatgaatattgccttcaggatattgatgataaattgtcagaatcagcagaggatgatggtgaagatgataccaatgatgaagatgatgatgaagatagtaaccctaaaaagaatactcaggccccactagagttaatggcagaatttctgagagcagaaatggcccgagagtaccagctggcaaaaaaattatgtcagatgatcctaatctatgaaccagaaaatcctgaggccaaggagtttttcacacttattgaagaaatgttgctgatggagaaaactcagaatcatgagcaagacggtgaaaacagtgatgaagacagcagtggtgagagtaaaggagaaagcgatgaggagctgagtgacgagagctctgacgaaggtgaagatggatcatgagtgttgctgcaatacttgaag

SEQ ID NO: 3097 - DNA, 476 bp, Homo sapiens
  CDS 208..423
atattgtctgtgtgagcagaggggagagcggccgccgccgtggccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaggggaaatcaagatgactaccagctggttcgaaaattaggccgaggtaaatacagtgaagtatttgaagccatcaacatcacaaataatgaaaaagttgttgttaaaattctcaaggtgagtacaagagataatttcagaggtatttggaatatagatttttaawagtagttttgaagacttttttaaaacagcatttaaaaggtttttggtgc

SEQ ID NO: 3098 - DNA, 405 bp, Homo sapiens
  CDS 184..360
  misc_feature 48: n=a, g, c or t
ataaggaggaagcgggtagtcgaccgtgtccgcgcgcsttggagacgnkgcctcggcccggacgcgcccgcgcccccgcgctggagggtggtcgccactgggacactgtgaaccaggagtgagtcggagctgccgcgctgcccaggccatggactgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattg

SEQ ID NO: 3099 - DNA, 533 bp, Homo sapiens
  CDS 159..431
atgctgggaaggcgtccgcgcggcgccattttgtcttgtcggctcctgtgtgtaggagggatttcggcctgagagcgggccgaggagattggcgacggtgtscgtgttttcgttggcgggtgcctgggctggtgggaacagccgcccgaagaagcaccatgatttcggccgcgcagttgttggatgagttaatgggccgggaccgaaacctagccccggacgagaagcgcasaacgtgcggtgggaccacgagagcgtttgtaaatattatctctgtggtttttgtcctgcggaattgttcacaaatacacgttctgatcttgatgtatttggaagaggagataacattagagatgtcagcaaatttttggaagatgacaagtggatggaggagtagcagcaaacgcaacagagcagagcaacctgtaccctaaaagcctgcagaaggggatactaaacagaagcgagtgtttgatcagcagaaccctggacaggctcaggatttggaggcaccaggtccgtgtgaaaaaatt

SEQ ID NO: 3100 - DNA, 398 bp, Homo sapiens
  CDS 135..362
  misc_feature 77,80: n=a, g, c or t
attttgtcttgtcggctcctgtgtgtaggagggatttcggcctgagagcgggccgaggagattggcgacggtgtcgnrgntgttttcgttggcgggtgcctgggctggtgggaacagccgcccgaagaagcaccatgatttcggccgcgcagttgttggatgagttaatgggccgggaccgaaacctagccccggacgagaagcgcasaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagatttttgcgatactt

SEQ ID NO: 3101 - DNA, 501 bp, Homo sapiens
  CDS 209..373
  misc_feature 501: n=a, g, c or t
agttgcttatgcttttagctctgcaagatgcgttctccagaagcacctacggcaaattaactcaacactcgaattggggtttgtaaatattatctctgtggtttttgtcctgcggaattgttcacaaatacacgttctgatcttggtccgtgtgaaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcaamcaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtcn

SEQ ID NO: 3102 - DNA, 450 bp, Homo sapiens
  CDS 96..425
aatcggagtggactcggacttgaatcsgattgccccggaatccaccctctctctgtgataagttataatattakgrbsactgtttttaatggaasatgattgaaagtgamaacctaaaccaagaagamataattaaagaactgtgtttgtgcaatggcttatcttaygagatggttggacaagaaggatcagatacatcaaagttggagatgtttttcttagggtatcctcgtatagttggattatcattatttcctaatttaacgagtcttaccattgttgctcaagatataaaagaaatttcagggttagagccttgtttacaacttaaagaactttggattgctgagtgctgcatagaggtaagtgtaaacataaaacctcacatgghgtattttattctgaattatttggctttagaaaaataattcattgamatatatgcataag

SEQ ID NO: 3103 - DNA, 490 bp, Homo sapiens
  CDS 337..486
aagtagatcctagaaaatggccccttttacagcagctcagagcagagccacaaaagcaattgattggtcttggcatttagtcttatatcagctgtgtcatccatagcttcaggagtgagaacactaatctaaagtgacatttctgttctggcgggcttttctgccctgatgaaagcaattacttcattcctaaatgataatttgcaggagtttcaaccactttaattgataatttttttttgttctgagttcaattgtgaagtgattagctgatttggtaaatagaaatttaaggtgtgaaatatacaagttgcttcaagaggctaacataaattaatgatgacagctatgagcagcgcattagttaagcagcagagttcttaccttgaacttgaaggttccagttttaacttccagcgtatactgtccagctttctttacaccttaaagaagatttctgaaattattatcttttttggagagcattaaa

SEQ ID NO: 3104 - DNA, 501 bp, Homo sapiens
  CDS 147..356
attgtgatcattatgaatcccttcagtcacattaggggggaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctaacttctctaggggtttcaaaagactcagttaattgatttccaggaagtactcatagcaagttcata

SEQ ID NO: 3105 - DNA, 482 bp, Homo sapiens
  CDS 231..410
cttctaagtattgattactctctacagattatggaaaatatttgtctgagctcttatttcaactgctccattctcagctagtgaggagagtaagatgtagtgaggcatgtgttcagaactttctcccagaggtaaattactgatgcatgacttttaaggtgctaggagagggctgatagtccactacgttatcaagttcaaagcctaagaaatattgaacatttccacacatgaatgtgggtactatgtttaatttgagaatggccaactgtcctcgaagtctcaatctctttggagcctaccagctccgagagaagtttgaggatgctgcaaaaccctcccctgcaaatccatctactcctcccacttctatcctaatgggtatagttcttggctgtgctgaggatctgtaaggcaccagatgtgaaagtaaggaagaaagatggatgtggaagaaagtcactcaagaataactaatcatt

SEQ ID NO: 3106 - DNA, 557 bp, Homo sapiens
  CDS 193..402
cttctaagtattgattactctctacagattatggaaaatatttgtctgagctgttatttcaactgctccattctcagctagtgaggagagtaagatgtagtgaggcatgtgttcagaactttctcccagaggtatagttcttggctgtgctgaggatctgtaaggcaccagatgtgaaagtaaggaagaaagatggatgtggaagaaagtcactgcccagagaataaggagacctggattctaatctcagctctgccattaactagctatgaaactatggctcaaaagggaataagagatcaaggcaagcatggacatcttgtacgtggaagtgcagaccagaacttgtatcacagccagtcatatccgaaaaagtggcatagagggaaaaagaggtcaaattaaacatcaaggtagctaaaaggaaaattgtgtccgctgctctaatatcacaatcccaaggagactgcagacatttgtctcgagtyctcaggttgccagtaatgatgttctggtgatctggctcagaargctgagctgatgagtgatcactcaga

SEQ ID NO: 3107 - DNA, 542 bp, Homo sapiens
  CDS 207..368
ccaccgctctgaggagtaattgtagcacttcacatgtgctgtggttgtgatcacatggtgacatacatagcatgtgtgttcccagctgttgtgtgtttatgtgacatttgatgccaatacatatgtcttcaaggtatgcttgttccctcccagctcgtggaatatcaaaaaaattcattgctggaaaaattatttcatagacaaaaatgttaatgttctcttggggacttagagttgaaaatatttgtatagatttggttctcaagtccacagaatcgtatctgctgtggtctccctttggtgctcatctgggagccatgtgtatggaagattctgtcacaggcggctgggatgtgggcagatgctgttagcctccctctccacgtggtggtccatgcctgacgtgtcccctagttcaaggaagcgccatctttagcatgaaaacaattgcgttcccctaggaaatgaagaaaaaatgagctgaaatttccctatacatttgaatttgttcattttttaaagagacatttttgttgtctgct

SEQ ID NO: 3108 - DNA, 451 bp, Homo sapiens
  CDS 137..286
tcattgaggtcaaaaggttttaaaatttgctttaatttaaaaaattatagcatcatccagctattctgactgcataatcaacacttckttctgktggtaaaggtactgtttaagagtaattcatggcagtgtgataatgccaaccaattcacagaagagagaaattgtaattagtaataagaatgtgggccgggcacagtggctcacgcctgtaatcccagcactttgggaggccagggtgggaggatcacttgagtccaggagttcaagaccaaccttggcaatatagggagatcctaccaaaaaaatacaataattagccagttgtggggttgcgcaccagtagtccctgctactaaggaagctgaggagggaagatcctttgagcccaggagattgaggctgcaatgagccatgattgtgccattgcactccaacctgggtgacagaa

SEQ ID NO: 3109 - DNA, 537 bp, Homo sapiens
  CDS 201..512
agggtgcagcagggggccctgtcagacatccttggggagcctgccctttcaagcatgaatcataccaccagagatcacccagcgtgctcttagctctgcctgcctggtgtagggtcctggagaccttcttggagctcatccagcagccatcatgcaaggtggtgctggggactgccctcttgctaggaggtggaggtctcatgctgtgggttcagagaaagaggagaagaaaggaaacctctgagtgtccatcagacaaggacaagtcaccagaatcccataaagcaaagaatgaaagctggattaaatcccactttagccgcctttccgaagagaagctggccctcgacaacaatgccagcgctagtggcaatgctacccagactgagagtgggagtgaagaggtcagctccacggttcacatagagaccttcaccacgaggcacggagaagtgggctccgctctgcaccgggaatccttcacagcaggcagaagacatctgggccctcagtgatccaagagatcaccaggagtct

SEQ ID NO: 3110 - DNA, 428 bp, Homo sapiens
  CDS 91..294
ttattttcactaaacttgacatattaaagtgctaatactctggaaataacgtaaattatcgttacatggttctttttagccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaaggtaaggagagtcagctgtggagggcagcctgggggtgataagaatgcactggatcagggtcccaccacaggawaggtactgcgttgtgttttcttgataacagctttatcaaaacataattgatatcccatacaattcacccaattaaagtgtaaattcagtggctttt

SEQ ID NO: 3111 - DNA, 491 bp, Homo sapiens
  CDS 261..455
aaaaagcggccgccgtarrgggtgaagatggctgcctctgcctttgctggtgcagtagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaagaagaagcgattgagggaatttgtattctgcataaaacccagagtaa

SEQ ID NO: 3112 - DNA, 480 bp, Homo sapiens
  CDS 36..287
ctttcgttccgtcttccatcgttttctctcgtgcaatggcgtccgggctggtaagattgctgcagcagggacatcgctgcctcctggctccagtcgcccccaagctggtccctccggttcggggagtgaagaagggattccgcgccgccttccgcttccagaaggagttagagcggcagsacttctgcggtgcccgccgccgcccgtgcgccgttcagagaagccgaactgggattaccatgcagaaatacaagcttttggacatcggttacaggaaaacttttccttagatcttctcaaaactgcatttgttaatagctgctatattaaaagtgaggaggccaaacgccaacaacttgggatagagaaagaagctgttcttctgaatcttaaaagtaatcaagaactatccgaacaagggacatctttttcacagacttgccttacacagttttcttgaagacgagtacccagacatgc

SEQ ID NO: 3113 - DNA, 451 bp, Homo sapiens
  CDS 60..293
gagtgtatttctaacaacatgtcattgcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaa

SEQ ID NO: 3114 - DNA, 525 bp, Homo sapiens
  CDS 68..265
tatttctgaatggagatttaattaattataacagcaatgcttgaacaatcattgccaaaataaataaatgccaccaagaacacaggccttccatgcaatttgcattgcattaacagatctcatttttatcatcagcaactttttactaagaaaccattgtgaacaaaatattggcagtgctctccttgatacagatatgatcaactgtattttctcaggtgagtgggaacaaggaggtggaccatggggaagaggaaacaagatatgagtcttttggcctctctttccgcttcatttataacaattgcaaatattaggattccaacaacaattttatttgttcgagcttactgatttgcccatccttcaaacttagcaaaaaaaaaccacattttttcccagtattatgagaatcttagagagttctactatagaaacatacatgtccctgtcaagatacagctactcagcctcttgtattattgactaactaaattattgcctaataaaataatataaagccaa

SEQ ID NO: 3115 - DNA, 475 bp, Homo sapiens
  CDS 182..346
  misc_feature 333: n=a, g, c or t
aattttttgtgttccggccgatcccacctctcagctgtgattgacatggagaacatggatgatacctcaggctctagcttcgaggatatgggtgagctgcatcagcgcctgcsgaggaagaagtagacgctgatgcagctgatgcagctstgctgaagaggaggatggagagttcctgggcatgaagggctttaagggacagctgagccggcaggtggcagatcagatgtggcagtctgggaaaagacaagcctccagggccttcagattgtacgccaacatcgacatcctcagaccctactttgatgtggagcctgctcaggtgcgamvggnctcctggagtccatgatccctatcaagatggtcaacttcccccagaaaattgcaggtgaactctatggacctctcatgctggtcttcactctggttgctatcctactccatgggatgaagacgtctgacactattatccggg

SEQ ID NO: 3116 - DNA, 509 bp, Homo sapiens
  CDS 160..441
aaaaaaatttaacctgagacttgaacgacaagaaggaaacaatttcatgaacattcgtattaccaatgaccagaataagcatgtagtgtttgaagaatataaacataactaacttctgaaatccaaggataatctaaagccttcttctactctatctccatgtcttcatataccagaaaggaacctggcgggggaaccaaaagtttggattgcaaaattgaggagagtgctgaaacacctgccctagaagactcctcatcatcccccgtagatagtcagcaamattcckggcaggttyccamagacattgagaacactgaaagagacatgagagaaatgaaaaaccttttaagcaaactcagggaaactatgcctttaccattgaaaaatcaaggtgagtcttgtcacttctctttgaggcagaggatgtttttaatgggataaccttgggaattgtttcttggaaattaaagcatgtgtctcacacaaacagtaaaaaaaaaaaaaaa

SEQ ID NO: 3117 - DNA, 498 bp, Homo sapiens
  CDS 228..452
acctgggataacggcggcgagcggacggctgcatttacggggtctcccggaggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaataaagagaggcctgtccagtctttgaaaacatcaagagatacttcaccctcaagtggttcagcagtttc

SEQ ID NO: 3118 - DNA, 509 bp, Homo sapiens
  CDS 313..480
aggatttgtgaaggcctgaagttcgtagaatgaaatctatgtggagatgatttaaaagaacggtttcactgctgtctcctctctgtccctttttagagaccaacacatataaaccaagtctacacaagaaacaaagctaaaatcctttcgaaatgagttcctttaagttcttcagtaactaaatcctccagaaaggaaagccgagagaatctagtcctatacaataacaccctctaacaaagatcgctaaaggaagattttagtagatgaatatcttcaataatacatggtcacatacatgtatctgaccatatgatggctctctgcaccaaattcctccaaactattataatatgtattgtctgtagtgctatttatttggcagttaatcatgtattacattgtgacatttcttacagtgaaccattatgtatgtgtttatgttctgccctcaactactcaatgccagtaccttattcttaacacagcaaccaccctttctggtctgt

SEQ ID NO: 3119 - DNA, 284 bp, Homo sapiens
  CDS 34..201
ctcagcatctggagtagctgggattacaggcacatgccaccacgtctggataatttttgtatttttagtagagacggggtttcaccatgctggtcaagctggtctccaastcctgacctcaagtcatctgcccgtgtcggtctccggaagtgctgggattacaggcctgagccaccacactccacccctaatcaccccttctaataaagacacagctcatgtaggatgagagctaaaaaaaaaaaaaaaaaaaaaaaaaaaaaaaaaaaaawamaaaaaaaaaa

SEQ ID NO: 3120 - DNA, 494 bp, Homo sapiens
  CDS 98..466
  misc_feature 461: n=a, g, c or t
aaaaggtgacctggggcctcgaggggagckggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggttkggctgcgaatgggcaatggcgctctccatggggaccaccaacgcttctccacctttgcaggattcctgnctctttgaaactaagtaaatatatgactaggaa

SEQ ID NO: 3121 - DNA, 632 bp, Homo sapiens
  CDS 79..501
agccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcat

SEQ ID NO: 3122 - DNA, 616 bp, Homo sapiens
  CDS 79..501
agccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgraaaaaaaaaaaaaaa

SEQ ID NO: 3123 - DNA, 483 bp, Homo sapiens
  CDS 293..460
gaggggctatggacaaaccacatggctggaggtgagcttcagatctgggctgcttcctggacacagaaaataaagcaggacaggagatgcagagagcatggaatstcttcactacaggctccgtggaaggaactcgcatcaggccagctgagaaagccagtttgacattcacctgtggcagacctgggttttgactgaaccgcttgctccttgaggcccgaggcctgaggactcatctctatagcccctgcatctggccaggacttggttgcagtaggtgcttgataaacctatgctaagtataaaatgccacctaacttgtttcgctcatcttatctttattacactttcctctttttccagaaatgacttctggcaactgacaggctccacgttgagtgttcacactgtgcccaattctgccctgagcactttgcttggtttctccacaacaatattgtgatcagtataattactgttatt

SEQ ID NO: 3124 - DNA, 479 bp, Homo sapiens
  CDS 69..296
aggcgactcgggggattctagggcgacggcgctgccgccattttgtggggtgtttgtcgcagcggccgatgagggaagacggcagtttggcgacatttctcggccgaaggcatttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaagggaagtgc

SEQ ID NO: 3125 - DNA, 492 bp, Homo sapiens
  CDS 69..296
aggcgactcgggggattctagggcgacggcgctgccgccattttgtggggtgtttgtcgcagcggccgatgagggaagacggcagtttggcgacatttctcggccgaaggcatttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagtgcaatagacactgttc

SEQ ID NO: 3126 - DNA, 707 bp, Homo sapiens
  CDS 12..203
ttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctgaaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtg

SEQ ID NO: 3127 - DNA, 503 bp, Homo sapiens
  CDS 269..478
aatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttcttttttctatgggaaatcacttctggagttcgcaagaatggagaatggtgtgttgggaaacgccttggaaggtgtgcatgtggaagaggaagaaggagaaaaaacagaagatgaatctctggtaggaaataatgat

SEQ ID NO: 3128 - DNA, 479 bp, Homo sapiens
  CDS 165..407
atttttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgracatgctagggctcggtcacgagggtggaagaggtagaggacgatactctgaccgtttyagtagtcgcagacctcgaaatgatagacggtatgtgaaagggtggat

SEQ ID NO: 3129 - DNA, 464 bp, Homo sapiens
  CDS 72..443
gagagcgcgcgcsacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagttctgggctcaatggcgagattatggagtatgatttacaggcgttaaacatcaagtatgctatggatgcctttggaggacctatttggagcatggctgccagcccagtggctctcaacttttggttggttgtgaagatggatctgtgaaactatttcaaattaccc

SEQ ID NO: 3130 - DNA, 497 bp, Homo sapiens
  CDS 2..205
catggagttcatagtcctattggcacctaagagaagtagttcaaggttactgtgtgatacctctgactacttcaaacattggggagattgtgactggttggggcatttctcttcacacatcgtaaatgtctgggagggtaggaagaactttcgaggagtgccctttgtagcaaaggcatcttctaaacagtcttatgagttaacttagtctgtactcacaagagtgatagttgtaacagaggtaatagaagctcattgaatctggagagtggttcgtgtaactcatgggtagacccaactgttagaaattatcctgtgaaaaggctaggcttgacgctgcttgagtcagaactatatgcttataaggcaatactgttcactggtaggtgtggtatgacaagactgtgagtggcatgggctcagaggacttgttttggtagttgtggcttacagaagtgttagtggcctttcagagaggttctcactactcccatagt

SEQ ID NO: 3131 - DNA, 316 bp, Homo sapiens
  CDS 135..299
tattctggattttctctaacaaataatacttgatagggccaggcatggtggctcacgcctacaatcccagcacttttggaggctgacaggggtggatcactttagctcaggagtttgagaccaacctgggcaacatggtgaaaccccatgtctaccaaaaatacaaaaaattaaccgggcctggtggtgtgtggtcccagctactaaggaggctgagatggaaggatgacttgaacccgggaggcggaagttgcagcaagccaagatcacgctactgcactccagcctgggtgacccagtgagaccacatctcaaa

SEQ ID NO: 3132 - DNA, 464 bp, Homo sapiens
  CDS 57..230
  misc_feature 436: n=a, g, c or t
agcacctggcagggctgccgcagagacgcacagcgtagttgtgagggacattgctgatgtccatcccgttgacctgggggcaggtggaacaatcgtgcggtcagctccacctgccacaacccttcctgaaagatccaggcccacagaaaagccaggatcctgtctttaaagactgctctgctctcccacctcatcctgtgtccaataaccgcaccttccaacagcgtttctaaccctgttctctccaagcgtggcctgcagcacctctccaggcctctgtgagtagacaccatctttctccaccttgttcttacccaagcccacatatttattcccagaatcctagccttcatttctgttgtcattattttttagctggcaggaagagagggaacgaagataaggtaggaaaaggcaaaagaaaagcatttttccnvtttgcctcagtcaaatgattgcattaa

SEQ ID NO: 3133 - DNA, 546 bp, Homo sapiens
  CDS 90..281
aaggaaattgacgaacacgtgacgcggtcggscggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgargcaatcatggtggcatcaccataaagggaacacatttgacttttttttctcatattttaaattactacaagattattaaagataaaatgatttgaaaaaaaaaaaaaaaaagg

SEQ ID NO: 3134 - DNA, 556 bp, Homo sapiens
  CDS 84..275
attgacgaacacgtgacgcggtcgggcggaccactgcagactgagcggtggaccgaattgggaccgctggcttataagcgatcatgtttctccagtattacctcaacgagaagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgcmacctgttacccctcggagactccgtaaccaaactcttcggactgtgagccctgatgcctttttgccagcmatactctttggcatccagtctctcgtggcgattgattatgcttgtgtgaggcaatcatggtggcatcacccataaagggaacacatttgactttwttttctcatattttaaattactacaagattattaaagataaaatgatttcaaaaaaaaaaaaaaagcttatcgataccgtcgvs

SEQ ID NO: 3135 - DNA, 452 bp, Homo sapiens
  CDS 53..244
cactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggmatccagtctctcgtggcgattgattatgcttgtgtgaggcaatcatggtggcatcacccataaagggaacacatttgactttttttttctcata

SEQ ID NO: 3136 - DNA, 460 bp, Homo sapiens
  CDS 84..281
attgacgaacacgtgacgcggtcgggcggaccactgcagactgagcggtggaccgaattgggaccgctggcttataagcgatcatgtttctccagtattacctcaacgagcagggagatcgagtctatacgctgaaggagcagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccgtctgttacccctcgcagactccgtaaccaaactcttcggactgtgagccctgatgcctttttgccagccatactctttggcatccagtctctcgtggcgattgatcatgcttgtgtgargcaatcatggtggcatcacccataaag

SEQ ID NO: 3137 - DNA, 341 bp, Homo sapiens
  CDS 7..303
agtcttatgctaccactgtggctcatcctgcgacctgagagaaacctgggcaactgtgagcaccagaggccaagtcctggacagtctttaggccatgttggaactacatttggaaaggtggttgttaaacatttcccagcacacacctggawyyksaayyksykgggymawtkramcmwytcaykggtyckgkracctmagttctycgwagactckggaatggagctggaagctgtcatcctcagcacactaacgcaggaacagaaaaccaagcactgcatgttcccacttataagtgagagctgaacgagcagaacacatggacatatgaaggggaacaa

SEQ ID NO: 3138 - DNA, 489 bp, Homo sapiens
  CDS 253..408
acattatgtaatatgcctcaggagtggcagaaacctaggctgaaataaccagcactacttgccaaacactttagaaagattatgtttcttctccattacagaagtggaacatatggttcagattctcctcattaaactacctgccctctgtaatgtagctcttctgtgctgcagaaattgatactacacaagaaaagaaatgatgggagaatagggaagaagagaagaactggccaggaaaaggaaaacactatgtggaagcaagacacacagggaaaacatcctgtgatgacaaaggcagagattcgagtgctgcagctgcaaaaaaaggcacaccagggattgaaggccatcaccagaagctgggaagagacaaggagggattggaacatggccctgctgtcaccttgattttgaacatctaacctccagaactggtttgttttaattatctcaagagattcttgtgttaaatgaataccctctgga

SEQ ID NO: 3139 - DNA, 596 bp, Homo sapiens
  CDS 6..578
aatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattgg

SEQ ID NO: 3140 - DNA, 457 bp, Homo sapiens
  CDS 141..377
agtttagcgaactgcagcttggaaactcacactgggaagtgtgaagattgaatgagagagcagatgttaaacacccagagtagtgagttttcctgaggaatttggaaacctcaatttttgcactgactccagaactccaaatggatcccaatagaaagtctcatcgatcgtccccctcccccatcttacttagggaggaaaaaaaagaacaaactatttatttggatactcagcgaggttgtgagagttgccacagcaacagctgtgaaccttgcacagcaaaaggctcttactgtagagtgtcctgccttccaaaacatctcctctttaaagagacactgctggcgatactatatcagtttggtgtgtgtgtacattgacatatcatcgacaccatttgaagagacaaaggcaagtgtttacttgggtggttcacaagataattttagtcaagctt

SEQ ID NO: 3141 - DNA, 549 bp, Homo sapiens
  CDS 171..515
ttgatacacaacgatattcagcttctggagggccggggaagggtccattgcaaaattgtgcggagttgacccttgggtaaaaatcagaatttacattttggttttaaattttataagtacccttggctgtgtacatttgagtaaagagagcactataaaatcaaaaaccaatgaaatggtttccagaacacagaactattaagcttaagaaaaggacagaaggaactgaagagagaggaactgttttggagcatcacacttccacctcagaagaaataaggaaggaaggaggagggtgttcccacggctcttcaaccaggccggctcttcagcctacatccccatctcatcaagtaaaagggatttttcaactggaccaaccagatggtttaacagtgcactcccacaccattcaactacgcaagggagatacacttaacatatgcagtcgtataacacctactaacattttcaacattaaacctttaaaaaagagttctaaagaaatagaagcttgaagtatcatctctcaagtatatagacactact

SEQ ID NO: 3142 - DNA, 438 bp, Homo sapiens
  CDS 92..253
actttgggagccacatccaccacttctctgaccccacgcaggctgcttcccaggcctcatggtactagtgtggacctcctggctgtgattaatgcagttttttagattaagtactgcacgactactcgcttctgaaactgtcataagaaactgcctcagctccctgcaggtggacacacaagagcagaatctccgtgggacatctctttggagcatcaatattactacagtatttggaagacacaaatttaaataatttctaaggtaaagaatggaacatttaagacaaggctggaaagtcatctgcctttaataactcatctgtgcctcacatgtcagactttctccaagaaaaaaactaaggagaacttatttccattcttataagtagtaaaaataataaatcatatcaagtcaattgaaaaaaaaaaaaaaaaa

SEQ ID NO: 3143 - DNA, 513 bp, Homo sapiens
  CDS 185..346
ttatgaaatgaagaggttgaagcttgttagaagatatgaaataagataaggcaggcttctaattgtcccatgtaggaatactaatattctggctctctctatagttagaaatgcaaaggctgaataatcaaacaatagtaacccaacatcatccccatatttttgcaaaagtagttttgagtcaatgacaaagaaaagaccaaattataagaagtggtggagtgggtcagcaaagagcttactgggctttgcttatcagcgagaacaaaagagtgctgacagtagaaatactgagcatgtgagtgtaaggggccccggatacacagtagaaaagaagaagccttgttaattgtggatattatgtacatacttatgctattttttattaaacattttatttcgggataattgtagattcacatgcaattttgagaaataatacagactttgggaggccaagggggtggatcacttgaggtcaggagtttgagaccagccagaccaacgtggtga

SEQ ID NO: 3144 - DNA, 548 bp, Homo sapiens
  CDS 66..299
aagactttcaggggtcggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaagtcaaaaaaaaaaaaaaaa

SEQ ID NO: 3145 - DNA, 725 bp, Homo sapiens
  CDS 410..604
  misc_feature 19,630: n=a, g, c or t
acttttaacagcgcatgsngcagtgttgcctcgcccaaagaagactacaatctccagggaaacctgggggcgtctcgcgcaaacgtccataactgaaagtagctaaggcaccccagccggaggaagtgagctctcctgggggcgtggttgttcgtgatccttgcatctgttacttagggtcaaaggcttgggtcttgccccgcagacccttgggacgacccggccccagcgcastattgaacctggagcgagtgtccaatgaggagaaattgaacctgtgccggaaagtactacctgggggggtttgctttcctgcctttttctctggtttggtcaacatcttctgggttcttccgagaggccttccttgktcccagcctacacagaacagagccaaatcaaaarggstatgtctggcgctcagcctgtggggcttcctcttctgggtgatagtgctcacctccttggatcaccatcttccagatctaccggccccgctggggttgcccttggggactacctctccttcaccatacccctggggcaccccctgacaacttctgcacatactggggccctgcttattctcccaggacaggctccttaaagcagaggagcctgtcctggganccccttctcaaactcctaagacttgttttcatgtcccacgttctctgctgacatcccccaataaaggaccctaacttacaaaaaaaaaaaaaaaa

SEQ ID NO: 3146 - DNA, 476 bp, Homo sapiens
  CDS 85..291
agactctcaccgcagcggccaggaacgccagccgttcacgcgttcggtcctccttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaaaaagtttgggactataaatatcgttcacctaaacttgggagttatac

SEQ ID NO: 3147 - DNA, 500 bp, Homo sapiens
  CDS 205..486
gagaagcggcgataatctgtttgaggatgtagggtggtgtgaaggaacatagccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagagggaaagcagtgttctggcactccagcacccatgtcctgggggcagcagctgaacaattcctaggtgctgttctc

SEQ ID NO: 3148 - DNA, 462 bp, Homo sapiens
  CDS 150..302
acatttgttagggctaatgtcgtctcattactactttcttccagagtttcattggctctttgtgctaatatcattttgttaagtttcaccaaaaattaaaatgttttaacttaaataggatcatatcaaatttataggctaatttagggatgattgagatgcacttcaaaatttcatgtgacaaaacatctaaaatagcaaggacatttttcttccctatcatatttgctgcccactcccctccccccaaaaagggaacattctcagaggtcaaactaccaaagatggttactttcctaaactgacttccctctgtgatcttctcccctacttgctggttcctgaggcttccccttttggtctctgatgaaaagggtggggctttgatgaccctgctgtgccatgtctatgactatgcatgcatctggggccaggtgatgtggaggacagagaagtaaagca

SEQ ID NO: 3149 - DNA, 627 bp, Homo sapiens
  CDS 292..558
  misc_feature 500: n=a, g, c or t
aattttgactccagtgtctcgtttgcagtcggcgctttaggggaactgtcttcctccgcagcgcgaggctgggtacagggtctattgtctgtggttgactccgtactttggtctgaggccttcgggagctttcccgaggcagttagcagaagccgcagcggccgcccccgcccgtctcctctgtccctgggcccgggaggaccaacttggcgtcacgccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaakgacatcgcacagtaaagcttgttccgtggtccagtgccttcagaacttnctcttgcatggcaccaagaatgtaccaattcaagcagtttaagattgccaagacaaaatagtgatggtgtcagaaaaataaagctcgtgaacatattatagactgtggagatatagtctggagtctt

SEQ ID NO: 3150 - DNA, 864 bp, Homo sapiens
  CDS 102..521
agaatccttttctaggaccacctcaagatgaatggggaccacagcacttctggcatgatgtgaagcttaggttttattacaacacatcagaacaaaatgttatggactaccatggagcagaaatcgtgagccttcgtttgctgtcactagtaaaagaagaatttctttttctmagccccaacctagattcacatggactgaaatgtgcatcttctcctcatgggctggttatggttggagttgctgggactgtccatcgaggaaacacttgtttgggcatttttgaacaaatttttggactcatccgctgcccttttgtggagaatacttggaaaatcaaatttatcaacctgaaaattatgggagagagttcccttgctcctggaacattaccgaaaccatctgttaaatttgaacaaagtgatctagaggccttttataatgtaatcactgtatgtggtaccaatgaagtacgacataatgtaaagcaggcttcggatagtggaactggggaccaagtttgaggtagtggaaatgagacattgctgaacaaaagagaactgggtttacctgaccctctaaagcgctaagtactgtcagcctgawaaaaatctkstatacagaaactcttccaaatactatatcagtaatgtctgaatgatttcagatgtgaaaattgacatattttagttgaaatacctttctggactacagacttacatatcatgtgaatacttacctatttctacccgagttgcagcaagtattctgaaaacttaatgcaaataaatcccactttagatcttawaaatwccaaagtcacctgaacaaagccttatggaagggtagggaagttaactagtc

SEQ ID NO: 3151 - DNA, 655 bp, Homo sapiens
  CDS 99..476
agcccccgccgcggcgctasccgcccgagcccacgtgggaccgcttgcgcaaacgccgggagtagccgaagggacgccgggaacaggaatttcttcacatggctcctggagaagtgaccatcacagttcgcctcatccgttcctttgaacatcgcaatttcaaacctgtagtgtatcacggagtraatttggaccaaactgtaaaggaatttatcgtatttctaaagcaagatrtccctttaaggaccaacctgccaccaccattcagaaattataaatatgatgcactaaagattattcatcaagcacataaatcaaagacaaatgaacttgtgttgagtttggaagatgacgaaagactcctgctgaaagaagacagcactctgaaagcagctggaatcgccagtgaaactgaaattgcattcttctgtgaagaagattatargaactacaaagctaatcccatttcatcctggtgaaaacatctcgagggcttcctttttgcatacctgtattaagctctttattcactgctgartttttgaawttgacaaacaaatcttaaaaaattaatcccaggctatactctttgagctaaaatctggttatttctttctcttcaggtctttccttctctctttctttttctttgttg

SEQ ID NO: 3152 - DNA, 484 bp, Homo sapiens
  CDS 26..277
agttgsaccaggcgatgcaagacacatggcagtctggcctgaagtttcccaaaacaggctgactaggggcctactgcttcccaactaccagctgagggggtccgtcccgaaaagggagaagaggcctaagaggaaacatcaacatctttttactcctagcgagcggcattctgtstgccttgattgtcttctggaaatatcgctttcagggaaacaatggcgaaatgtcatcagtttcaactgcttttgcactactaagacgcttttctgggttaattagcagcaatacagacaacgatcttttattcaacaacctctctcgagatattttaaataatttctcacactcgaaaaacatgcagaagcgactattggcaaacctgaagagggtggaataccaaatggctgaactggaatattttctagttagcgagggtttgagaggtgcgtcaggtctccagaaattcacctcaaaagcgtacag

SEQ ID NO: 3153 - DNA, 459 bp, Homo sapiens
  CDS 150..329
tgataaaaatactgtaaaattgattttggtaatggttgtacagctctgtgaatatactgaagtcattaagttgtgcactttaattgggtgaattgtacatgtgagttatatatctgactgtagttgttattaaaaaacaacaggaggccatgtgggctgctaggagtagcaatgtctgttcccagccagcaggtagagaccagggctggacagaggagtatgggctgtgctgcagattatttgtggtacccaactgttgcataaaacagggtgtgatctcttgcattgctatgcatgagtggattcccagtaaattgtgccaggctgcctgatgatgtgtggcttgtgctttggatcgtaatgcttacctatgctacttaagttacataccctgtggcctttgtggcaggactgtgggctactacctggagtgattcgttaggggaaaggacccacagc

SEQ ID NO: 3154 - DNA, 526 bp, Homo sapiens
  CDS 142..417
  misc_feature 344: n=a, g, c or t
agtcagtcccctcgaagcccggttgccgtggaagccgcgtggggcgccttcctcagctcttcagttgaggccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatgganggccactggaaaaagcacagctttccagctggtggaactgggcccaggtaggggaacctcgtgggagatattttgagggtgttcactcaacttggatctgtgctgaaaaattgtgacatttcagtacatctggtagaggtaagccaaaaattaagtgagattcaagcattgacactgactaa

SEQ ID NO: 3155 - DNA, 505 bp, Homo sapiens
  CDS 202..474
  misc_feature 492: n=a, g, c or t
aaacggtccgtccggaaggaggaggcccattccagcttctacttttgttgctatgcaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatggattcagtggcctttgaggatgtggctgtcagcttcacccaggaggagtgggctttgctggatccttcccagaagaatctctacagggatgtgatgcaggaaaccttcaagaacctgacctctgtaggaaaaacatcgaaagttcagaacattgaagatgagtacaaaaatcccaggagaaatctaagagggagttttgctcttgtcgcccaggctggagtgcaatggcgtgatctcggctcactgcaacctccgcctcccagattcaattgattttcctgtctcagnttcccaagtagct

SEQ ID NO: 3156 - DNA, 605 bp, Homo sapiens
  CDS 419..589
ctttttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtaacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaacccagaagcagctgctctccgggagcttgaagaagaaactggctacaaaggggacattgccgaatgttctccagcggtctgtatggacccaggcttgtcaaactgtactatacacatcgtgacagtcaccattag

SEQ ID NO: 3157 - DNA, 409 bp, Homo sapiens
  CDS 53..337
agttagttacgagtcggcgcacgcggcctcggtccggttgactttgcggascatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagcaaaaaaaaaaaaaaaa

SEQ ID NO: 3158 - DNA, 482 bp, Homo sapiens
  CDS 36..251
agaatccacattgttgtggccaggcacaggggctcatgcctgtaatcccagcactttgggaggctaggaccgaagagtgcttgagctcaggaattcaagaccagccagggcagcatggtgaaacctgtctctacaaaaattacaaaaaattagccaggatcagagcggcaccgaacctattagtagtgaggaagatggcagcctcgaagttggtattaaacaattgcctgaaagtgaaagcttcaaactggtgagaatcttgagtatttttcatcctgtattctgtttagggatgtatcacttatattttgtaccaccttggaaagaaccacctatcatgtttgcttctctcaggaatcttcgtctgtgagacaagaagctattatatgtagtgagtgacccattgactctgaagaagagcatcttctcttaccttggcaacacttgaattgtgctgtctgggattaaggaagcaatctctc

SEQ ID NO: 3159 - DNA, 528 bp, Homo sapiens
  CDS 53..337
agttagttacgagtcggcgcacgcggcctcggtccggttgactttgcggagcatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtctcgccaccccccgccctgccccctgccagccagtgcagcttggatctcgggggtgtg

SEQ ID NO: 3160 - DNA, 494 bp, Homo sapiens
  CDS 122..382
agttagttacgagtcggcgcacgcggcctcggtccggttgactttgcggacgcattggagggcggcttcggctccgatttcgggggctccggcagcgggaagctggamccmagggctcataatggagcaggtgaaagtgcagatcgccgtggccaacgcgcaggagctgctgcagaggatgacggacaagtgtttccggaagtgttatagggaaacctgggggctccctggacaactccgagcagaagtgcatcgccatgtgcatggaccgctacatggacgcctggaacaccgtgtctcgcgcctacaactcgcggctgcagcggggaacgagccaacatgtgaccggcgagcgcgggccaccccaccctgttcatttccataaacgtgctttgagaggcgggggtccgcatgtacgtactgcctgcccggggcttaggagggtggcaccggtgctgggacacacgggactgtgtctcgccacccccgcactg

SEQ ID NO: 3161 - DNA, 451 bp, Homo sapiens
  CDS 53..337
agttagttacgagtcggcgcacgcggcctcggtccggttgactttgcggascatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccgggggcttaggagggtggcacggtgct

SEQ ID NO: 3162 - DNA, 494 bp, Homo sapiens
  CDS 165..341
aaaatgccctgtacgacctaagggcctccacagcaggaacaaaaggaattttgtctgagattttagcagaaaagtaatttttgaaatctattcttggatttagacgtttattggatttcaaagcttcttgctgcccaggagcttgtgaatacggtcaaaggtccatgaaattgkcgaaagtggtaccacagcagatgaacctgaatgcaaactggagggaccaacagagtccagcctatagacataaatccttaactacacctagatctcactgtcttttccaaaggtcaaaagaggggctcttgaaatggctccattgttttatagaaacaaggtcttcctaagaagtctttttctcctatctttttcttacccaaaataaagggatggcccaaaacctcaagccaagcttaccagctataaacaacttggtggtcagcagccaaaagaagagtggacatgccatggtcatgtggcacgtaccctatacaagc

SEQ ID NO: 3163 - DNA, 478 bp, Homo sapiens
  CDS 9..263
gaccaaagatgacctactatgaccatgcggatttccaccacagtgtaaaaagtcctgaattgtatgaaacagaacccactaacaaggacattagtgctccagtggacgctgtgccagaagcccaggctgccaggcaaaagaagatctcctttaacttttcagaaattatggctagcacaggctggaactctgagctcaaactacttaggattcttcaggacactgatgatgaggatgaggaggaccagtcctctggggcagagtgagaagcctctggaggaatagactgaaggcatcccctggggcagccgtgttccaaagcgggatggctggtatcctgagggcagcaacgtttcacataagggcaagaggagaggggcttctgctctctggagcctttaccagggcctgagctctgagcttagggattccgttttctttgttcacctctacttgcctctaaaataaatgtaggaga

SEQ ID NO: 3164 - DNA, 508 bp, Homo sapiens
  CDS 233..445
ttcttcttggctggctggcctcattaactccttccctgagtgtctttgcgataggagaaagctggttaactcataatgtgatactgtttattttcttagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggtaagtatttctggggacctcaggatcctgccctgtccctcagcctctggaaaggagtgtccatttctaagagtcccaccatcaccttgccctcccgcctgcttacccttgcccaccaccacaatttgctctgcattagaatctcctgtggtgcttgatgaaaagggaactctaaaataaaatgctacaagtcagacaatcccagtcataggaaccaatacctctcaaagacagaattcc

SEQ ID NO: 3165 - DNA, 498 bp, Homo sapiens
  CDS 167..490
  misc_feature 442: n=a, g, c or t
gcaaattcacaaacccgcccgctgagttggtcgtttcggaatcccgagacttgaaacccaacggaagacccttctcaccctcaaaagaagatgacagcccgcagagagttaacttctgtttacatggaactcagacatctgcaaatcatgatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcangcagaacaagctgaagcatcttaccatcgtgagcttggcatcaaggaatgaagtgt

SEQ ID NO: 3166 - DNA, 539 bp, Homo sapiens
  CDS 254..418
ccctgcgagtggcgcaggtaacagaccgcagggcaagacagccggcgcgggaggaggatggcgctgtcggtgctgcgcttggcgtgctgctcctggcagttaccttcgcagccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattt

SEQ ID NO: 3167 - DNA, 350 bp, Homo sapiens
  CDS 17..202
actaagcctttcttttatgttccaactaaattgggcaatattctattgtctcaaaaatctcagtgaaacctgcatttctaatttatcccgcaagaaaccaaagaatcaaggtgtgcagtgttgtagaagtgagctcttctctttcctctcaccaagcatgtttaagatcacacttgtgtatccactaaggagagctgaggtttaatttttaaaaagaagcaactccatttctcaaattactgcttaagattgtgtagatagtcccgaactttgtctttgcagttgtatttggatagaagtttgtaaagagagaaaaataagagggaattcgggacctagttcttatctga

SEQ ID NO: 3168 - DNA, 471 bp, Homo sapiens
  CDS 117..299
agccaggcggtggcgcggaggatggatggggacagccgagatggcggcggcggcaaggacgcaccgggtcggaggactacgagaacctgccgactagcgcctccgtgtccacccacatgacagcaggagcgatggccgggatcctggagcactcgktcatgtacccggtggactcggtgaagacacgaatgcagagtttgagtccagatcccaaagcccagtacacaagtrtctacgkagccctcaagaaaatcatgcrgaccgaagcttctggaggcccttgcgaggcgtcaacgtcatgatcatgggtgcagggccrgcccatgccatgtattttgcctgctatgaaaacatgaaaaggactttaaawkracgttttccaccaccaaggaaacagccacctagccaacggtattttgaaagcgtttgtctggagttagaaagttctcttcttcaacacgtccctcccca

SEQ ID NO: 3169 - DNA, 490 bp, Homo sapiens
  CDS 101..265
agattcaagtgaaccagggaaggagaatgacatcagactgggcttgtgcctgataattcatttctgaagtgcttcaagattgacgcatcagatttgcacaatgtccactttaggagattatttcttccttccttcagccagacagaagactgcagtagggatatggttcctgtttgcctatttccatccacaactctgccagaaacgaaagcagtgtttgaaacaattcaccaagatttccatctggaatcatcaagaatggaattgatcaaattccttaagaaatttacttaaagtcatgattttgacagcctagtgctacctggaaaagggacagcagcagcctggagcagttttctagctaacaagaattttgttagctatgtggccacctagtgctcttccatggatgtcgctgatgcattgtcaggtacacagacaattgcccactaataaagaagttattatctttcttagaaaaaaaaaaaaa

SEQ ID NO: 3170 - DNA, 563 bp, Homo sapiens
  CDS 224..388
gtagattcaagtgaaccagggaaggagaatgacatcagactgggcttgtgcctgataattcatttctgaaggtgcaatattaagtgtcacagtgtccagctggtgatattttcagcatagaaacctgttagacacggcagcattaaggagatggaatgaattgatttatttctcttctgaattgcttggcagtgcttcaagattgacgcatcagatttgcacaatgtccactttaggagattatttcttccttccttcagccagacagaagactgcagtagggatatggttcctgtttgcctatttccatccacaactctgccagagacgaaagcagtgtttgaaacaattcaccaagatttccatctggaatcatcaagaatggaattgatcaaattccttaagaaatttacttaaagtcatgattttgacagcctagtgctacctggaaaagggacagcagcagcctggagcagttttctagctaacaagaatttgttagctatgtggccactagtgtcttccatggatgtcgctgatgcattgtcagktacacagacaat

SEQ ID NO: 3171 - DNA, 489 bp, Homo sapiens
  CDS 124..321
agaagggagtggaccagttcaggtcccagaggaatcctccctccctctgagccgtctttcttctcctccctatttcgcagatatcccgagattaggtccccagcttccaaagagaggatcagaatgtctcaggataatgacacattgatgagagacatcctggggcatgagctcgctgctatgaggctgcagaagctggaacasagcggcggctgtttgaaaagaagcagcgacagaagcgccaggagctcctcatggttcaggccaatcctgacgcttccccgtggctttggcgctcttgtctgcgggaggagcgccttttaggtgacagaggccttgggaaccctttcctccggaagaaagtgtcagaggcacatctgccctctggcatccacagtgccctgggcacgtgagctgtggtggagacggcaggggcgagcgcggcctcccgacaccgcggacagaagcagtgttcaggaatctcggtct

SEQ ID NO: 3172 - DNA, 826 bp, Homo sapiens
  CDS 557..736
gacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccaccccttgatccgccagcsccttctttcctttccactcccccagccgcctctttgaccagttcttcggagagcacctgttggagtctgatactatttcccgacgtctacttccctgagtcccttctaccttcggccaccctccttacctgcgggcacccagctggtttgacactggactctcagagatgcgcctggagaaggacaggttctctgtcaacctggatgtgaagcacttctccccagaggaactcaaagttaaggtgttgggagatgtcgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctgggccctgagcgcaccattcccatcaccccgtgaagagaagcctgctgtcaccgcagccgcccaagaaatagatgccctttcttgaattgcatttt

SEQ ID NO: 3173 - DNA, 455 bp, Homo sapiens
  CDS 128..322
agaggacttttgccaaaggaaccattttctatttgtagaaaatgcatatgtgatttaatgacaggactcacctaaaccccactcctaaagcttacttggctgatactttaaggtgtactctgtcaaaatgccattcgggtggctcggtggatcccattccaaagtgagagagtccagtgttggattcacaatcttcaaagacgagggagcactggggacttacagtgagaacttacagtcaacacaaagatttctgaatgtttcaacatgtattaaattgacatttcaccgtgctcgcacrwttcaaggttttgagtttcagtaactcattcctgattcagctgaaaatacattagtacaaacctgtgacaggcacccatttagttattctcttcctttttctctcttgtcatttacatttatatttaataaaaccatcctctcaaaacaaaaaa

SEQ ID NO: 3174 - DNA, 465 bp, Homo sapiens
  CDS 63..356
acaagggaagtggctatcgccagagtcggattcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatgagaggtgtatgagagtgagaaagatgaagatggattcctgtacatggtctatgcctcccaggagacgttcgggatgaaattgtcagtgtaaaaccagaaaaratgcatctcttctaga

SEQ ID NO: 3175 - DNA, 484 bp, Homo sapiens
  CDS 93..266
acttagccttgtccctacctctttactcctctgtaggcagtaattcttttttcttttctttctttttttttcttttggtgtaayagtatcgcatgagccaagactgtcatgaaactatttggatactgtactctggttccttcatctcctccatctgcatcagcctaaattgtcctagcttctggaacacagagatgctcatgcacatgcccctccccatggagggacacaaagatgaatttccgcctggaagcacgacaggctgctaactttttgcctggatgctctcacccttggagatcagaagctgagcatctctccattcagccatcaacaaaagggagagattgcctgagcagcatgctgttgttagacaaatcggaatcctcttctagaaaggcattctcttctgcatagtgagtgggaagcctgctgtatctaggacacgttcccaaaataaaattcagtggtcaccaactgaaaa

SEQ ID NO: 3176 - DNA, 482 bp, Homo sapiens
  CDS 70..300
agaagagatggagctggacagagctgtgggggtcctgggcgctgcaccctgctgctctctttcctgggcatggcctgggctctccaggcggcagacacctgtccagaggtgaagatggtgggcctggagggctctgacaagctcaccattctcmgaggctgtccggggctgcctrgggcccctgggccaagggagaggcaggcaccaatggaaagagaggagaacgtggcccccctggacctcctgggaaggcaggaccacctgggcccaacggagcacctggggagccccagccgtgcctgacaggcccgcgtacctgcaagacctgctagaccgagggcacttcctgagcggctggcacaccatctacctgcccgactgccggcccctgactgtgctctgtgacatggacacggacggagggggctggaccgttttccagcggagggtggatggctctgtggacttctaccgggastggg

SEQ ID NO: 3177 - DNA, 482 bp, Homo sapiens
  CDS 279..434
gagatcatggaagatcaactgagcacctctgggaaacatcaagagcaaagagaagatggcccatcataagccaaagcaattaaattcctctccctctggccacaccaagagcatttaacatgcatcatggtctcaggtcaagagtatattcaatagttgacagtgatgtggcctctagctttccagaagagaggaagtcactgtccatcatacagtgctttaatttgagaggctgaactgatgtctgtggagaaaagaacacgaaggaataatgtaatatgaaactccctaacatgatacatatacaaagactattgagaaatcaatgtggaaaatgcaaaactaagggagaaagcattttgaaccactcatctaagaatatggtcagtattaaaaagacaagaatatcagaaaaatctcccaagttatgttcataggcttagcagaataaaggtaaggcttactagttaaatgaatgagag

SEQ ID NO: 3178 - DNA, 497 bp, Homo sapiens
  CDS 30..422
agttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctg

SEQ ID NO: 3179 - DNA, 485 bp, Homo sapiens
  CDS 161..364
attgaggactgggaatccgcttccgggagggcactgtctagtgcacaggcaacctggccttggcctcctagcccgagaagccgaatctccctaatccctgtgacctgtgtcacctctgcatcgcgaggagggggataagtggggagaagcctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggtaatcggcagccgg

SEQ ID NO: 3180 - DNA, 401 bp, Homo sapiens
  CDS 51..233
aggcagcccgtggcctagcagtggaggtgttaaccaccgaagraggtagaatgtttttccccaccagaggaggcagcgaccacgtctcctctatggaggcattcaagagccgtccagctgaagcagcatcactgtctgagctcggaaggcacaatccacataggtctgcatggtccaccgagctgcatacccacggggccagcgggaggtgggcagctgctggggctctcttctgaagcagacaggatctcactctgttgctgaggctggatcacagctccctgcaaccttgaactctccctcaagcaattctccccactctgccttccaaagcactagcattataggcctaagccaccactcccatccactgtagtgtaaactgtctccttcaatgtttc

SEQ ID NO: 3181 - DNA, 517 bp, Homo sapiens
  CDS 112..282
attattactactgaaggaagaacgccagatcagaaaagggagctcaggtaccttccagagagtgagacccagcgcccttgtctcgcacccagtaggctttcatccgccgccatggcgaagctgatccagaagaagctacagggagaagtggagaaatatcaacagctacagaaggacttaagtaaatccatgtcggggaggcagaaacttgaagcacaactaacagaaaatcaatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctctggcaaggcctgaccccatggtgggggga

SEQ ID NO: 3182 - DNA, 577 bp, Homo sapiens
  CDS 52..282
acctatcgtgggtcgagttgcttggcggtcgtggttccggagttcctcgggatgtcggtggccttcgtaccggactggctgaggggcaaggcggaagtcaatcaagagactatccagcggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcgaaacgtgaaaatgtgaagaaagctactaacttagctgtattctcatgtaaatattttttaaataattaagcaaatccctcaataagttgagcccaggtgtcctctttcctgaacttggagcatgtttggatacaaagacatcactgggatgt

SEQ ID NO: 3183 - DNA, 451 bp, Homo sapiens
  CDS 12..266
ctcttaccgccatggagttcgacctgggagcagccctggagcccacctcccagaagcccggtgtgggggcgggccacgggggagatcccaagctcagtccccacaaagttcagggccggtcggaggcaggggcaggtccgggtccaaaggcctccaacttcagggggctgggtaaggggcgccgcctcactgccgcacctccatccagcaaggacaccacagctcttccgactccagcagcagctccagcgattcggacacggatgtgaagtcccacgctgctggctccaagcagcacgagagcatcccgggcaaggccaagaagcccaaagtgaagaagaaggagaagggcaagaaggagaagggcaagaagaaggaggctccccactgaagggccctggacagggctcattaaaccttcctctctgccttcaaaaaaaaaaaaaacaag

SEQ ID NO: 3184 - DNA, 424 bp, Homo sapiens
  CDS 75..260
agtcgctagtcgctatgstgtgcttgtgggtggcgggacaggcttcattgggacagccctaacccagctgctgaatgccagaggccacgaagtawcgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagaccagcccaggagggggactttgactttttctccaacctcgtaa

SEQ ID NO: 3185 - DNA, 556 bp, Homo sapiens
  CDS 151..414
ataaatagatgtaactattatgataccgttgcaagcaaagtgttcttttaaaaatatgtaacaactacatatttcttttttttaatataaaaataggctattattgagggttggtttatttattgtcagcctattaaatagttatccaccatgactacaggtaagaactctctgtggagcataaaacaaacaacgactaccatgaatctcgtggtatcttccagacatactgaatctgaatccttagatattgaagaccggcgaaagaataccaaattaagaattatcattcagaatttaaaatgcttcatgaaccacttcattttgaaattggaggtccgctgtaaagaaacaaatttgagtttgaggatactgaaagtgaatctggaatctactaagatcaatattaattcatagatggcgtaagatgaagatctaatttaattcttctgcatgtggatatccagttgtcctaaaaccatttattgaagacactgtaaaactttatgctttcactgraacaagatactgttgtgtactactacataaagataga

SEQ ID NO: 3186 - DNA, 539 bp, Homo sapiens
  CDS 135..407
agaaggttctagaactatgctgtagccaacccccatgtgcagcactgtctggactctagaagatgctctgattcaagaggatgtaaagaaattctctaagccgataagaaaaatagaagaaacccaaatgggcaatgagtgcatgggaactcactcacctcagtggaaaggagggaatggcaagccagcccactgaagcccactggggacataggacaagtccgcaaagcagagacagcccctccaggaagagcgaccaggccttgagaggacatggccttaggaccagatccagggaagacacagtcactaacccctggctcatctggcaggtgtgggaagcagccaggcccgtggcttcaccagctccccccgatctctgccttcagctgtcctgcagcctgggttaggcacctaggcagctttatggcaggcggagatgcaccacccacatcctctttccaggcagggcttgctgccctggctgtagmsagtgcggcacaggtggcctccagctatcagcaacttcagagagctgc

SEQ ID NO: 3187 - DNA, 520 bp, Homo sapiens
  CDS 50..199
gaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccatacattgacacatttcctttaccctccacacacttctt

SEQ ID NO: 3188 - DNA, 444 bp, Homo sapiens
  CDS 60..233
acagtcaacgtcatctaggagcaccgagcagcttggctaaaagtaagggtgtcgtgctgatggccctgtgcgcactgacccgcgctctgstctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgctggaaacgtgcgtamaacagtaggccgagtatccaacgttgatcataacaaacgggtcattggcaaggcaggtcgcaaccgctggctgggcaagaggcctaacagtgggcggtggcac

SEQ ID NO: 3189 - DNA, 225 bp, Homo sapiens
  CDS 22..171
aactgggacgtgtgcgcagacatggtgggcaccttcacagacaccgaggaccctgccaagttcaagatgaagtactggggcgtactccctttctccagaaaggaaatgatgaccactggatcgtcgacacagactacgacacgtatgccgtgcagtactcctgccgcctcctgaacctcgatggcacytgtgctgacagctactccttcgtgttttcccgggacc

SEQ ID NO: 3190 - DNA, 530 bp, Homo sapiens
  CDS 102..263
tggtgaaccagggagawtcaaataawgagttccagaagtgaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcaggtgtgtctttgagaagatgagaagatcgcagacctgtattctaaactggaatggttctaaagawaaggtttaattgtttgtgagggaatccgtctgccatgtaatcaggacactgaagcagccctgtgaagaggtcaatgaggtgaggaactttggcctccagctcacagttggcaaagaaccattggtgtgtgaccttgagagcaagtcctccagctccaatcaggtcttcagatgattccaactttatgagaagttgggcgtggtggtttcacacctgtaatcccagtactttaggaggctgaggcggttggatcatctgaggtcaggagttcaa

SEQ ID NO: 3191 - DNA, 452 bp, Homo sapiens
  CDS 127..288
atgtcccaatcagagtcttttaacctatgatttaaaaatgtataagtaacagaaattaacatattttaatgactttactttttatttctaagaaaagtatttgaaaaatggaataattttaaatcaatgataattctagggatcatgaactcccagaagattttattatttaattgtaaaggtagaggccagacgcagtggctcacgcctgtaattccagcactttgggaggccgaggtaggcgggtcagttgaggtcaggagttcaagaccaggctggccaacatggtaaaaccctgtctctactgaaaaacaacaaaaacaaaaacacaaattagtcgggtgtggtggcacacacctgtagtcccaggtacttgggaggctgaggcaggaggatcgcttgaacccaggaagcagaggkttgcagtgagctgagatcatgctactgcagtc

SEQ ID NO: 3192 - DNA, 527 bp, Homo sapiens
  CDS 183..404
gacaaggaagaaggtggctccagatctggaggtgtgtccatggcggcgcttgacctgcgagcggastggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaacaggtctgcggaggcgcaagggccccactaagaccccagaaccggagtcctctgaggcccctcaggaccccctgaactggtttggaatcctagttcctcacagtctacgtcaggctcaagcaagcttccgggatggcctgcagctggccgcagacatagccagcctccagaaccgcattgactggggtcgaagcc

SEQ ID NO: 3193 - DNA, 757 bp, Homo sapiens
  CDS 521..718
atggagaccagacacttcaccctggtcaggggtacagtacttccttccgcagattttaccaggctcttgcttatccggtaatggttatcttcatgtaagctaaaaacattatcagtacccagaccttccagagatgtgatcatactacctacgggaaggaactaacatattcaagcttacttctggctgtgtcactgacccaacagaggccagtaggtccagcatggcaagcatggctccaggatgaatgatgactgcatcagaactctgcagagatgaagttgtcacatgtagtttcaggtctgagaagcagccaagaaatcgaacagcatctgccaacttctcatactgaatctctgttttgaagaaatgagagttggctggctcatagcgcattgctgcagtcaacgtgcagaacacagtgtgaagaagttcaaacacttgattctggttcactttctcccagccattcttgggkkgacagctcaaagatctttccatagcaacgagcaaggatgtaatgtacacaaatcctccaactttcctaaaaactgttcttgaacgatggctttctcgaaggaccgacaggagggcctacaggagacaaaagaaaaaacaaatgaaaatacacataattcaaaaaaaaaaaaaaaccactatgcatgtatatggaggttgtacattctgtgaatctgacatgtttttatcatttacccaataaacggtcctataaagcaaaaaaaaaaaaaaatgcgaa

SEQ ID NO: 3194 - DNA, 503 bp, Homo sapiens
  CDS 289..456
aaaggcttctttagacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggccagcttccaatagtgtcagaagcaacttgtggctttgcttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtg

SEQ ID NO: 3195 - DNA, 486 bp, Homo sapiens
  CDS 63..389
tttttggatagggttgacgttcgtggatagactcatatctgtgaccagtgtccgccaccgcgatggcaagagacctgatcggaccggccctgscgcccggcttcaaggcccgcggaacagcgkaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggtttttggaccagcccttcctcctggatttaaaaagcaggatgattctcctccaaggcccataataggtcctgcattgccacctggtttcattaaatctacacagaaaagtgacaagggcagagatgatccaggacaacaggraacagacagcagtga

SEQ ID NO: 3196 - DNA, 489 bp, Homo sapiens
  CDS 204..377
gaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttggccctgggagaaggaagccatttgcagtgctggtgtgtcctgctccctccccacattccccatgctcaaggcccagccttctgtagatgcgcaagtggatgttgatggtagtacaaaaagcaggggcccagcccagcttttggctacatgagtatttagaggaagtaaggtagcaggcagtccagccctgatgtggagacacatgggattttggaaatcagcttctggaggaatgcatgtcacaggcgggactttcttca

SEQ ID NO: 3197 - DNA, 494 bp, Homo sapiens
  CDS 5..226
aaggatgactcagggcagccctgaccacagttccgccgccatcggccagcctgcggaattgggctcgccccgggacgataacagagctctgccgggggctggaggcactgaccgggtgaccagagacccagagaccagaccccctccacggcgcccgggatttcggggacggcttctcccatcgcaagtttcaacagaaaatgagaaatatcgcccgacgattggctgaaaacatgcagcaaccactattttcttcctgcccctcgttgatgagagcattcgaagtgacctcagcagggcatccaggtcagtttctggaagacttgtgtgtgtgatgaatgaatatctggttttgtctctgctgggcctgtgtgcctggaaaggaattgttttggcctaggatcatccagagtttcgctcttgtggcccaggctggagtgcggtggtgtgacctcggctcactgcatcctccgcctcccggggtttcaagtgat

SEQ ID NO: 3198 - DNA, 336 bp, Homo sapiens
  CDS 119..307
ctaagaaaaattcttctgccttgagattctgttaatctataaccttacccccaaccccgtgctctctgaaacatgtgctgtgtcaactcagagttaaatggattaagggcggtgcaagatgtgctttgttaaacagctgcttgaaggcagcatgctccttgagagtcatcaccactccctaatctcaagtacccagggacacaaacactgcggaaggccgcaggacctctgcctaggaaagccaggtattgtccaaggtttctccccatgtgatagtctgaatatggcctcgtgggaagggaaagactgaccgtcccccagcccgacacccgtaaa

SEQ ID NO: 3199 - DNA, 496 bp, Homo sapiens
  CDS 50..226
agatcttctcggcggccggcgccctttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaagacagcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaaaa

SEQ ID NO: 3200 - DNA, 484 bp, Homo sapiens
  CDS 110..313
agtttttcctgggagtcacggtgcttggtcgcgttattgggtccgggaattcagagaatcagggccagctgatacttcaccctcttatcccaacgccaacccttgatagatgcgaaccagtcgtatttcctttgtgggaaaggagtcgctttttaaagacgtgcactggccatctagggaggagcttttacttcaactcaaaataggactggagctgactggtgacctggcgctcgatggacggaaacgctgttcttgccgcttcggcagctcccatactggtgggagaggcaaacttgcagtctgctcatcttaagatggtgaatgttgagatagggttgctcccgaaaagccgagaagaggagccgtttgacccaacttgagggtgatccgatagacactctttagggcgtctgcagagtgggtgcgcgtggagacagtcaataagagaaaatcgtaaatacagatggtattctaaatccaa

SEQ ID NO: 3201 - DNA, 463 bp, Homo sapiens
  CDS 28..198
ttgtctcatagctgtcctttaaaagagatgttattaaattcccattttaggctggggcagtggctgacgcctgtaaccccagtactttgggaggctgaggtgggcggatcactgaggtcgggagttcgagaccagcctggacaacgtggtgaagccccatctctactcaaaaaatacaaaattcctatcagccgggcgtgatggttcatgcctgtaatcccagctactcgggaggctgaggcagaagaattgcttgaacctgggaggcggcacctgcagtgagccgagatcgcgacactgcactccagcctgggcaacatagtgagattctgtctcaaaaataaataaaaataaattcccattttagcaatgaggaaactgggattcagagaagttgagggccgagtgtggtggctgacgcctgtaaccccagcactttgggaggccgaggtgggcggatcac

SEQ ID NO: 3202 - DNA, 473 bp, Homo sapiens
  CDS 161..337
cctttttgaacttacagaattgttgaaattttctactaacagccagctaaaatttggtatatgttagctctatctgtttcacttggacgtttcattttgaaagaaagaaattttatgtttcacatatagttttatacaaagtagccagtcccataatgaaatgctgtattgccatagtggtcacacccaagtggtccagtatctcaatggtgaggcagccagactggtcagggctgctttgttgaaatgtgatgattttcatatgccttctttctctttctctctctctttttttttccttttttggcccaatgttgaagatgtagaactttgtttttaaataatgtttttataatttcattcgtatacctaagtttgtattttttgtgactttggacttcaacagtttgtatattgggacttctaatgtgattactgtactaaataaattccactaataaacatcttacatt

SEQ ID NO: 3203 - DNA, 419 bp, Homo sapiens
  CDS 75..380
cattccgcgcggtgtcccgattttaggggtagggagaagtgtcagcttcaggcatcgcgaggcgtggcggccccatggcccgctggaggcgccccgcggctggtactgctgttcagcggcaagaggaaatccgggaaggacttcgtgaccgaggcgctgcagagcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatccagtggtttcgggaggcctatggggcgtgacgcagacggtccgcgttgtagcgttggagcagagcc

SEQ ID NO: 3204 - DNA, 538 bp, Homo sapiens
  CDS 101..415
aaagtgttagcggggaacgctgggaaactcccggcctccgccaccatcttggstttcctttaatccggcagtgaccgtgtgtcagaacaaatcttgaatcatgaagctactaaccaggagccggctcttttctcgagattttattccctcaaagktkgcccccaaagttaaagccacagctgcgcctgcaggagcaccgccacaacctcaggaccttgagtttaccaagtataccaaatggcttggtgattgcttctttggaaaactaatcccccgggwycaaraawttggtttgtccattaaagcaggcagtagatatgaggacttcagcaatttaggaacsrwcccatttgctgcgtcttacatccagtctgacgacaaaaggagcttcatctttcaagataacccgtggaattgaagcagttggtggcaaattaagtgttgaccgcaacaagggaaaacatggcttatactgtggaatgccctgcggggtgatgtttgatattctaatggagttcctgctcaatgtcacacagca

SEQ ID NO: 3205 - DNA, 533 bp, Homo sapiens
  CDS 116..403
acagtaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtagacactccagggctctttgacaccaaggagagcctggacaccacctgcaagaaatcagccgctgcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttkgagggcca

SEQ ID NO: 3206 - DNA, 464 bp, Homo sapiens
  CDS 154..396
aaatgttccaaaaggagaaataaggtatagcatctcactacaaatcctccatctcaaaacatggggcctggagtggccccccaagaccctacccctaaaaacaamctggctgtggatatggtgacagattagaaagttaaacccttcaccttcatgaaagaatctggaatggagcaaacccatcatttacctaagaaggcagaaggtgagacagtcccattgctgcgtgacaccatgacacttatgcctgtctctatgaagggcacagagaagtcgaccacctccgatcgttcctcattgatgatggctacagaggggtttgatgacttgcccaagctcccacgggtccctctcagcgcctacgacacagctgctgacaggaggaatgtgccggaatgatggaagagctgggtcacagcagataatccatttatggataataaaaaatgtgtgtcacacttcgt

SEQ ID NO: 3207 - DNA, 521 bp, Homo sapiens
  CDS 129..320
atatagcatctcactacaaatcctccatctcaaaacatggggcctggagtggccccccaagaccctacccctaaaacaaactggctgtggatatggtgacagattagaaagttaaacccttcaccttcatgaaagaatctggaatggagcaaacccatcatttacctaagaaggcagaaggtgagacagtcccattgctgcgtgacaccatgacactgatgcctgtctctatgaagggcacagagaagtcgaccacctccgatcgttcctcattgatgatggctacagaggggtttgatgacttgcccaagctcccacggtaagtgacttgaagctgagcagtctgactccagagcttggactcctacccaccactctgcactgcttctctgacaatgaaggagtaagacatgttccttttcctccaaggacagtctagagggaaaagacactatccatcgacaataataggctttggtaattactctaatatccactatccattgacaagttaggctttg

SEQ ID NO: 3208 - DNA, 518 bp, Homo sapiens
  CDS 178..351
atggaactttctccaagataggaccatatgataggccacaaaatgagcctcaataaatataagaaaattgaaaatatatcaagcactcagaccacagtggaaaaaaactgaaaatcaactccaaaaggaaccttcaaaactacacaaatacacggaaattaaataacctgctcctgaatgatcattggaccaaaaatgaagtcaagatggaaatttaaaaaattcatcaaactgaacgacaatagtgacacaacctatcaaaacctctgggacacagcaaaggtggtgctaagaggaaatttcatagccctaaacgcctacattaaaaagtctgaaacagcacagactatctaaggtcaaacctcaaggaagtagagcaacaagaacaagccaaacccaaacccagcaaaagaaagcaaataactaagatcagaacagaactaaatgaaattgaagcagacacagaggatttttaggccagtgaaattattcttatgatactgtaagagtggctccat

SEQ ID NO: 3209 - DNA, 505 bp, Homo sapiens
  CDS 173..421
agactccaagggttttatagctccggtagcgacacggagccggctcccccttttccagccttcctccccatctcccattctccrtcccccacgacctataccagaggtccttaggcctccacgtctctccttttgccgagtagcccaaggtttccacccatctgccagggggatggcgtccactccgatggggaatgagggggagaagaagagcagctggccatctcaagctgcaccctccttgagaggaggtccggcttcgttatctcgttctgaggaatacctgtcccagatcagtgcagaactcatggaggaggytttgtgcactgcttgctgccacttgaaccctgtgcccatcaaaaaaaagcagtcacaagaccaagcgactcagatatccaaacgcgcattcttcaccaagacctgaggcacagacacctggtgagtgaggcttcaagggagatgctctttgtcctgggagagagaacatgcctcaaaactactcttt

SEQ ID NO: 3210 - DNA, 380 bp, Homo sapiens
  CDS 70..297
attttctccgggtgagggaatccggtgggctccatttctacaaggctcacaaacgcagacaggaacaggatggcctcctgcccgaagactttctctgcagccagghccggggcaggagggtcagctgggcagcatccgggcccgcggattcctgcaaggtcgcgaggtgagaggtgcggggaggatagacctcgggctcggcgcacagggtctgggccagacgcacaagcccaaattccctccagcttcttcggctccatctttaagtccaggcaaagatcaattccctctctctcttgaacacacacatttgcagccataaataaacagctcccagctaaatcaggaaccggagaggagaaagggaaaaagaaaggaga

SEQ ID NO: 3211 - DNA, 578 bp, Homo sapiens
  CDS 102..500
agtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacrtctggtctgcaacagaaaaatgtttggatctccgtaaacacatttttgttcttagtctatctcttgtacaaacgatgtgctttgaagatgttagtgtataacaattgatgtttgttttctgtttgattttaaacaaagaaaaaataaaagggggtaatagctccttaaaaaaaaaaaaaaaaa

SEQ ID NO: 3212 - DNA, 461 bp, Homo sapiens
  CDS 149..322
taaatgcaacttccggttgadgtcactcggccaggcgccggcgacctgaggggagagggaacgcagctgaaasgtggaaactgtgtgagtaagaaactttgtgaattggtgtgtccgaatccgtcaagcacgacgtcggagaatttgtatgcgtgasgagagggacgcgctgacagtaggggcgccgcaggagagaagccgaggagcagcggagacaaccaatttgcagtttggggagggattttgtgcgggagaaaccacgcgagtccttcccccggagcggactccttgtgggttggtttccgggcccgcgatgtcagcatagcatcgtcggcctctgccccaacggcttcaagggagggactcgtcccggctgctttgcccggggaaatggggggtggaagggcctgcggtgtcgaggtgagcagtggaccctccaggaacattcccgacttcccttc

SEQ ID NO: 3213 - DNA, 444 bp, Homo sapiens
  CDS 147..335
acagatgacaactgcagcccagacgacccatggctaggataaagctggtgctgtcctaaaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaar

SEQ ID NO: 3214 - DNA, 457 bp, Homo sapiens
  CDS 100..294
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatkaggaagatgtgttcattgtggactctaaaaacaaaacaaaacacaaaatcccctgttcaaataaacaaaaaatccaagattgattcatgaaataaaagaaga

SEQ ID NO: 3215 - DNA, 474 bp, Homo sapiens
  CDS 69..359
gctagaaacagtggtgcgcggagaggagagtttttagggaacgctgctgtccctccccaggcctcgggatgtctctggcagatgagctcttagctgatctcgaagggcagcagaagaggaggaaggaggaagctatggggcaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgctgaataccgcgtcatcgtggatgccaacaacctgaccgtggagatcgaaaacgagctgaacatcatccataagttcatccgggataagtactcaaagagattccctgaactggagtccttggtccccaatgcactggattacatccg

SEQ ID NO: 3216 - DNA, 458 bp, Homo sapiens
  CDS 100..294
  misc_feature 317,430: n=a, g, c or t
attcatttcatgggtagagaactgaaacccagagaaaatagaaatgccaccacctcggtgccagatctcctagatgcccacctacagatacctttataaatgaatgtgtcaacctttctggcatacgaccagcccrcratragttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccangggttgctaccaaactttgtaacctcaaggacaaaatgaggaagatgtgttcattgtggactctaaaaacaaaacaaaaacacaaaatcccctgtttcaaataaacaaaaaantccaagattgattcatgaaataaagagr

SEQ ID NO: 3217 - DNA, 526 bp, Homo sapiens
  CDS 285..521
aactgttcctacaaatgaaagacacaagccaataaagccagtgagaaaggagcttaccaaaggcagtgtacgaagaaggttcctgggagactgtcagaaatagtttttcactgaacttcaccctgccggctaacacaacgtcctctcctgtcacaggtgggaaagaaacggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgccaggactgagcctggaatgatg

SEQ ID NO: 3218 - DNA, 517 bp, Homo sapiens
  CDS 36..491
agaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtggcaagaacaatgagaaccttgcagcagatcctcacc

SEQ ID NO: 3219 - DNA, 509 bp, Homo sapiens
  CDS 89..358
ggcaacctgctcgggtcctcttctagggtgtggaaggtttgttcttttgctcttggtactgctcactgtttgggtccatgttgcttttatgagcggtaaaactcaccgtgagatctgcagcttaactcctgagcccagtgagagcacgagcccacgggaaggaatgaacaactccagtcacgctgtcttaagagttgtaactccgcaaaggtttgcagcttcactcctgaaccagcaagaccatgaacccaccagaaggaagaaactgggaacacatctgaacatcagaagggacacactccagatgtgccaccttaagagctgtaacactcaccacaagggtctgtggcttcattcttgaagtcagtgagatcaagaactcaccaattctggacacactgtgaccccacccacctagcaattgactcagcactggaagacagttttgacacacctgtgatttcatccctgactcaaccaatcgcaatagcgtttctaactgctgccac

SEQ ID NO: 3220 - DNA, 461 bp, Homo sapiens
  CDS 100..294
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacataacacaaaatcccctgttcaaataaacaadadatccaagattgattcatgaaataaagagacatgta

SEQ ID NO: 3221 - DNA, 492 bp, Homo sapiens
  CDS 119..460
aatcagattctgcatatatttccaagttaacatgaacaagattttctgacactgctatggagtctgagaaaaaatgtcaaagggwattgccaaaattgtcacttaaagaactgcaggaatggagttggcatttacagaatttggaagagaagcaggtttagtgataaagaccagaagcacagagctaagcatattaaatattgaggacatgaagaggaaagaactgacagaggaggtgaagaaaggtgatcaggaagagccatcaaagtgttatcctggaattcaagtgaagacagtgtttcaaagtggaaatgaacagtgtcctgtaaccctcagagtgagactagagtcagaatgcaggcttttctcatttgaaatctatatgccacagagaggatccagagagcccatctccggtcagttatctgtatttgtatgtcaactacagcatcaaaaagcataggcatggrtactaaggrccccctctgtaca

SEQ ID NO: 3222 - DNA, 347 bp, Homo sapiens
  CDS 29..211
  misc_feature 171,186: n=a, g, c or t
gtcggaaggtggcgagcctgaggcracaatggcggastgggctaagccgatgaagcggagttgcagcgcctggtggccgccgagcagcagaaggcgsagtttactsacaggccacgtgcccgtagaaaagatactcatccactgtgggttttggtttcgccgtcaccccantgactcactggattntgaagatcatatgcgacaatgtatttgaaaacgactagaacattatcggaggaaggtggactctgaagtagtcgctgtagactatggatgtagaacaagggtttggagcccttcggacatggttctaacgcggcctgasttsttgstggctacatgacctt

SEQ ID NO: 3223 - DNA, 517 bp, Homo sapiens
  CDS 160..492
agatgaacatgaatttgggtaggggaggcaggaagggggaccatttctcaactcactatagtctctttttagcatcttgactctactgtgcctggatgtagctgtgtgttttgtgtgtatcctgttcatggccaatggtggcagagtctacatagaactatgcttcgtggtgttctggggaaaacctttcgacttgttgactatactattcaatatggctgtatagctcattgtgcttttgaatacgttggtggtgttgtcatgtgttctggaccatcaatggagcctacaattcaaaattcagatattgtctttgcagaaaatcttagtcgacatttttatggtatccaaagaggtgacattgtgattgcaaaaagcccaagtgatccaaaatcaaatatttgtaaaagagtaattggtttggaaggagacaaaatcctcaccactagtccatcagatttctttaaaagccatagttatgtatttggaaactaagcagttcctattaagatgctgt

SEQ ID NO: 3224 - DNA, 473 bp, Homo sapiens
  CDS 3..164
agatggtaggaaatggagacggagaaatggcactaatggcccagccacctgagatgggatacctgggagggacatcttttcaagtagaggctgtgttggggcatggacggggctgcagcataggagtctcagctgcttacatccaggtccaggattatgtctgctaacagacgctggtgggtaccactgacgatgaagactgtgtgtctgagaagctcctgaggaagactcgggaatctccactggtgcctataggcttaggaggctgcttggtggtagcagcatacaggatttaccggctgaggtctcgtggttccaccaagatgtccatacacctgattcacacccgagtggcagcgcaggcctgtgcagtgggtgcaatcatgctaggtgctgtgtacacaatgtacaacgattacgtcaagaggatggcacaggatgctggagagaagtaggactcctataggagccgg

SEQ ID NO: 3225 - DNA, 497 bp, Homo sapiens
  CDS 120..281
agttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatattaatgaagataatgtcagatgtagacaaaaataacacaataacaggagacttccataagtttgtgtattatgttagtctatgaaaacgtgcaaatgtattgtagagact

SEQ ID NO: 3226 - DNA, 601 bp, Homo sapiens
  CDS 217..462
attctcgagtcaggattggcgggcgagcggctgggacgggatgggattcttctcacggcgcacgttctgtgggcggagtgggcggastgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaat

SEQ ID NO: 3227 - DNA, 516 bp, Homo sapiens
  CDS 100..480
gcctattaactgcgccccttacagagagggatcaggacggtatgagtcctggcttcacccgcttaaagcactgtaagtggccaaattcctggtctccacatgatttctaaaggggttcgagttgtcactcattatccagcagtggatggggagggggaacaggagactggggacgtgggaaatgcagctggaagagacctcgcgctagagggtccaggccctgactccacgccccgccatcgctccccagctgacctcgtgcgtccacgcgtcctgcgcgctcctgtaccccatgcgctgggagcacgtgctgatccccacgctgcccccacacctgctggactactgctgatgccctcctctgccaaggactcccgggctctgagcggccgaccccgcttttccgcagagagtacgagaaaaagccctggaggacgtcgtggtgctgaacgtggacgccaataccttggagacgacctttaacgacgtgcaggcgctgcctccagacgtggtgtc

SEQ ID NO: 3228 - DNA, 513 bp, Homo sapiens
  CDS 198..437
accggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcagctgggttggacagacaaatattcctttgggatgtgaatactctaacagcatagactgcctcaaataacactgtcacaacttcttctttaagtggaaacaaagattccatttatagcctggccatgg

SEQ ID NO: 3229 - DNA, 525 bp, Homo sapiens
  CDS 44..244
ccaaattgtttacagaaaaagaaatactcatggccctttaggaatgaaaagatgctcggctttactcacgagagaatgcaaattaaaacaccaagacatcatttctctgtatgatattagcaacagtgcatatgttgctgaggctgcctggaaacgtgtgctcacctgtgttggtgctgagtgcggatgggcaccactcaacaccagacagaggcgtggcccactctcagaattacaaatgctttgatgtttaatccaccagtccccactctgcagattgtatgctgtagatacaccttgcacacataaaaataaaagatgaccaggtttttaatatcagagaactggaaactatactgggacctgaagcggccgtggaataaacagcgttagagtgacagaccccataagtacccacagaccagaaggtgctctgggcactgttaagtggaaaaaggaaagtacctgattcatgttacagcaggctgccttttgtgtcaaagaggataaataaaaattcacaaa

SEQ ID NO: 3230 - DNA, 548 bp, Homo sapiens
  CDS 27..536
aattcctgtcctgggcgtacgtcaagatggcggcgtctgtattaaacaccgtgctgagkcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattcgtcggaataaagttgttgggaatccctgccccatctgtcgagatcacaagttgcatgttgactttaggaacgtgaagctcttggagcaatttgtctgcgcccacacgggtatcatcttctatgctccatacacaggagtctgtgtgaagcagcacaagcggttgacccaggccatccagaaagcagggataatggtcctcctcatttaccacatcccccaaggttgaaccacggga

SEQ ID NO: 3231 - DNA, 539 bp, Homo sapiens
  CDS 27..389
aattcctgtcctgggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattcgtcggaataaagttgttgggaatccctgccccatctgtcgagatcacaagttgcatgttgactttagggagtctgtgtgaagcagcacaagcgkttgacccaggccatccagaaagccagggatcatggtctcctcatttaccacatcccccaggttgaaccacgggaccttgacttcagtacctctcatggggctgtgagtgctactccgccagcccccaccctgg

SEQ ID NO: 3232 - DNA, 523 bp, Homo sapiens
  CDS 85..252
agtctgttctcacacggttataaagtactgcccaagactgggtattttctaaagaaaaaagagttaattgattcacagttccacatggctagagtgacctcaggaaacttacaattatggcagaaggggaagacacacgtcttacatggtggcaggcgagagagagagagagcgtgcaagtgtggaaaagacaactacacttataatatcatcagatctcatgagaactcacttactatcatgagaccagcctgaaggataccgcccccatgatccaatcacctcccaccaggtctctcctttgacacgtggggattatagggattacaattcaagatgagatttggggatatgggagaaaaagcctaaccatatcaccagtaaattctcccatcttatttgtcttgaagatggtcttggctattattatcctttgactttccaaaaacatataaaaatgagtttgtcaatttacactcatatacacccctacttgttaggattttaatcagaattgcattga

SEQ ID NO: 3233 - DNA, 399 bp, Homo sapiens
  CDS 214..366
ttcttatgtgaggtggggaagggraaggtatgagggaaagagagtctgaaaattaaaatattttagtataagcattggctgtgatgctcaaatccattgcatcctcttattgaatttgccaatttgtaatttttgcataataaagaaccaaaggtgtaatgttttgttgagaggtggtttagggattttggscctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttg

SEQ ID NO: 3234 - DNA, 532 bp, Homo sapiens
  CDS 109..360
  misc_feature 277: n=a, g, c or t
gagtgcctcgagggcgccgttcgggcggggaggatcccgcgggtcccactgacccacgcggggtggggccaggggtggacgctcgcccgtacgcggtcgctactgatcatgcttgggccagggtccaatcgcaggcgccccacgcagggggagcgaggcccagggtcccccggagagcccatggagaagtaccaggttttgtaccagctgaatcctggggccttgggggtgaacctggtggtggaggaaatggaaaccaaagtcaagcatgtgatvnhgcaggtggaatgcatggatgaccattacgccagtcaggccctggaggagcaatggggtctcaccattttgcccaggctggtctgaatttctgggctcaagcgatcgtcccacctcggcctccaaagtgctggggtacaggcatgtaccaccacacccataccagaactgtttaacaaaacaaatataaattacccttaattctaccattgagagctgcccagcagtaacatactcgtttacaataatagcgata

SEQ ID NO: 3235 - DNA, 480 bp, Homo sapiens
  CDS 32..295
aatcgagatctcctgcgcgaaggccagcgagatgagcagcaggggcagccccaccgcaatgcacgtgaccatcttgtccacagccagctccagtcgcagccccttgaacttgggctccgtgggctccttcagcaagaaatccgagaacacgtactccgtggccaggtggtcgctgacctggcacgttatcatccacttcccaggattctcggctatcatttctgttgtaaggaaggtggctgggaacaggttgacgacatcagtccgatgccctctgctgatgaaggtgttaccatagaaatagatagaatggatgtctatttcattccccattccaaataggtgccaggacacagattctccaacacacatatcaggctccgggaagtttccgaagaggtatccattgagggctggaaacagaaacacgctagtgaagagactcccctgcagaggcgactgggaccagaaatgttggta

SEQ ID NO: 3236 - DNA, 580 bp, Homo sapiens
  CDS 115..411
cacttacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctgaaattgcagaagataacatatttcccttattttgat

SEQ ID NO: 3237 - DNA, 499 bp, Homo sapiens
  CDS 115..342
cacttacggccggagctgwttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagatgaggaaacagacttggagaggttaagtgacatgctcaagacaacactgctgacggggtttcaccgtgttgcccaggctggttgcgaactcctgagctcaggcaatctgtccgcctcggcctcccaacgtgctaggattacaggcgtgasaaccgtg

SEQ ID NO: 3238 - DNA, 587 bp, Homo sapiens
  CDS 115..474
cacttacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagagttttacaacagagagaaaatacagcagtcaagtataatttaaaaaattcagccaatttttctcagcattgtttctggacctttctgagggtgggatctgggcatcttcaatggcttaacaagwatcacagatgaggraacagacttggagaggttaagtgacatgctcaagatvtaactgctgggtcttgctacgtacgttgcccaggttggaatgcagtggcgtgatcatggctcactgtagc

SEQ ID NO: 3239 - DNA, 748 bp, Homo sapiens
  CDS 181..609
attacccggagtcctggttcctgggccagaccggtgtgtcgtttttggcccaagctagagaatgttaagggcttctgcggtgttggtgctagaggcgccgcgaacaggtgctgcgggggcggcgcgggaggcggtgcccttgcttccggatccggtctcagctctgggagggaacgggagatgttgcaggcgccgagagggcgggccagggccgcactccggagactcgcggttgctacgcgcaccatggctggagcgcccacggtctcgcttcctgaactccgttcactcctagcctccggacgggcccggctcttcgacgtgcgctctcgcgaggaggcggcactgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggcacgcaagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaaaaaaaaaaaaa

SEQ ID NO: 3240 - DNA, 468 bp, Homo sapiens
  CDS 187..402
aacgggagactcgcggttgctacgcgcaccatggctggaggtacctgcgggggattcctggggccgcggttctcttggtcctctgggttgaggcgtggcagggagtggggtggcggasgaaggggctggctgaggggtcttcgtgcacaccctaccgggaggggcgctgccaggtgaggggatgccatggcggccgtgactcctaggccccctcttcctgaaggctgtcgcgccccttcctcagcgcccacggtctcgcttcctgaactccgttcactcctagcctccggacgggcccggctcttcgacgtgcgctctcgcgaggaggcggcagctgggaccatcccaggggcgctcaacatcccgggtatagggtggagaggggacgcccaggtggtggaatagagaccgttcaggaggttctttgccaatgggacctcatttaggatggaatggggaaggcactga

SEQ ID NO: 3241 - DNA, 690 bp, Homo sapiens
  CDS 408..653
attacccggagtcctggttcctgggccagaccggtgtgtcgtttttggcccaagctagagaatgttaagggcttctgcggtgttggtgctagaggcgccgcgaacaggtgctgcgggggcggcgcgggaggcggtgcccttgcttccggatccggtctcagctctgggagggaacgggagatgttgcaggcgccgagagggcgggccagggccgcactccggagactcgcggttgctacgcgcaccatggctggagcgcccacggtctcgcttcctgaactccgttcactcctagcctccggacgggcccggctcttcgacgtgcgctctcgcgaggaggcggcagctgggaccatcccaagggsgskyaaaaattcccgggttccgagttggagagtgctctgcagatggagccagctgccttccaggctttatattctgctgagaagccaaagctggaagatgagcatctcgttttcttctgtcagatgggcaagcggggcctccaggccacgcaagctggcccgggagtcttggatacactggggctcgcaactacgctggagcctatagagaatggttggagaaagagagttagggcaggaggcagcttactgattgccaccccctggccccttaatggccaccttaactaagggtgtgaacgggctgacttgggtggaattgggc

SEQ ID NO: 3242 - DNA, 525 bp, Homo sapiens
  CDS 266..475
  misc_feature 504: n=a, g, c or t
acagatctgaacctgatttgtgtgtgcaccgcgtctccagcgatcccggatccactgcgctgccaggggcctgggggctgggttctcttgtctgtctctgcgacgacatccttacgtttcggcactctaatgctgggtttgtgcgtgtgtgtctgcttagcggtctagcggggctgttaggctccctcgcccccagctccttggctcgctcagctcctccaccgcagcccagcagtgagacgcgcgcgcascagctccccacgagatggaacagaccgaagtgctgaagccacggaccctggctgatctgatccgcatcctgcaccagctctttgccggcgatgaggtcaatgtagagggaggtgcaggccatcatggaagcctacgagagcgaccccaccgagtgggcaatgtacgccaagttcgaccagtacaggtatacccgaaatcttgtggatcaaggaaatggaaaatttaatctgatgattctctgttggggtgaangacattgcagcagtattcatg

SEQ ID NO: 3243 - DNA, 466 bp, Homo sapiens
  CDS 160..444
cacactgatacagaagcgggcagggaagtgttgggtagagaaaggcaggtcccctggctagggttccacccctgggcctatacccacagacctaggtgaggacaggcactcctgccttcatgcccaaatgttgcattttccaagaccaccctgcttgccatgcccccatcctgtgcctatggaaaccccaagaccctagcgggcagagacatgagcagctggacatccagaggaacacatcaactaaagaagacacaaggggctggatgtcagagcatgttagcagaagagcacaccaacaggcccgaagccatcgactggtggaatgatgcatactttgaccagggtggtcagacgagagttcgtgctgctgagcggcccaactccaggggaaaaccatctcccttctggctgccccatctgctgagagctactgtcactcaataaaactttgaacttaaaaaaa

SEQ ID NO: 3244 - DNA, 504 bp, Homo sapiens
  CDS 63..248
ctctgatcagcgatgaccagctagctaaatgtactcctgtatcaaatgaggggttcagccagatgccatctcaggtcttgtctaccactaaaatgctatgccattgtaaatgctattttccatccctatttacaatccctttaaccactgaatacaattttctgaaaaataaatattttaataaatggaagttcaatttaggggattcccattcatttgacaaatatatactgcatcaggcactgtcctaaatgcaagtattctattttgccaaatgattttcagagaaagatttacacattaattaggtactttaacagtatggcaccctcagtggagcaaaattctcactttataggtcaacagaatctgctagaagagatatccgccaacccgcagcccaggacagctttgaatgcagcccaatacaaaatttgtaaactttcttaaaacatgagattttttttttaagctcatcagccatcattagtgtatattatgtgt

SEQ ID NO: 3245 - DNA, 597 bp, Homo sapiens
  CDS 389..553
ttacagagccagggaaaagcctttatggctgagtggccatttcaacactatagccctggtctcctgacatagttctatttttttatttaattttctttgaagtctagtcatcagacctgaatttgcacttaatctctgccatttactagttgcatgatcttgtgagagttttaaaatttatgagtctggcccttttatctgtgaaatactgagattttgaaccacacaggaatgtctgtgatgcagaatttactttgcttaatttttaataagaattgctttgtataacgctgtatgggaatgcgtatttgtgtatttaagactcaaatttattcacttattggtgtcttgcctggtaggaaatgtctctatttctagattgtcttcaatgttcttatcctgcttatctgtggataatmytcttgatagtcatgtgaaggatctatcttgggaaagccaaggacatctgggaatgtttgacaggtgtgttccagagaacaagccttcagacatttgctatattgacgctgagctgtcaggggactcaggcttatgaggaggtattgttacacaaaacagtgtctagtgaagacgaca

SEQ ID NO: 3246 - DNA, 460 bp, Homo sapiens
  CDS 150..353
cattgcaaatgtgcagtgttaaaagcgtaagtacaggatactttgagagcatatctgggagtgacataattaaggttagggagttggagaaagattcccaaggaactgtcatgtatagtttaaaagtgtcttgacgtacttaggattaaatgaaaaaaatggctagtaaggtgatagacttcggaagcataacattgcttttgttggtaacaaaagtgcactttaggtggattaaaaatattcttcagacaccattcttagaacagtgtaattgctttgaggtacttgacttcagaatgttgatggtagcatcaactgttttaccatcctctgaagttaaagctgaaaccccatgagaatgatcaataatttaagtggaacattaagaatcttgtaagctatcaaagggtctgactttttctgctatcacatctacaaattgtctttgaagtttgggtaa

SEQ ID NO: 3247 - DNA, 565 bp, Homo sapiens
  CDS 157..360
  misc_feature 512: n=a, g, c or t
catcataagtcattaggaagctgcagattaaaacaacaatgagatactactacacaccaattagaatggccaaaatccaaaatactgacaacaacaaatgctgacaagtatatggagcaacaagaactcttaattcattgctgatgggaatgcaaaatggtacatccactttggaagacagtttggcagtttcttacaaaactaaacatactctatccatacagtccagcaattgcaattcttggtatttacccaaatgagctgaaaacatgtctacacaaatacctgcatagagaagtccatagcacctttattcataattgccaaaacttggaagcaaccaagatgtcctttagtagatgagtgtctaaataaattgtggtacatccaggctttggaatattattcaccatgaaaaagaaatgagctatgaagccacaaaaaggcatacaaaaaacttaaattgatattcctgctgaggcaggaggatcacttcagcctaggagtttcangatcagccgaagcaatatagtgagatctcatctctaccaaaaaaaaaaaaaaa

SEQ ID NO: 3248 - DNA, 508 bp, Homo sapiens
  CDS 217..381
cccggccttgcgtcgtaagakaatgccaagcccggggagaaggcgttccgggcctcaactttggcgtcgtgagattcttatccagaccagctcctcccagacctctccagaagaagccatgggaaccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttkccaggaaaccatactaataattaaagcagggactgagacagccattttggccacgaagggctgcatcccggaagggakgaggccataacaattgtccagcactcttcacctcccggcctgatcgtgacctcctacagtaactactgtgaggattccttctgtaatgacaaagacagcctgtctcagttttgggagttcagtgagaccacagc

SEQ ID NO: 3249 - DNA, 499 bp, Homo sapiens
  CDS 212..370
aatacatgattattttagaaaatttgaaaattactgaaaagttataaagagaaaaaattatctgcaatctcactacccagagataaccctgttaatatttttctgtatttcttttcagtctttgtctgtgctatttctatgtatgagtgtgtatacatgtgtttgtgtgtgtgtgtaataacaaacttgagattatactgaccatatagttatgtaccctgttttttataacctaacttcatacatatttacccatgtctatgaaaatgtgacttttaaaaatggctgcctaatattctattgtatgaatatgccacaatttaactacttctctctttggatattaggttgttctaatctttcaccattataaataatagtgggatagacatccttgtttgtaaaatttcatctctatattagactctttaggatatactcatgtacatggaataagtggtttagacagtgagaactttttaggctctttaaaatattt

SEQ ID NO: 3250 - DNA, 503 bp, Homo sapiens
  CDS 90..269
agattgggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaaycgttcatcataagaaggagrwttgagcgtctgcagaaaag

SEQ ID NO: 3251 - DNA, 456 bp, Homo sapiens
  CDS 90..314
  misc_feature 447: n=a, g, c or t
agattgggtgcttggscgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacttggagctaccttctgtttctttgctgtagaagccgttgtgtgaacaaatccgtttatttctctcatcagtctcctttgatagacatttgggtcacgtccggttttacgcttttacaatacatcagtgaacagcagtaatacgagctcaagacagaaggcctgaaaaaacattnaaaaacaca

SEQ ID NO: 3252 - DNA, 524 bp, Homo sapiens
  CDS 184..483
agattgggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgc

SEQ ID NO: 3253 - DNA, 474 bp, Homo sapiens
  CDS 90..269
agattgggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacaa

SEQ ID NO: 3254 - DNA, 552 bp, Homo sapiens
  CDS 91..408
aagattgggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagygaaaaaaaaaaaaaaatgcgaa

SEQ ID NO: 3255 - DNA, 482 bp, Homo sapiens
  CDS 22..339
  misc_feature 14,478: n=a, g, c or t
agaggtgcagctcnagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcmatgtcattgcccacttctgtgtagacatggttctggtttaactaatatttgtctgtgtgctactaacagattataataaattgtcatcagtgaactgtgaaaaaaaaanaggg

SEQ ID NO: 3256 - DNA, 463 bp, Homo sapiens
  CDS 31..252
aaagacgccaggggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacagagtagagaacaactggcagctttgaaaaaacaccattaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctgctaacagattataatagaattg

SEQ ID NO: 3257 - DNA, 496 bp, Homo sapiens
  CDS 125..349
agagacgccagaggtgcagctccagcagcaatggcagtgacggcgttggcggcgcggacgtggcttggcgtgtggagcgtgaggaccatgcaagcccgaggcttcggctcggatcagtccgagaatgtcgaccggggcgcgggctccatccsgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgkcatcagtgaactgtcaaaaaaaaaaaaaaaaa

SEQ ID NO: 3258 - DNA, 533 bp, Homo sapiens
  CDS 284..523
aggagggagcctggactttggaggatggggaaggcaggccagggcccggagtgggtgaagacttctcaggactaggccaggacagtgcccatccctgcagaagcccagtggccaattgakgcaggaggagctccagacaacagcatgtgaggcaggcgtggattttgtgtacaagacaaagctggaatctgtggaggtctctgcctccaaccctwacgtctattacaacacgcagctcgaagacatcattaagagtggtacggaccctgccacacccctggccatgaagaaattcgtctcccatgccacttgccatgactccctggggttgcaagaacaggaatcgtacctcatcatgggccagacgtcagacctgtggagaatcaaatctgattacagctatgttctgggcaaggagacgttcctcatcctttggccagcagatggagatgccagcaagaaagaattgcgggaccaactggaggaatttttggaatatatgcgcacccacggctgccagtcctgagcctctt

SEQ ID NO: 3259 - DNA, 464 bp, Homo sapiens
  CDS 85..396
actttctcggggtgtctgcgtaactgcccagacttgccttggtttggtcagatgacctcctctgggactggctagccagcgttcatgtctacattattgatctcgtcttccgatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcastcgtgtatactaccaatatccaggagctcaatgtctacagtgaagcccaagagccaaaggaatcaccaccgccttctaaaacgtcagcagctgctcagttggatgagctcattgctcacctgactgagatgcaggccaaggttgcagtgagagcagatgctggcaagaagcacttaccagacaagcag

SEQ ID NO: 3260 - DNA, 429 bp, Homo sapiens
  CDS 90..248
ttttggttttttgtttttctgtttcctttttcctgcctacttatgggtcacatcaatatttttttagaatctcactttatttatctgtaatgtttttgagtgtgtctctttgtatagacttcttagcaatggctgtaggtattatgtatagagtttatcacagcctattggttttgacgttttaccagttcaaacaaaatatagaagccttacctcagggccgggcccagcacagtggctcacacgtgtaatcccagcacattgggagatcgaggcgggcggaccacttgaggccaggaggttccagaccagcctggccakcatggtgaagccccgtctctactaaaaatacaaaaattggccgggcatggtggcgcgtgcctgtagtcccagctacttaggaggctgaggcacgagaatctcttgaas

SEQ ID NO: 3261 - DNA, 462 bp, Homo sapiens
  CDS 10..213
ctgcgcgtaatggcagcgccgtggcctcgcgtccatctttgccgttctctcggacctgtcacaaaggagtcgcgccgccgccgccgccccctccctccggtgggcccgggakgtagagaaaaactgccattggatgtccagaaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacaccaacagcaacaa

SEQ ID NO: 3262 - DNA, 330 bp, Homo sapiens
  CDS 36..305
ccttccgccacggccgtctctggagagcagcagccatggccctacgctaccctatggccgtgggctccaacaagggccacaaagtgaccaagaacgtgagcaagcccaggcacagccgacgccgcgggcgtcttgaccaaacacaccaagttcgtgcgggacatgattcgggaggtgtgtggctttgcccgtacgagcggcgcgccatggagttactgaaggtctccaaggacaaacgggcccctcaaatttatcaagaaaagggtggggacgcacatccgcgccaagaggaagcggggaggagctgagcaacgtactggccggccatga

SEQ ID NO: 3263 - DNA, 498 bp, Homo sapiens
  CDS 131..466
agaggcgccacccgggagaggggagccaccacggctcccgacatggctcttttcatgtgggatgcttaagcacggcacacagagagagtaacttgcaggagacagaaactggcatgaggattctgccaccatggaagggctcctgtctccgatgaggacgaagatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacaaaaaaaaaaaaaaaa

SEQ ID NO: 3264 - DNA, 469 bp, Homo sapiens
  CDS 125..427
atcttgtcttgttcccgaagaagtagaagcatcgaaagcgttggagaggtgttaccggaacgcggcgacaagggtgttcccgaactagagtggatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccaggtttgttgtttatgttttcacaattttaagacttttaaaaaacagaatgaagattattattaaatttt

SEQ ID NO: 3265 - DNA, 460 bp, Homo sapiens
  CDS 146..334
  misc_feature 301: n=a, g, c or t
aatctcctgacctcgtgatccgccttcctcggcctcccaaagtgctggggttacaggcgtgagcacgcgcccggccaaggcccggttttagaggcactaagtcttcctccaccctgccctttacactttgaagcctatactgtatatgtcgatagggttagagaatccattccaggctcggggacccagaggcctggctgcagctgggcctggctctcactgcatccctcctggcacagtactggtgtggcatactcggacagagaagcccaagatgaagcaggaggagcagctgcagcgncagggccggggctcagacccagcaattgaggtgtgatggcggccccaccccaactaccacctcttttcaggcacagaccttgtgggactgggccccaggctgcccaggatgtggttttccaagtcctgacccttggagccagaagtggcccctctgccc

SEQ ID NO: 3266 - DNA, 511 bp, Homo sapiens
  CDS 164..346
caacagacaatgtagaaaataacagagaaaagaagggccaatcctggatcgatgatgactactggtagcatgagtcatatacagtgaatacatgtctggaactctgaggtctgtctcaaaagatatctagtctatttcctgtttcaaatgatcctacagacagatggcaaaaaatagaatgtatatgtgtttggttttcatgtttatgaatttttattttacatttatgattggctcaatcagagaatcagttaataaatatacaaataaagatgaatgggggccgggcgtggtggctcacgcctgtaatctcagcactttgggaggccaacacgggtggatcacttgatgacaggagatcgagacctacctggccagcgtggcgaaaccctatctctactgaaaatgcaaggattggccaggcatggcggcatgtgcctctaatccgaggacttgggtggctgaggcacatggattgcttgaacccgggtttcaaaaattgcttgaaccc

SEQ ID NO: 3267 - DNA, 425 bp, Homo sapiens
  CDS 76..333
cacttctaaatttttagcaggattctagaagttatcctttctatgtcagggatatagtctagtgtgtgttaagatatgtacttggatatttttagggtctctgtccaggaaaccccctgctgttctaacaggagaagttgggttttggcctcttttgctagagatgggctcctgttttctttgccttcttctgtcttgttcataaccccagtgatagtgtctctcgtgaaacagcccttatgctgtagaccaagaatgtgtgtatcaggggctgacgtcactcccagtttatttagccatccctgcattcacactttgtttcattttttaaaataacttcattggggtaaaatttatgtaccatgtaattcacccacttaaaatatacaattaattttttttatatattcacagagttttgcagc

SEQ ID NO: 3268 - DNA, 453 bp, Homo sapiens
  CDS 183..383
caaatgtttctgtctttaaaaactctcttatattttacttttaaaactatttttatctaccagttggtcagtaaaagaaaaaaagaaaactatttttatgacatactaatcttggcaaaaatctattaatttaacattgtacgtgtttttttttcagagattgtctatacttcttggttcacatgctttttaataacataaaaacaaaaacagccaggtgcagtggcacaagcctgtggtcccagctactcgggcgtctgaggtgtggatatcccttgagtcaagggattaaatccagcctgggcaacataaggagacctccatctcttaaaaaagacaaaacagtaatgttaaagccaaatgataaattgatatatttatcttaaaacttagcattaagtttttgaaaggtaaaaaaatatctctatagttctcacttttcacttgatgaga

SEQ ID NO: 3269 - DNA, 503 bp, Homo sapiens
  CDS 158..310
atgtgaggattagcagtcagtccttctgtgtccacctattgtattttttcccgtactaattataaaatgttgtataaaatgtattctttcattgtatacaatctgtgtgcttagtaaaagaagggtgcctcctcactgttcctcacatccttctgccatgactttgcaccattccaaatactgcttatatttcaaatcagtttacatcctgcccccttacagttccttccctgaaaatcccagcccacacttcaagttgttcttttggtctttattaaaactcactgctaataacacaactttaaatagttaattctgttgtgtattcaaatagttttggctgacacctgtaatcctagcactttgggaggcccaagggggcggatcacctaaggtcaggagtttaagaccagcctggccaacatgatgaaaccccgtctctactaaaaatacaaaaattagctgggcatggtggcgagcgctgtaatcccagctactcggga

SEQ ID NO: 3270 - DNA, 415 bp, Homo sapiens
  CDS 54..248
acttctgacctgcggcccgtagtccgagccggggacggcggcgtcggtgggtcatgctccggcactccccctcgctgtgggagctggtggaggagcacgttccgctccgggagcgacgcgaagtgaagaggattctggggggaggcggcggtggacctgagcctggagctgcgggcggaggtggcgatgttacgggcactgctccaagaggctcgatcctctcaagcccccagctcccgccccatctctgacccctcttctcttctggcaccaccgcctctcctaaaggacctcttgcgccaggagctccggcagttgctccagggtctccgccacaaagccatctgtgagggcagggaccaggsccaagcttgggtccagtatagcccccarggtcctgcactttgccttggag

SEQ ID NO: 3271 - DNA, 529 bp, Homo sapiens
  CDS 33..239
  misc_feature 475: n=a, g, c or t
ccttttcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggcctttamtcsttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgttttggctcgatattataagaccaagcgagtcctccctcccaattggaaatatgaatcatcctacagcccntctgcactggtcgcataaatttgtctgtgtactcaagcaataaaatgattgttt

SEQ ID NO: 3272 - DNA, 353 bp, Homo sapiens
  CDS 67..285
  misc_feature 272,275: n=a, g, c or t
gagctctcagcgggascgagacggtgcagggcgggagaagcaccttcactcccagcctgcgccccgatgctgcgcgttctgkgcctcctgcgcccctggagccccttcgggcccgcggctgcgcttccgacggggcggccgggggctcagagatccaagtgcgcgccctggcgggtccggaccaaggctgtaggttccatgaggacaggccttgagtctgtcctggtctctggaatcacggtgtctagtagaggccagcacacagcaaatanatndvtgtrchratgagtgaatgaagagaatctgattggccttaaggaacttacgcacttaaaataattgggcagaagaga

SEQ ID NO: 3273 - DNA, 401 bp, Homo sapiens
  CDS 27..218
atttcgaaggaaagtaactcaggaacatgatagtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatggtgagatttaacatttagaggtgacagcatcccccacactggcagtgaattttttgtgctacaaacttggcmaaagtctgtgaaaagaagtttcaacttcatgtgttattaactatacaaatattagttgaatgaattgttgaattacatgattacctttgaggttttttttttttycsggcaaggggggggggaaat

SEQ ID NO: 3274 - DNA, 447 bp, Homo sapiens
  CDS 147..335
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaaaa

SEQ ID NO: 3275 - DNA, 461 bp, Homo sapiens
  CDS 146..433
gtgacgttccctacgcggtcgggcgttgggtttcgcggcgctcgssactggttgttcagcaccttcggtccggttgaggttgtcaagtcggaccaaacaggttgtttctctgcagtttccaacatggcagggaggtttaatagacatggataagaagtccactcacagaaatcctgaagatgccagggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaawagaaaggttagtaattgtgagtaatataagaataagatttggctattag

SEQ ID NO: 3276 - DNA, 628 bp, Homo sapiens
  CDS 123..404
gttgggtttcgcggcgctcgcgacctggttgttcagcaccttcggtccggttgaggttgtcaagtcggaccaaacaggttgtttctctgcagtttccaacatggcagggaggtttaatagacatggataagaagtccactcacagaaatcctgaagatgccagggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaaaagaaaggacaaaatatgaaacaccaagaaaaagagaaggaaaaaaaggaggaaacaaccacatatgtcacctttccaagagggactgaaactgggctgacccttttgatttccaagctcagcgttttggtgtaaggcggccaaagaaggatgcggagccagcactgtgaagcctacaaaaacattgatgcgctggcttggggatttgaatttgaacatctttcacactaagttcagacc

SEQ ID NO: 3277 - DNA, 475 bp, Homo sapiens
  CDS 32..223
  misc_feature 421: n=a, g, c or t
gttccggtgggctcgcgttgaggctgcggtcatggagggagcaggagctggatccggcttccggaaggagctggtgagcaggctgctgcacctgcacttcaaggatgacaagaccaakaagcagcagtccgcggcgtgcggcaggcccaggcagaagacgcgctccgtgtggacgtggaccagctggagaagctcctggacttctagggatctcagccgtggctgaggccacccccagaggagcccctggtccacagawkcaggccttgtgtttccagcggcctctgataagaggcagggaaggacctgaaggatttggagttgattcaaacaagatctctgggagtctccagcctgtgcagaakgggcaggactgcagtgcactgcgggccttggagtgtccagtggggacactggtgtnggaaggggsagcacctggggagtccckgcctctcctccctgggacaatagtgtg

SEQ ID NO: 3278 - DNA, 476 bp, Homo sapiens
  CDS 268..420
  misc_feature 92: n=a, g, c or t
tagccatttgcttagcatgttctaggcacttacctaagtatttaatgatgagtcattgcatgaatctagtaactttcttttgagtggctaanctctcaaaattaatagtgtaacttaaatgtatgtgtaatggtgataatatcgtactcccttattagcatatatttctttgaaaaagcaaggaattttctcaagatatatggtataggtttcctcatactttttatgatgtaatatgtattggtttactgatattttttcagtctcatgtgtattttaagagccattatagttgactgttggaaaattgggttttgtggctgggcatggtggctcacacctgtaatcccagcactttgggaggccggggtgagcagatcacttgaggtcaggagttcaagaccagactggccaacgtggtgaaaccctgtctctactaaaagtacaaaaatcagcccaacatggtggtgcacacc

SEQ ID NO: 3279 - DNA, 527 bp, Homo sapiens
  CDS 284..448
agcacaagagctctgccataaaaggacattggacagaagtgaagagtccaatcagaaactctttttgagagactgaacgcaaagcattcagagagtcagcaggctggagaggccaagacacacacacgaagaaggcaatgaggaaactgaggtacagatgggaaacttgctcaagttcacacagcaattaagtgatcaagtccaagagcaaaaccaggcaggctggctccagagctcacgatagtccaccactgctttccaccatcactacggaatcaagtccatgaggatactcaccttatgtcagttgcctaagttggaaattatagaatcttcaaattggaagggacgttatcatccaagatttcaactttctactcactgcaaaatcccttctggaacttcccagattgatgaattttcatcagctctgcttgagtactcccagtgacttggaaaaaaaacactgtaatatggatatgaaatataaactgttcatggataaattattgcataataaaaacatg

SEQ ID NO: 3280 - DNA, 505 bp, Homo sapiens
  CDS 53..208
agtgtgctgggtacaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcagtggttttacgcacgacgagctgctgaaggtgtggaaaggactgttttattgcatgtggatgcaggacaagccactcctccaggaagaattaggaaggactatttcccagctcgttcatgcttttcagaccacggaggcgcacacctgttccttcaggccttctggcagaccatgaatcgcgagtggacgggcattgacaggctgcgctggataaattctacatgctcatgcggatggtcctgaacgagtccttgaagttctgaagatgcaaggctgggaagaaagmagatcgaggagctgctagagctgctgatgactga

SEQ ID NO: 3281 - DNA, 513 bp, Homo sapiens
  CDS 128..376
atctggatatttctcacatttgccttggtttgatgctcctggagttcccaaaagaatagagatcactttatcaagcttgcagaacaggttgcatgattgttgtgctgctgcttgctagtaaaagtttatgcttgtagaaagaaaagttaatgggctggtgccgcggctcatgcctgtaatcgcagcacattgggaggcccaggtgggcgcatcacttgagggttccagcatcttggacagagctgttattgawcacaatttgttgtctgcaagcaaattatataataatattaccttcgaagaacttggagctcttttagagatccctgcagctaaggcggaaaagatagcatctcaaatgataaccgaagacgtatgaatggatttattgaccagattgatggaatagttcattttgaaacacgagaagccctgccaacgtgggataagcagatccaatcactttgtttccaagtgaataacctttttggagaaaattagtcaaacagcacc

SEQ ID NO: 3282 - DNA, 486 bp, Homo sapiens
  CDS 108..431
agtgaggaaatcatgggtcagaatcgagagatgcttccgttttggatgaacagcaccggcagcgggaaggttggcagcgtggatggcacggctacgacaacgagctcatggacatgcggggcatcttcctggccttcggacctgatttcaaatccaacttcagagctgctcctatcaggtcggtggacgtctacaatgtcatgtgcaatgtggtgggcatcaccccgctgcccaacaacggatcctggtccagggtgatgtgcatgctgaagggccgcgcggcactgccccgcctgtctggcccagccactgtgccctggcctgattcttctcttcctgcttgcataactgatcatattgcttgtctcagaaaaaaacaccatcagcaaagtgggcctccaaagccagatgattttcattttatgtgtgaataatagcttcattaacacaatcaagaccatgcacattgtaaatacattattcttg

SEQ ID NO: 3283 - DNA, 555 bp, Homo sapiens
  CDS 245..421
agcggcggcggctccgaagcgcttgttcttttttgtgaaaggcgattcctccaccacctcttaggatcttgggcaagtcactcagcctcgctgagcctgtttgcatcagtagggttttgtgaggctccagcccttcaacagaacatttgctgagcatctactgtgtgcccagcagggccttcttagatcaggtataaggcaggagggaagcgtcgggagtcccaggcctgctgcctctgtaaccatgggcaggtggttcaacattacctccccttcttccccactgctctgccccatcctggcttttattgtatctcctctaaaagggtgtgagctccacggggaggtacccatgtgctttgaggaaggtctgccccagtttatattcaataggtactttttgaataattattgcaaagactagttctcagcacagagcttaacacataggaggtgtttgataaatggcaattgttcatgcaataaagaacaatagcaggccaggtgcgcggtggctcacacctgtaatcttagcactttgggagtctgaggcag

SEQ ID NO: 3284 - DNA, 471 bp, Homo sapiens
  CDS 45..197
aaattgctttggcttccacacagctcctgtcgcttcaagtgcggatggttaatgggacctggactggaaaaggattgtttgtgtgggaatcattcatggcaaaggcagtgacacctccttcaaaaacctgtgtctttctggcagagtgttgctggagatggccactggagagsctgagtcaaatcaatctcctcacctgaggacttcctaagaccagcgcactgaaggaccagcagcaacaacaacaataatgctaatgctcccttatggacaagactgcaattctctgcctgctgaagctcagctatgaccacgtgacttgccttggccaatgaaagaggaagagtatgtaacactgctgaatggaagcaagtggcccctgcccctgctgcagagattctagacatgtgtgccatgctggagcaaggagacagggagtcctggagaaaggagacatggaacagagctccc

SEQ ID NO: 3285 - DNA, 468 bp, Homo sapiens
  CDS 18..260
gacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacagttctgatacaacaccccttttaaatggatcaagccaagacagaatgtttgagacaatgcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaagtgggtct

SEQ ID NO: 3286 - DNA, 526 bp, Homo sapiens
  CDS 83..250
agtacattcaggctccacacaggacacagcacacataatactgcctssgtttccccactgcgagcccttcgagaacaatgtcatgttgatcgatggcagtgactcacaccagacctttccatgcmtcctctgcaaggactcaagagaktcgagagcaaaaccgtgccatagttccataaggagggcaaagagctttatccamrctgaggaacaggcggatcatgcggctacagcactggtctttaccttttaactgcttgattcgaaacattccagccaggaacagtggctcacacctgtaatcccagcactttgtggggccaaggcaggtggattgcttgagctcaggagttcgaaaccagcctgggcaacctggcaaaacctcatctctasraaaaaatacraaaattagccaggcctggtgtgtgtgcctgtggttccagccactcggcaggctgcggccagaggatcacttgagcccaggaagtggaggctgcagtgagctgagatcgtgccgscacactcc

SEQ ID NO: 3287 - DNA, 479 bp, Homo sapiens
  CDS 16..282
taagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcscaagtmsttgttacctccttttcstgctgcccagggaagagtgtgtgtgctgggctggagcgcttgcactcttcaggtgactattctcacctccatttcctccacatgcattaggtgaaactgaggtctaagcctcctgcaagtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaa

SEQ ID NO: 3288 - DNA, 482 bp, Homo sapiens
  CDS 153..410
agaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaataasaagaggaaaagaaaaaagaaaaaagcaaagaaaaaatcaaattgaaaaaaaaaaggaaaaggtcttactcatccagttcactgaagaggacacttcaaaacaaaaggamcaaaa

SEQ ID NO: 3289 - DNA, 489 bp, Homo sapiens
  CDS 34..462
  misc_feature 75: n=a, g, c or t
aagtctccagcctgaagcggaagtggaggaaagatggaggaccatcagcacgtgcccatcgacatccagaccaknaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttaggtaaagtggcccggcctgggagccctggtatccatggggaagcccactctcagagttctgagataccaggcttgmtaggaggcacagtctgtgagtgagaagagactggagtgtagatgttg

SEQ ID NO: 3290 - DNA, 489 bp, Homo sapiens
  CDS 34..186
atacttttcaatttgttgtccttcttccacttcatgcgccggttctggaaccagatcttgatctggcgctcggacaggcagagtgcgtgggcgatctcgatgcgccgtcgccgggtcaggttgcttgtctggagatggagccactacaggcgggcctgggcgcctggagtcgggcatgaaagaaaatagcgcctcatcgctcttatctaagcccagaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgccctgcgggtcccctcccttggctgagaagaaaaccaaataaaccttgaacagccttgaaaaaaaaaa

SEQ ID NO: 3291 - DNA, 270 bp, Homo sapiens
  CDS 34..186
  misc_feature 124,175,200: n=a, g, c or t
atacttttcaatttgttgtccttcttccacttcatgcgccggttctggaaccagatcttgatctggcgctcggacaggcagagtgcgtgggcgatctcgatgcgccgtcgccgggtcaggttgnttgtctggagatggagccactacaggcgggcctgggcgcctggagtcgggnatgaaagaaaatagcgcctcatcgntcttatbstaagcccagaggtagadvttcgcttgaaaagatcgagaatggaggaggggatcggdvactca

SEQ ID NO: 3292 - DNA, 435 bp, Homo sapiens
  CDS 34..186
atacttttcaatttcttgtccttcttccacttcatgcgccggttctggaaccagatcttgatctggcgctcggacaggcagagtgcgtgggcgatctcgatgcgccgtcgccgggtcaggttgcttgtctggagatggagccactacaggcgggcctgggcgcctggagtcgggcatgaaagaaaatagcgcctcatcgctcttatctaagcccagaggtagacttcgcttgaaaagatcgagaatggaggaggggatcggcactcacttgcagacatcaacagtttccagaaaattcggttcaattccttcaccacggacccaccaaccaaggagctggcaaaacccactaaccaaccaggagaacacagacccggtttgtcttttgacaaccgagtggaactgacggggccggcgcctgcctgcggtcccctc

SEQ ID NO: 3293 - DNA, 460 bp, Homo sapiens
  CDS 171..416
acaacacttggcctctcgctggccctgctcgcggatcccgagtagagaacgcaagcacccasgsscgcctgcwactcccgggcgcccccggcctctcctgctcggcggaacgaggataacccagtagagccggacccagggatattattgataataaggcctctgtaaccatggctagttctgacgtaaaaccaacatcagtaagtcatgccaaaaaatggtcagaagagatagaaaatctgtacagatttcaacaagcaggatatcgggatgaaaccgaatatagacaagtgaaacaagtttctatggtagatcgttggccggagacaggatatgtgaagaaacttcagagaagggacaatacgttctattactacaacaaacagagggatgtgatgacaaagaagtccacaaagtgamaatttatgcttactagcctgtcttctttgtattacttgtc

SEQ ID NO: 3294 - DNA, 450 bp, Homo sapiens
  CDS 138..296
ttttttctttctgtgtgtttctccattatgttgttgcatttttctctatttacgttatctccctttccctttttctctctgtccctccctccttcttcctctctattcttcccctccccttgtttttatgcctgattatgtggacacagacaaggattaaaacagggcacctgcccttgaggagtttacaatctgctgggctgaggatcaacacatgttcaaaaagagaggaaagaagtcaagggagatcatgccagatggacttaatttcaatgaagaacaggagtcctaaagattaagaagagagggaaatgcaaatcaaagccacaatgagaagtcacttcctacctactaggatggctatavtaaaaaagatgaagaaaaaaataagtcttggcaagaatgtggagaaattgtcatcttcgtgcattgctggtcttcctgsctgta

SEQ ID NO: 3295 - DNA, 573 bp, Homo sapiens
  CDS 155..421
gtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaagattggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaa

SEQ ID NO: 3296 - DNA, 461 bp, Homo sapiens
  CDS 67..306
aaaaatttaaaatacatttagtgtagcctaagtttatagtgtttataaaatctgtaatagtgtacaatgatgtcctgggacttcacattcactcaccactcactcactagctcatccagagcaatttccagacctgcaagcttcattcatggtagatgccccacagaggtgcactactttttgtcttctatgctgtattttcactctacccttcctatgtttagctatgtttggatatacaaatattaccatgttacagttgcctgcagtattcagtacagtcacatgctgcacagattggtagcctaggagcaacaggctatgccatagagcccaggtatgtaatgggctgtaccatttaggtttgtgtaagtacactctatgatgttcamacaatgacaaaatcccctaatgatgtgtttctgagaacgcatcactgtcattgagcatcgttgtgtatt

SEQ ID NO: 3297 - DNA, 509 bp, Homo sapiens
  CDS 33..329
acagtcccgcctcttccgctgcgtgccggaccatggcgcaggggcagcgyaagtttcaggcgcacaaacccgcaaagagtaagacggcagcggcagcctctgaaaagaatcggggcccaagaaaaggcggtcgtgttatcgctcccargaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtccccagcactgggcttcacctagaacttcagtgggggccaagggtgctgagaacccagcaatgaccaggaagatacag

SEQ ID NO: 3298 - DNA, 360 bp, Homo sapiens
  CDS 26..331
acggctgcccaacccggtcccagccatgtccgttccatgtaaacctgctgtgcggggaggagcagggctcgatgccgcgctgcatttcaacccccggctggacacgtcggaggtggtcttcaacagcaaggagcaaggctcctgggsccgcgaggagcgcgggccgggcgttcctttccagcgcgggmagcccttcgaggtgctcatcatcgcgtcagacgacggcttcaaggccgtggttggggacgcccagtaccaccacttccgccaccgcctgccgctggcgcgcgtgsmtbrgtmgaggtgggcrgggacgtgcagctggactccgtgagatcttctgagcagaagcccaggcgg

SEQ ID NO: 3299 - DNA, 459 bp, Homo sapiens
  CDS 50..199
ttcttaaagaagctagataaagaaaggcagccggattaaaacaaaatgtatgtacagaggaataaagataaaaattatagcacaattcttatataacctatgcacgcagaagacagtggagtcacatcaagtgctgagagaaaacaaaacaaacctgccaacctgggatcctatacccaataacaatatctttcaaaactaaaggcaaaacaaagactttttagacaaacaagagctgggaaaattcattgctagttaacctgcactacagatggaggaagtgtgttgggcagaaggtgtatggtaccaggtgacatttggatctccacaaagaaatatagagtacctgcaataatgtaaaagccatcgaatgtaaagacattgcatgtctaaagccaaaacaatgcaaatatattatgagatttagaacatgtaggaataaagcatatgacaataatt

SEQ ID NO: 3300 - DNA, 450 bp, Homo sapiens
  CDS 211..426
taagaaatataatttacttaatttgaaatttcctgtgaaattttgaaacttactttgaaactttgaaagattattagcaattttccaaatagtttaacttcattattaagtgtattcaaacttcacagaagccagtatacaaagggaaatcccagatttaagtgatgagtttatataccattgtttaactggtcctctgagtgatcctgcatgattgataatccacactactgtctctctagacagaagacagactcagtaaggaaatgttttaagtgggtaattctgatatctgccattacaaaaacaacgacgaaaaagcaaatatttcttcttatttcttatcagcaaaagaaaggaatgaggtgtactggaattcctagcactgtgatactcaaaatgtcagtttttaaggcttttgtgttttagggraacactcaaagaaaaaat

SEQ ID NO: 3301 - DNA, 542 bp, Homo sapiens
  CDS 334..519
ttttatgttaaccagacacatatgtccctatgggtttattttcttcacattttgttttaaagtatgtttcaaataaacaattttggttatatcaaaaagttctaagaagtggctactgcaaatttaaatgttcttggtgcagtcatgctgattagaaagaaaagttcaagagtaataacacaaaagcaagtgctggaaggtaacacaaatttattagcaggttatccattagagactggctgacgaccagtcaaaagcaaaagtatctcttgtgcccatctttgattctcaatgtaaggtcaagctgcccctgtctgctgacctgagaaatcgatggttcccatggcaagtagaatttgtggacagaaaatatctttaaaagccaatcttgcatacataaaccaaaccaagataagtgttgataacatgttgatgaataatacaacaaaatttatcctgaaaagacaatgtgtaaggagagctttcattcttcaggctcagctggaaagacatttattataactacatttgtcttgaacttc

SEQ ID NO: 3302 - DNA, 418 bp, Homo sapiens
  CDS 83..412
gtaggggagcggaaaaggaagtcaccaccgtggcctgcgacggaccctttccagctttttgcctgaaagctttgcagaagaaatggcgaaaagtcttttgaagacagcctctctgtctggaaggacaaaattgctacatcaaacaggattgtcactttatagtacatcccatggattttatgagggagaagtgaaaaaaacacttcagcagtttcctggtcgatccattgaccttcagaaggaagacaatggcattggcattcttactctgaacaatccaagtagaatgaatgccttttcaggtgttatgatgctacaacttctggaaaaagtaattgaattggaaaattggacagaggggaaaggctcattgtccgtggggcaaaaaatactttctcttcaggatctgatctgaatg

SEQ ID NO: 3303 - DNA, 462 bp, Homo sapiens
  CDS 204..362
tgcagttttaagcaggttgactacttgctaaaatagatgatttaaataggaaccggagtgtcatagtataataatgttcaggatatggcccaaaattacttgtcatatgaaaaatcaggaaaatagaaactcaacagatgccaatattgagatgacacagatgtggaatgattgacaaagacttttaaacagcttttgtaaaaatgcttcaacaagcaattacaaacactcttgaaacaaacaaaaacatagacgaccttaggaacaaagtagaaactataaagaaccaaatgaaaatgatagaactgaaatctataataaccaaaattaaaaaaatattatatgggctcaatagcagcctatagaaattatagagaaatgaacaggtcaatttgaagatagctcactagaaattctccaatacaaataatggagagaaaaatagaaaaaatgagctctgct

SEQ ID NO: 3304 - DNA, 486 bp, Homo sapiens
  CDS 142..300
cttagatgtaaaaatgagatctcaatagcagcgggctgggcacatcctctcctctctccttctctctctgcccggagctggtttccgtctctcggctcggggctggaactccggcccaacctaggcgcgcascgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaaggcaattccaaaggtgaaaacgcagccaactggctcacggcaaagagtggtcggaagaagcgctgcccctacacgaagcac

SEQ ID NO: 3305 - DNA, 460 bp, Homo sapiens
  CDS 137..358
agcattttgggaaagagtggaattctgggtgttaggcccgccattcgcttgactcacgccttcgccgtagcatctttcgcagcggaccgaagagaagaaaatgtaggccagatgccgaactctcttcctgccmaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgccctgacatgctgaagaacgcacccatgttaaaagagcatgaaaaataaaaaaccaaggctcaggggctggccgaggaaaagctgccattctcaaggccaagtgg

SEQ ID NO: 3306 - DNA, 478 bp, Homo sapiens
  CDS 152..430
agacactctaaccctctggcccaagtcacctttctatcaggggagggaggctgtgctctcactggcttcttgttagaagttctgcctgccctacagcctgcactgagggctctcatcactgcttctgagatcttaatgggggtcaacgaagatgtgggcttctctgagtttagaccatccatctgccaaggaaaaccaagccctgagactgatagagatgagagaagagaatggtaatgtccccaagacagagcaggcaggaagtttgaagcctctgagggatacaggaaaatctaacctcaaagagaagaagatgaatatcaacaagttgtgtccgggcttgggtggtgagtgtatgactccagatgttatgctgctccagcagaaccagtcactcttgtggaagccaaggaatgggaacagaagaatatgaaatctgtggtactgatcatcagtcttaatatccaaatgaatatca

SEQ ID NO: 3307 - DNA, 471 bp, Homo sapiens
  CDS 103..354
ctttagctgtaactccggcgggcgtgttgggtgtgtcgttttaggctctgtgacccaggagcaagacgcaataagcgggtgcagtggaggtagaaacgggaaatgcagtaccctttccggaagctactccgcccctcgacagagtcttgctgtgtcgcccaagctagagtgcagtggtgtcatctgggctcattgcaacctccacttcctggattcaagcaattctcatgccacagcctcccaagtagctgggactacaggtgcgcaccaccatgcctgactaatttttgtatttttagtagagacagggtttcaccatgctggccaggctggtctcgaactcctgacctcaagtgatccacctgcctcagcctccgaaagtgctgggattgcaggtgtgagccaccatgtccgcccattgaaaagctctttaaatattgaatgctcatgtttgaaaaaatataacctatg

SEQ ID NO: 3308 - DNA, 524 bp, Homo sapiens
  CDS 24..464
  misc_feature 515: n=a, g, c or t
gacacaaaacagaagatgagagaatgggtggctgtatgcacagtacccaggacaaatctctccacttggaaggagatcccaatccttctgcagccccaacatccacctgcgcacctaggaaaatgcccaaaaggatttcaatatccaaacaactggcttcagtgaaagctctgaggaagtgctcagatctggaaaaagctattgccaccactgctctgattttcagaaattcttctgactctgatggtaaacttgaaaaagctattgccaaagatctgctgcaaacccaatttaggaatttcgcagagggacaagaaaccaagccmaaatacagagagatcctttctgaacttgatgagcacacagaaaataagctagattttgaagacttcatgatcttgctcttaagcatcactgtcatgtcagatctgctacaaaatatacggaatgtaaaaattatgaaatgaacagttttaaatatgctgtataaaataatggcaaaagacagtggttanttaaaaatg

SEQ ID NO: 3309 - DNA, 309 bp, Homo sapiens
  CDS 13..243
tatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaaaaaaaaaaaaaaaaa

SEQ ID NO: 3310 - DNA, 358 bp, Homo sapiens
  CDS 62..268
taactcacctctttattctgtggtcttttctgaatagaaatgtatgccctaggawgaaatcatgctgggttttgcttttagagataaaaggtggtggatttattttgcctgcagtawagattctcagggtgtcagagcagcatattgtcaaatcctgcttctgttttatgtttcagtgtattcactttcattttcttacttactagaccatttctgcagtttgcccaaacctctactgtttgggacaagwagccaaatacctcatttttaaaaagaagttttcatggsatcagtgttaatmaagkacatttttaactgagtcttaatctcyawttgragaaaaagtagagacaaaagk

SEQ ID NO: 3311 - DNA, 444 bp, Homo sapiens
  CDS 101..286
aaaaaacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtagkagtgccaaaaaatgcgataaggaggaaaaggccgaaaaggcaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgattctggagaagatttctgctttgatg

SEQ ID NO: 3312 - DNA, 932 bp, Homo sapiens
  CDS 362..562
atcacctgaaatagatgttcacatttcgttcctgtttctcacaaaggatgatgctcattccaagattttctgttttatttctgtcttttgcaatcgttggcctgctttgctgccataaatgagggaattgtggctaagagagcaatctgccggaagcatctcctcatccatcggtggacactaaccacagctataaccgggacaactagagacactgtccaagtcctctgtcaaattcacaacttagcttgcccttaggtgtgaatacagactgaccccagggccggaggggctgctgttgtgagcctttcctgctggaggggcctaaggactcagttccctttatctaagacaaaaccgaatggagacagtaagagcccatcacactccaccctccctccctcaccttcttgcagagctggtagagtgtagtggccaagagcaggtcctctgcggtgtcacaattggagactcttctgaatccatccctcaccaactcagtgaccagagctggttacccaacctctcagtgcttcaggtttggtttgatgttttcaatctctagaatgcaacagtcgtagagttggtgagaagattatgcagctgtgctgaggaaagagtaagagctcaaacatgtcagctgtcattcaaatgtcactacaatggccttttttcaagtgtgatccacttgcaccaaaattacctgaggtgcttgtgacaaggatcttacagattcagtctccacggaaggttccagaagtgttttagtgatcgaggcaggggctctacagtcagacagacccaacttcaaatcttaccttgcaccttagttagatctgcgtgatgtgcaacaagttaatgcatttagcttcttggagtctttgtttcaataaattaagacattaatatcgaaaaaaaaaaaaaaatgcgaa

SEQ ID NO: 3313 - DNA, 549 bp, Homo sapiens
  CDS 302..499
  misc_feature 374: n=a, g, c or t
ttttgtttcttcggggtttattgaaggggctaggggcgggacgggattcttttcagttttgtatarwawcaaagtttactcatgctttatattatattgtgattgcaagcgttataagcgtgtgccactggcctcctattgttgatgcttaggtaatggaggcctgtggtsmgttttatggtgacttgggcatgtcttattcamwaacaaaaacataaaacacagawacctttcttcagcataccaaggcaagcagccatttcatgactcacttaacacattgcagtgtaccagtttacagatgatttttccctttttgcgtgacatggcagttctaacccccagagaattccttatttgtaaattggaawrrnttctactatgccttacagagcttaaattcagaagtttttgcctcatatctgaaacaaagggaaataacacacccattcaaaagtwaataaatctcctagaagtttttgtttttaacatttccatataaagagctctgttgaatgtcatgaatagactggmwaaaaaaaaaaaaaa

SEQ ID NO: 3314 - DNA, 472 bp, Homo sapiens
  CDS 26..190
  misc_feature 309: n=a, g, c or t
atccatctacaaggtttgcgaacccatgttgccgatttttttttctgctacagaacaactcccttggtacaataaaaaagacgagtatttacttttcattgaaagtggagaacctgaaaaggaacctggaaagaagcagctggaaaaggtgagaggaaaacctagagtgtgtgtwatcctgcaagccaattgagaatggagcttgcttgatatttcactagataaagaatttaaggcgagtatctatctttgttctccttggcaactgagagtctgcccttggaaacatcaggcaccatggggaagcgnbataatcgggtagcctatatgaatcctatagcaatggccagatggagaggcccaactcaatctgtgggcccaavmatccaagattatctaaatsgaccaagacccacctgggaagaagtaaagaaacaattagaaaataaaaaaacaggttcaaaagcattag

SEQ ID NO: 3315 - DNA, 541 bp, Homo sapiens
  CDS 72..302
ccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatataatttgttaagtgggtttcagtttgctaatagggattttttgtgttttgttttttaattttcagcatctcttgaagaatcttgctacagccaaatggcatctcactttttaaagacsgtttgcaattattagttgattcacagtacagaacaaggtataaaggaaaaaaccctgctaggtagtgttataattgctagattaaaaatagactagaacaggttcattttaagatttactt

SEQ ID NO: 3316 - DNA, 511 bp, Homo sapiens
  CDS 183..461
gaaatcataacagtctctcagaccacagtgcaaacaaattagaactcaggattaagaaactcgctcaaaaccacacaactacatggaaaccgaacaacttgctcctgaatgactactgggtaaataatgaaattaaggcagaagtaaataagttctttgaaaccaatgagaacaaagacacaatgtatcagaatctctgggacacagctaaagcagtgtttagaaggaaatttatagcactaaatgcccacaggagaaagcaggaaagatctaaaatcgacaccctaacatcacaattaaaagaactagagaagcaagacgaaacaagttcaaaagctagcagaagacaagaaataactaagatcagagcagaactgaaggagatacagacacggaaaacccctcaaaaaatcagtgaatccaggagctggttgtttgaaaagattaacaaaatagactgctagtcagactaataaagaagaaaagataaaagaaccaaaaaaaaaaaaaa

SEQ ID NO: 3317 - DNA, 414 bp, Homo sapiens
  CDS 172..351
aaaacaatctcgacagagcatttcgggagccacggctccgggcgctttgctgggggctaaaggggtttatccctttccttgaatcccagcaggctagaactaccccctcccagtcttcaggcttgccacgctctccacccgatccttccattgaaaggcagagaaggaaggatgtgcttgggaactttaagacccacgaacgacagcgcactgatggagcagcccagtgtctggggcaaagtcctcgaggttcattcattcaggaagcctctgaccagcctttaccatgcgctgagtgagaagctgaggataaggaaagagcaagacccccaagaaaccctgatgtctggctgaaagcgaagcatgacgcaactttgctatatttctctccaacaaggatttgtatattttcgc

SEQ ID NO: 3318 - DNA, 417 bp, Homo sapiens
  CDS 30..248
aaaggttgaagttacagacttttgcatagatggtttgtcagtttaaaattccagaatttattattgccatattttcacatgctgcttatacaagattattattgagtagtaactgcttccctgtctatgtagaagtgcctgtgtttttatttattgttcagatcaaagaccaaaacattttcttaaatatattttatgtaatattttatttgtatacagtgttgttgatgaaatatttaactagagcatgatattttaaatgttaaggtgtaacatatgttaaataaaactgttatttttgaattttaaaatttgttttttgggggtatgaactactagagtttaaaattctgccaaactattacttatatgtactattgtgtaacatactttcttgaaatatttttgtttatagaa

SEQ ID NO: 3319 - DNA, 556 bp, Homo sapiens
  CDS 312..530
agagccattttcaaatgtcatccctttctagttatggcaaataagaaaccaagaaacacaacaggattttgtcataagtcctctaggcaagaaaaaaaaagaagataagggaaagacaaaggaaggaaatggaaggaaaggacaaagaagaaaagtctactctgaatcttgacatgtcagcttgattctagaagtgcgtttacctggaggacttacccacaactttaaccttgatgcttgcatgtgcctctccagcttcgtttttcagattgatgtggtaaacaccagagtcatctctttcagctatatcaatgaccagagtgctgctatcaggtcttcaacaaaccagaagactcattaggatccataatagctgccagtgtagaggagcctcagttactttcactttgatcattatccctgggagaagaagccaacagctcctggtgaccacaataagagatttcatttttacctcttacgaagagctcagtggaacatttctcatcaccggctgtcacataatactctgaatcatctgtcatctgacagttat

SEQ ID NO: 3320 - DNA, 416 bp, Homo sapiens
  CDS 4..180
  misc_feature 236..237: n=a, g, c or t
acgatggatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgktrataaggataacaagagatttgccctgctgggtgatttcttccggaaatctaamnngaagattggcaaagagtttaaaagaattgtccagagaatcaaggattttttgcggaatcttgtacccaggacagagtcctagtgtgtgccctaccctggctcaggcttctgggctctgagaaataaactatgagagcaatttctgaaaaaaaaaaaaaaaaaaaaaaaaaaaaaaaaag

SEQ ID NO: 3321 - DNA, 599 bp, Homo sapiens
  CDS 307..525
atttttcaaatgtcatccctttctagttatggcaaataagaaaccaagaaacacaacaggattttgtcataagtcctctaggcaagaaaaaaaaagaagataagggaaagacaaaggaaggaaatggaaggaaaggacaaagaagaaaagtctactctgaatcttgacatgtcagcttgattctagaagtgcgtttacctggaggacttacccacaactttaaccttgatgcttgcatgtgcctctccagcttcgtttttcagattgatgtggtaaacaccagagtcatctctttcagctatatcaatgaccagagtgctgctatcaggtcttcaacaaaccagaagactcattaggatccataatagctgccagtgtagaggagcctcagttactttcactttgatcattatccctgggagaagaagccaacagctcctggtgaccacaataagagatttcatttttacctcttacgaagagctcagtggaacatttctcatcaccggctgtcacataatactctgaatcatctgtcatctgacagttattgataaacaggattctctggcatcctttgtgttcaagatgtatctgtt

SEQ ID NO: 3322 - DNA, 473 bp, Homo sapiens
  CDS 199..360
gacatcacaggaaggctgagagaaagggcaggtccccgctgcgtggggctgggcttaaaggctcgtcgcgcctgcgcaaaggacctgacgacgtgctgcgtcgttacttttgaaacgcttggcggggaagagctgttggagccgctgtggttgctgtccgcggagtggaagcgcgtgcttttgtttgtgtccctggccatggcgctgcagctctcccgtagcagggaatcaccctgcgcgggagccggaaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaa

SEQ ID NO: 3323 - DNA, 479 bp, Homo sapiens
  CDS 216..449
gtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgaaggagttcggcttccgcgggacagagggccggctgctgctgctgcaggactgcggggttcatgtccaggtcgctgagggcggcgcgccgcagagttctatctccaggtggaccgcttcagcctgctgcccacggagcagccccggctacggtgcctggttgcaaccaagacttagatgttcagaaaaagctctatgactgccttgaggagcactttcagagtcc

SEQ ID NO: 3324 - DNA, 294 bp, Homo sapiens
  CDS 19..168
taaaaaaaaaacaaaattatgtctctaagtatattatgtatacttatgtttatgtatattaagtgttctgtggttttaaagactatgaaagaaattaaagcaagtttagattactttaaggaacagtcaggggraamccttactgrggtcaacattagagtagaaatttgaatgaaatgactgtgtgagccatgaggattctgcctcttttcagcaggggtaatagcagctgctagccttggacaggaatgtgcttggtggttttcaggaatgaccaaaaagtcacagtggctr

SEQ ID NO: 3325 - DNA, 485 bp, Homo sapiens
  CDS 106..393
aaacaggcaggcccggggctcgtgtgaagaacacagtggaagcatcctccaagccagccaacaaatttccgttttctactgccctttcgggccaggggttattttatgagcatctccgatgttgcacacgtggcgtgtgaaccgagagaaagaagatggagagatcaccctccagacgtcgtcgcctggaagaggccccaaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaaaaaaaaaaaaaaaaaaaa

SEQ ID NO: 3326 - DNA, 451 bp, Homo sapiens
  CDS 27..242
cagacctgaggactattttttcgattatgtgtgttcattctttgttcaaatatttgtccaaattcaactattttgttcaatatgcctgtctacctagtatttggctcgctggggatatagtgatgaataggcatggtctcttgtggaacttacagcatgggttccatgcaagttggtgttattctgcccccaagcacacagacatgcaattactagacatcttagtatgtgccgggcactgctaagtattcatttgtgtgctgccttttcatgatctgaaccctttgawgtgtagctgctattatgattctctctgtgtcttcacttcctcatctctaaaatcaggataggtatttgcccaaggctacacagagtaggggagggctggagtttgaatgtgagctaacataggcttataagaaaatacaaaaactgggctgggcacggtggg

SEQ ID NO: 3327 - DNA, 572 bp, Homo sapiens
  CDS 259..480
gttgtttgggctcctatctttgcctctggagctcacggtcggcgcttgttataacccagcactaggactgagcgggcggacgttcgtctttctagaaaggcctaggcgaggcctaggacgagggcggcggagaacgcggggagaagcccacccgtgaggagccagctgccgcgacgcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatattttgatgatgctttggaagatttcaagaaggtcttagacttaaatcctggatttcaagatgctactttgagcttaaaacagactattctagacaaagaagaaaaacaaagaagaaatgttgcaaaaaattattgatattttkdacttaatggaagtattgattcatgatccttacatctgcatctagttatcagtaatttagatattgagctattttgatttat

SEQ ID NO: 3328 - DNA, 527 bp, Homo sapiens
  CDS 249..401
aatgaatttatcttgcaagttattaggatgagaggatgtatctactaggttacaaaatggagctcctggattaagtaatatctgtaagttctatttagaatgctaatggggttttgctacagtgcataaaaagctgtggatctcctcaaatttcttaaaattttgctatactattaaacagttttagttcaaatgaatcaacacaaatgttacattagtgtttaatgtggtgacagcttgtttactaaatggatgttaatgtttttgaggccatctccttatataaaattaacaattcaagaataaatactagctgggcacagtggctcgtgcctgtaatctcagtgactcaagagcctgaggcagaaggattacttgagcccaggattttgaggctgcagtgagctatgatcataccactgcattccagcctccagcgacagagcaaaactctgtctctaaaaataaaaaataataaataggctgggcgcagtggctcacgcctgtaatcccagcactttgggagg

SEQ ID NO: 3329 - DNA, 481 bp, Homo sapiens
  CDS 50..208
  misc_feature 15: n=a, g, c or t
aagaagcggccgcgngctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccaggcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaattcagaaagtcggcagagcactgtgattgcttgcagtgtttctttataatacattccatgggaggaggtaaaatttttcactcatttgcctgttaacagtgttaaaggat

SEQ ID NO: 3330 - DNA, 471 bp, Homo sapiens
  CDS 50..208
aagaagcggccgcgtgctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccaggcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaattcagaaagtcggcagagcactgtgattgcttgcaggtgtttctttataatacattccatgggaggaggtaaaatttttcactcatttgcctgtaacagt

SEQ ID NO: 3331 - DNA, 528 bp, Homo sapiens
  CDS 199..420
  misc_feature 522: n=a, g, c or t
aagtaacccacgtgcttccgctggagcctctcgggaggcgggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggastggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgcgaaaaaaaaaaaaaattncgaaaa

SEQ ID NO: 3332 - DNA, 465 bp, Homo sapiens
  CDS 236..391
  misc_feature 19,426: n=a, g, c or t
agagcctctcgggaggcgngtaacgttatagtatttgtcagaagttggggtctccgtgggcattgtgatccgtcccaggcagtgccccaggggtaggagagtgaacggcggcggtrggtgctgatggtgatgtctgctcccaggattaggaggccagaaggagatcccttccacggtgctaggctgagatggatcctstcagggcccaacagctggctgcggactggaggtggagatgatggccgatatgtacaacagaatgaccagtgcctgccaccggaagtgtgtgcctcctcactacaaggaagcagagctctccaagggcgagtctgtgtgcctggaccgatgtgtctctaattacctggacatccatgagcggatgggcaaaagttgacagagttgtctatgcaggatgaagagctgatnaaagagggtkcagcagagctcttgggcctdcattaggtc

SEQ ID NO: 3333 - DNA, 389 bp, Homo sapiens
  CDS 147..296
gaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggagaaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcggg

SEQ ID NO: 3334 - DNA, 348 bp, Homo sapiens
  CDS 33..209
agtcaccctgcagtgacccagccagtacagccatgccgggtctcagctctgctcacccgcgcagtcccagaaacttccccggcttgtctccrctggaatcgggatggaagggagccacggstggctcagcccctctcggagcagaaagagggaaacttctgaaaagaagatgggggctgggggaggacatcaatcagcacggacaaccatgatcaccactttggctcaacctggtactggaggtcctggcccgtgcaataaggcaagamaaagaaaaaggcatgaagrttggaaaggtaaaactgtttttgctttctgatgacaaaactgtataaataggaaatccaa

SEQ ID NO: 3335 - DNA, 479 bp, Homo sapiens
  CDS 268..429
ccccagacctgagctccaccaccccagctgctcccctccctcctctgtccctaggtcagcttgctgccctaggctccgtcagtatcaggcctgccagacggcacccacccagcacccatcaactccaactaacaagaaactcacccccaaggggcagtctggaggggcatggccagcagcttgcgttagaatgaggaggaaggagagaaggggaggagggcggggggcactactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagcctggccagaggcttgttttgtcttttggtttttatgaggtgggatatcctatgctgcctaggctgaccttgaactcctgggctc

SEQ ID NO: 3336 - DNA, 452 bp, Homo sapiens
  CDS 95..385
ctctttttcctttgctctatccaaagatatcagccaaagaagccaagaaaaatgttatctttactttagaattagggatttcagatatgggtagatggctctgttaggcagaagtgttagagctggttataggaaaaccaggcggcacatacatgatcccagacaccgaagtaacctctgtctcactcctccacttccagcaagggatggaaaacaaactgaaactggctcaagtgaatgctcactggaaggcttactggaaaacttactggaaggatgtgaggacatgttcgggaatctatttgcagaaaacatattcagccctgtccaccacagccagctggctgaagagctcaaaaggcaagaaatcagcaagagagagagatgaagcatgagaaatgagcaaaaaacacccagcacatcataatcttggacagtttagcagtacatga

SEQ ID NO: 3337 - DNA, 846 bp, Homo sapiens
  CDS 100..438
ctttttcgaccctgcggagatccgcttccggttcccagactgaattgtcagtgagcggagtctgaggtcgctgtggactgcccactgggccttgccgagatggacagccggattccttatgatgactacccggtggttttcttgcctgcctatgagaatcctccagcatggattcctcctcatgagagggtrcaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgagagatcctgaagacagctcgtgaaatcagcatgcgtgtgcgcttctttccctacaattatcatcccaaaaagagaggactgtgcactagaaagttgcagcccacagcccttcatgtggactctgtcatgacatgctaactagactttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagca

SEQ ID NO: 3338 - DNA, 527 bp, Homo sapiens
  CDS 16..255
gcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctrgaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataaaaaaaaaaaaaaatg

SEQ ID NO: 3339 - DNA, 474 bp, Homo sapiens
  CDS 75..239
tcgcaccagtgtcagagtctttgttggaatactgcattacaaccatataagatgtaaccatggagggaaactagatgaagggtgcgtggggcccttacctttacaacttcctatcatctgaaattatttcaaaatataaatttaggaaaaaagaaagcaacagctctaagtgcagtatggcatcctggattggctgctgcagcagaaaagggacattgggaaaaatggtaaaatccaaataaactctagctattagtatgattgcacctttagttttgataaatgtaccaaggttatatgtaagctgttaacattaggggaacctgggtgaaaggtgtatgaaacttctgtgaatctgggcacggtggctcacgcctataatctcaacactttgggaggccgaggcaggaggatcgcttgagcctaggagttcgagactacccsaggcaacataatgagaccctatctctacaa

SEQ ID NO: 3340 - DNA, 431 bp, Homo sapiens
  CDS 5..157
  misc_feature 333,342,350,356,361,367,370,377,382,392,399: n=a, g, c or t
agagatggtccagccgtggggggcgggggaggcttctggccagaccattactccgccccgtccccaccctcaaggagagccgttaaagcctggggctgcgggagaagttgagggattttcgtttataacaactctaccattttgcaggtgvhgaagctgaagtcccgggagagacagtggcaaggtcaagtagcaaagtgcactcagccctcccagcaaggagtctgccactcgcgcttgaaggacgtgtttgaagagctgctttcccagtgggatgctgccttaaagtcttgattccctggcactctttcctattactacattttatcggtngctggtttngtgttatnscaacnggtanscatcngtngtctccnggaanrataaaaaanggtctcngrtacaaacatccataaccttccacccactcc

SEQ ID NO: 3341 - DNA, 505 bp, Homo sapiens
  CDS 51..476
tggctaccgaaccccggggctcttcaccagtccagctcgtttccagcaccatgtcggtgcgkacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccagccatcctgcagcaagtggacgggactttgcggcastgacagaaatatatggtggtctctctgca

SEQ ID NO: 3342 - DNA, 464 bp, Homo sapiens
  CDS 3..185
ccatgtacccctctttattccgctgccccaacaaagatggtcctttccacttagatacctgtgaccaacctcatcttgtgtcacaccaccagcatccagccagatcctgcggacaatggggtattcaaacaaacaggagatccatgggcactgagcagacctctctgtcctcttctagcaatctttaaatatgtccagtggctgcctcttttttttttttattactgctgttgcactgaaaatgtgtsatcactgtttgctgtgcaaccttttcatcccatggactagtttggcatcaaaggaatgasatttatcgactctgctgatagaatgattgatgagtaagtcatgcaatggtttcagtccccgtcaaaatcaattatttaagggctatacatttatatttgctgtcaagaagcctgacgtcaccagagtcaaccttcaggtgcgtgttaggggctggg

SEQ ID NO: 3343 - DNA, 596 bp, Homo sapiens
  CDS 120..464
agttccggctctgcgtgaagagctttgcattgtgggaagtctttcctttctcgttccccggccaatcttagcggctgctgttggtybrgrrgccgtcccgctcctaaggcaggcatacgatggtggccgcaaagaaagacgaaaaagtcgctggagtcggatcaaactctaggctccaactcgttatgaaaagtggggaagtacgtcctgggsgtacaaggcagactctgaaagatgatcagacaaggcaaagcgaaattaggtcattctcgctawacaactgccccagctttgaggttcccaaaggaaatctgaaaatagagttactatgctatggttggctaaaactggkgkkyccatccaytamagkggcaataatattgaaactggggcacagcatgcggaaaaatactacagagtgtgcacactggcttatcattgatccaggtgactctgaacatcattagaagcatgccagaaacagactggtgaaaagtgaaaccttttcaccctacaaaattttcacctgcaaaccttaaaacctgcaaaatttttcctttaataaaatttgcttgttttaaaaacaaaaaaaaaaa

SEQ ID NO: 3344 - DNA, 496 bp, Homo sapiens
  CDS 115..402
agttccggctctgcgtgaagagctttgcattgtgggaagtctttcctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttctaaaaaaaaaaaaaaaa

SEQ ID NO: 3345 - DNA, 550 bp, Homo sapiens
  CDS 154..402
atgaggactagaaacctggaaacctacgtttcccagctactccatctccccacaccgcagctttctgttatgttctgatgatgcagttgaaagtcaaatgccagaagattgcgggtaggaggcaggactagcttacagctctcactcagatggatggagcagcacgtggagactcatgttatcaacttttgctccaagaactactgcaggaacatatcaggaaagccaagagaatccacagaccctttgaaggaactgtaccacccctgcagactccctgagatgccaaaaactgtgaatctgcttgctttctcaactgggaggctcatggtctggggtaagttctcttccctggtgactggctgcctggaaatagactcggtgctgttgggggggccatggtgagagtgagattggcctttaggactgtgggatgaatggcagcagggtgaagcctgtaacttctggttttcccccacttccccggtgacttgtatgactcagtagaggcagccacaatctccctgggaatataactccattgggctag

SEQ ID NO: 3346 - DNA, 507 bp, Homo sapiens
  CDS 351..503
cttttttctcgttccccggccatcttagcggctgctgttggttgggggccgtcccgctcctaaggcaggaagatggtggccgcaaagaagacggtgagtgaggcgggccaggcccggaagacgattcacgtggagagatgttttggccagggcgggcagatgtgagcccacgggggtgacagcatgcctgctggcatttggagggccccagaaggaatcccagtggccctctcaatgacttggggtcctcgacttcggaagtttaaggggctcggcttcaaaaagctgggtccggttttgaggcggttgcaggcgaggcccttaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaa

SEQ ID NO: 3347 - DNA, 496 bp, Homo sapiens
  CDS 184..348
cttttttctcgttccccggccatcttagcggctgctgttggttgggggccgtcccgctcctaaggcaggaagatggtggccgcaaagaagacggtgagtgaggcgggccaggcccggaagacgattcacgtggagagatgtyttggccagggcgggcagatgtgagcccacgggggtgrcagcatgcctgctggcatttggagggccccagaaggaatcccagtggccctctcaatgacttggggtcctcgacttcggaagtttaaggggctcggcttcaaaaagctgggtccggttttgaggcggttgcaggcgaggcccttaggtccgtatttaatgtttgctttgtagaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttga

SEQ ID NO: 3348 - DNA, 286 bp, Homo sapiens
  CDS 74..247
tttcctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatgstgaaatagagtactatgctatgttggctaaaactggtgt

SEQ ID NO: 3349 - DNA, 527 bp, Homo sapiens
  CDS 357..509
agattcggagtcgcgggctggtgggaagctgcagccccgctcagcccctcggccgtggcgctaccttcactgagacttggccggggagtgagcgcgccgagcctgggaggatacagcacccactgtggcctgggagctccgaggggctccagctgcttgtctgcttcctgctgctgaacagctgcccggggggctgcagcgacactagtgcccacgatggtcaggaccaagtaggagtggggcagctttggcccctccaaggatttgccaccccagtcttccagcatttacaggttgtgctccagcagattataccccaaggtctgttctggaaggatgacatcacccaggatgcaatgatccaaaagatggagcatgccagcagactgcatccccaagaaccatgcctgaaggatgggaaggcacttttccccactaaaaccactgagagccccctggccaaggtgaacagggatcagtgctttacctccgaagtggtttctaaggcctgaaacaagaggttggca

SEQ ID NO: 3350 - DNA, 320 bp, Homo sapiens
  CDS 165..317
agtcggaggcccagggcccaagtgaagctgctcgcagctggagtgagabgcaggtggcggccggggccgaagccagcagtgtgtaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttaytggtttgtgtttatattttcggggatacttaataaatctattgctgtcagatacccttaa

SEQ ID NO: 3351 - DNA, 506 bp, Homo sapiens
  CDS 127..444
atwygtcattsgttcatttatttaattcctcattcagcaaacgtgcmttaagatgtcagtgamatgccagatgstcataaggtccctgssttcttagagccgatttygttctagttggggaaacaaatggtgcasaagtcaacawatargagaagcaccawttgsactgagtgttgtgaaggcaataagcsasstgagccgwgakaggccacttttgtkttttatagggtggtcattagtgaascaggaaktgcctggtacatggcagctctagtcagagtcatttccactgakcttcctactgggstgtctgtgaacttcaagcagaaggcttcattcctggtcaaccacagcccccgcagccccgtgtggctcagggagttagctgccatgctggatgttgttgaacgtgctgcacgatcttacaggaagatggtaaacacctaggtcacatacattgcagaagttaccccttcatagatggtaaaaccttcttagttacccca

SEQ ID NO: 3352 - DNA, 497 bp, Homo sapiens
  CDS 97..444
ataggcggcctgaaatagaagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtc

SEQ ID NO: 3353 - DNA, 461 bp, Homo sapiens
  CDS 217..450
atccggccgctgcsggcggatgggagctgcgcgaggagacgggcgcgcgtggagagggcgcgggagttggcattcggtggtcctggcagttagctgagcacgccctctgagccgctcggtggacaccaggcactctagtaggcctggcctacccagaaacagcaggagagagaagaaacaggccagctgtgagaagccaaggacaccgagtcagtcatggcacctaaggcggcaaagggggccaagccagagccagcaccagctccacctccacccggggccaaacccgaggaagacaagraggacggtaaggagccatcggacaaacctcaaaaggcggtgcaggaccataaggagccatcggacaaacctcaaaaggcggtgcagcccaagcacgaagggcacgaggagggggtgtcgccgctaccggtgggaattaaaagacagcaataaagagttct

SEQ ID NO: 3354 - DNA, 504 bp, Homo sapiens
  CDS 291..491
gacctgggccgcggggaaaggggaggacggcggtcggtcgcctgaggtcttcatctccgcacgcccgggggtatcgaccggctgccagtggagcagacacaggcacagcccgtccgtgtgaggagcgggcgaaggggccagaggatgaagggaccggggttggcggccccggcctccgtgtttcctgtgaaggaggacggagaccggcactggcacccacggctgcacttcagctcggagtcgtccatgcacagctgggccctgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagcattggactggagtgctaccaggacaacttctccaagtttggcctctgtaccttcagtgatgtggctcagctcagcctagaagacctgcc

SEQ ID NO: 3355 - DNA, 511 bp, Homo sapiens
  CDS 291..491
gacctgggccgcggggaaaggggaggacggcggtcggtcgcctgaggtcttcatctccgcacgcccgggggtatcgaccggctgccagtggagcagacacaggcrcagcccgtrggtgtgaggagcgggcgaaggggccagaggatgaagggaccggggttggcggccccggcctccgtgtttcctgtgaaggaggacggagaccggcactggcacccacggctgcacttcagctcggagtcgtccatgcacagctgggccctgaccagctggtkkctgcatttgacaagatgatccgcaagccagataccctgcaggctggcggggacccaggggaaaggccttcccaggcccttctgacccctgtggccctggactttccttgtctggactcaccccaggcctggctttcagcattggactggagtgctaccaggacaacttctccaagtttggcctctgtaccttcagtgatgtggctcagctcagcctagaagactgcctgcctggg

SEQ ID NO: 3356 - DNA, 408 bp, Homo sapiens
  CDS 141..344
  misc_feature 162: n=a, g, c or t
cccaagtctgcaggccccgcctggcccacccagtccttcttagaagatgatgacctcaactactgctttttaaagaagactgacgtcgtgttaactgagtttcgataacgcccctctgtgtattttctcatcgtcttattatgttttccaaaataggacctngggtcgaactcctgacctcaggtgatccgaccacctcgacctcgagaagtgctggcattatggatgtgagccactgcccctgccctagatggtatcaccttcaaagcttaattaggaagaataatatgagcactgagtgtaactccaggtcgggtatattatgtccctctgtgttctctagctagttatctatccatccatctcttgscttgtccacagaagttacaggtaggctgccgggcgcar

SEQ ID NO: 3357 - DNA, 532 bp, Homo sapiens
  CDS 211..384
aaaaatctctttgctccagccaggggttgtgacttaagcctataaattttgggaggctgaggtgggcagattactggaggccaggagttcaagaccagcctggccaacatggcgaaaccccatctttatgagaaatacaaaaattagctgggtgcattggcacatgcttgtaattccagctactcgggaggctgaggcacgagagtcaccatgcccggcatatatgaagttttaaaaaatcagaatacagaacaaaatttattgggagatgagcttctttctttctctcttcaacaccatcgccacatcacctccacatatacacacactgaaaagatactgaaaagacataataaccatgggaaatggagattactggattgttaaatgttctttttgcctgtctttattctctaactttgctataatgaacagaaattattttttgataagcaaaaatattttaactttaaacatgtaaagtacttagtagttgtcttttcaaaatatgtaagaatcattagttcactag

SEQ ID NO: 3358 - DNA, 475 bp, Homo sapiens
  CDS 152..430
atcttttctggcagctacacggccacgcagggtgggactgctctgcctacgaacagcactgtgtcgaacacgggccacggttaagcctcccggctgcctcccccagggaacacgacccctgagaagattccagacagtctcgcagaggctcatgctcgggagcgtggttgagcggctggcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagactcgaccgagtcagagtctcactctgtcacccagactgtagtgcggtggcatgaccatggctcactgcagsgtcaaacacctgggstcctgtgatc

SEQ ID NO: 3359 - DNA, 413 bp, Homo sapiens
  CDS 3..176
acatgctctttaagtttttgctgacagacattagccagttggaaatgattttggtgtgtgagtctttgcctcccagcaactggtgcccaggctcaactgagatcttactctcactaaacaggatcctgtcttccaccaagacttacgcaattgtgaattccccaaatgaagagggttgagatgtgcaagaaaaaaagagttctccccagacctgtggacaatgacagccttctagaaactgggtttctctacagcttctggtgtcagtgtgtgactgaaggcagggacattaaaatcactgaggtttgcagccaaaacatccttcagactcgcctagaacagagggactcaaaagaattggttgttcagcagacccgctggagctsccccttgaacaacatgggtttgaactw

SEQ ID NO: 3360 - DNA, 593 bp, Homo sapiens
  CDS 87..344
agggctttcgagccagatggtcatctgagacgagaggtggcggcgaaggagagtctcgcctgtcacgctcccggagcaggggcttcatgaggtggccatggaaacagcctggcagactcccatctctcctggtgccatctccggagcggaaagtggagcgccccgctggcgaccaaggccgcactgagagccctggtttggtcaacagttgggctccaaggagcctggtattccttgaacatgcatacctttcccagcgtgagggacatggaccgtgccgtgcgagggaccccatcttctgcagcaggagggagcagagaagagaacacagggattcctgttgctaaaaggtctgttttctcctgctagccaccctcatcagccagagttcaaaccctgacagtgcccatggagagatctggtccaaggcaccaacctcttcctgctggactgagaaagagcctcctactgtgtctctctttacctcagcttttgcacacctccaatatattgtccactgaagtcagaataatctaaaaataaaggctgattacctcatgtggtataaacaaaaaaaaaaaaaattscgaaaa

SEQ ID NO: 3361 - DNA, 509 bp, Homo sapiens
  CDS 72..254
agattactctcacccttcacctcgctctggaaaaaccagccaccatgttgtaaggatgctcaagtagcactatggagattcacacgtggcaaagagctgaggcctcccaccaacagccacatgagggagccagagtaggagtggctcctccagccccagtcgaaccttcagatgtgacagacttggctgctgacagtttgcaatctcatgagaccctgagccagaaccacccagctaaatcagtcctggactcctgatcaacagaaatggtgtagaccaaagagaggcgttttgaacattaagacgctttgctgcttctcacctgaaacacgtaacaggaacaccaacctcttcagccgcrgaaatcttctttgacacaaaactcaaaccgagtcaacccaaagttccaagttctttgctttctcttctgtgtgtgtgttggtttgtcccaaaagtcagtttgcagttgaaacttcatgaaattactcgtagcagaaataaagtacatt

SEQ ID NO: 3362 - DNA, 699 bp, Homo sapiens
  CDS 91..315
aagaggatgggtgtggcctggcagcgcaggcgcactagaggactgtagggtcggggcgcctgcgcagtcgcttttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgcatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtctcctcacctctatctttctttctctctctctcaactttccttaaagttctcattgcctttgcactgcttctgtga

SEQ ID NO: 3363 - DNA, 579 bp, Homo sapiens
  CDS 91..315
aagaggatgggtgtggcctggcagcgcaggcgcactagaggactgtagggtcggggcgcctgcgcagtcgcttttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgcatctggggtgtggtgtggtatgtgggaagaagttcagaggaaccgttggaaacgacgttaggcattttaccttttcagtaacattttatacatctaactttgtcaatg

SEQ ID NO: 3364 - DNA, 612 bp, Homo sapiens
  CDS 91..315
aagaggatgggtgtggcctggcagcgcaggcgcactagaggactgtagggtcggggcgcctgcgcagtcgcttttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgcatctggggtgtggtgtggtatgtgggaagaagttcagaggaaccgttggaaacgacgttaggcattttaccttttcagtaacattttatacatctacttgtcaatgtatttgagacattcacaaaaaaaaaaaaaaatgcg

SEQ ID NO: 3365 - DNA, 385 bp, Homo sapiens
  CDS 19..243
cttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgcttttacacaacacaggccacatgggaaaggccccagcagccttcagctccttcctttctccttaaagagcaacagggcttattcttgtttttcttttttcaaagtgtgg

SEQ ID NO: 3366 - DNA, 516 bp, Homo sapiens
  CDS 60..284
  misc_feature 344: n=a, g, c or t
amyaagaaggmctgtagggtcggggcgcctgcgcagtcgcttttcctcaggcggcggccatggcgggacaggaggatccggtgcagcgggagattcaccaggactgggctaaccgggartacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgdwgrnaggccccagcagccttcagctccttcctttctccttaaagagcaacagggcttattcttgtttttcttttttcaaaagtgtggcctttgggctctgcatctggggtgtggtgtggtatgtgggaagaagttcagaggaaccgttggaaacgacgttaggcattttacctttt

SEQ ID NO: 3367 - DNA, 447 bp, Homo sapiens
  CDS 26..250
ttttttttttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgcatctggggtgtggtgtggtatgtgcgaagaagttcagagga

SEQ ID NO: 3368 - DNA, 568 bp, Homo sapiens
  CDS 202..405
cagccacacgtgatcggccaacactgagtcttacctcgttgtggcgtcagaaccgccgtcgctcgctcccttctcggcagtggtacctgttcccggtgtccctgaggacgtgcgggccaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtagcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatcccctcaccatgaccatcacgatgag

SEQ ID NO: 3369 - DNA, 545 bp, Homo sapiens
  CDS 237..440
cagccacacgtgatcggccaacactgagtcttacctcgttgtggcgtcagaaccgccgtcgctcgctcccttctcggcagtggtacctgttcccggtgtccctgaggacgtgcgggccaggtacggcccgaaagtaggaagcggagggggagcaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtagcggttccgcgttaggcagcccatcctgcagtatagatgggacataatgcataggcttggagagcacaggcaaggatgagagaggagaatatggaaaggattggggaggaggtgagacagctgatggaaaagctgagggaaaagcagtt

SEQ ID NO: 3370 - DNA, 501 bp, Homo sapiens
  CDS 172..399
  misc_feature 35: n=a, g, c or t
actcgtgtctcgctaccagctcscsgstgccctgngctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccgcagcaaggatgagagaagagaatatggaaaggattggggaggaggtgagacagctgatggaaagctgagggaaagcagttgagtcatagtctgcgggcagtcagcactgac

SEQ ID NO: 3371 - DNA, 508 bp, Homo sapiens
  CDS 176..475
actcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaagcagttgagtcatagtctgcggggcagtcagcactgac

SEQ ID NO: 3372 - DNA, 384 bp, Homo sapiens
  CDS 173..337
  misc_feature 36: n=a, g, c or t
actcgtgtctcgctaccagctccccgytgcccttgngctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggscstscctttggatgctggtgaatactgtgtgcctagaggaaatcgtaggcggttccgacgttargcagcccatcctgcagtatagatgggatatgatgcataggcttg

SEQ ID NO: 3373 - DNA, 414 bp, Homo sapiens
  CDS 201..365
  misc_feature 295: n=a, g, c or t
agagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggngcccttggccctccctttggatgctggtgaatactgtgtgcctagaggaaatcgtaggcggwtmmrcgtataggcagcccatcctgcagtatagatgggatatgatgcataggcttgga

SEQ ID NO: 3374 - DNA, 467 bp, Homo sapiens
  CDS 237..440
cagccacacgtgatcggccaacactgagtcttacctcgttgtggcgtcagaaccgccgtcgctcgctcccttctcggcagtggtacctgttcccggtgtccctgaggacgtgcgggccaggtacggccccgaaagtaggaagcggagggggagcaggtttgcggggccaagtgttgcggcgacsacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtagcggttccgcgttaggcagcccatcctgcagtatagatgggacataatgcataggcttggagagcsacagg

SEQ ID NO: 3375 - DNA, 544 bp, Homo sapiens
  CDS 203..511
  misc_feature 66: n=a, g, c or t
gcagagctacgcagccttcggtgcagtcgtcactcgtgtctcgctaccagctccccgctgccctkngctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaaagctgagggaaaagcagttgagtcatagtctgcggggcagtcagcactgacccccctc

SEQ ID NO: 3376 - DNA, 560 bp, Homo sapiens
  CDS 201..545
  misc_feature 456: n=a, g, c or t
agagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattngggaggaggtgagacagctgatggaaaagctgagggaaaagcagttgagtcatagtctgcgggcagtcagcactggasccccctcaccatgaccatcatgatga

SEQ ID NO: 3377 - DNA, 424 bp, Homo sapiens
  CDS 200..364
  misc_feature 62..64,173,288: n=a, g, c or t
agagctacgcagccttcggtgcagtcgtcactcgtgtctcgctaccagctcycygttgcscnnnctcggsgggctggcatccggcccgggggaaagcggaccagcccttctgcaggtctgcggggccaagtgtcccggcggcgcacctcgtggcgagaatcgggagaargagnagastacaaggataggcccaggagtaatggagtccaaagagaaacgagcagtaaacagtctcagcatggaaaatgccaaccaagaaaatgaagaaaaggagcaagttgctaatanaggggagcccttggsmctcmctttggatgctggtgaatactgtgtgcctagaggaaatcgtaggcggttccgcgattaggcagcccatcctgcagtatagatgggatatgatgcataggcttggagaaccacaggc

SEQ ID NO: 3378 - DNA, 528 bp, Homo sapiens
  CDS 122..496
atccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgcgggcagtcagcactgacccccctcaccatgaccatcatgatgagttttgccttatgccctgaatcctgatggtttcctaaagttattacgg

SEQ ID NO: 3379 - DNA, 461 bp, Homo sapiens
  CDS 138..344
aattttcctaagatggaggtctgttcagatttcatcagagcacccctcctacctcagctctgtgttcccaggagacggttgctaggcgacggcaaagtccttgattgctgcgttgccaggcaacagagaaacggaaaatggagggaaaagggaaatgggggatggggaagggtctttatgggccatggcgcccactggtggataagcagggcctgcaggttttctattctggaaggaaatttgagtccagccccttccgcactgactccttggatcctctggtgatccaagccttcctaccagatatgaaactaggacattgggggtcatcttgggggcgcatgtaacagatgccgatcaacggggtcaatctcgcttgggtgagattctagggaagtcgtcatttctaccatgtatgggcattttatagaagtcagccgatttgaggagacccctcactg

SEQ ID NO: 3380 - DNA, 490 bp, Homo sapiens
  CDS 147..347
acatccctcttcctggatacctgagctcctgttctccatggtgatccattcagtgacttctccaaactatctggtaacagtattggctcagaccacggaactgccctttgataccaattgcaagttctctgacccactgtggatccatgctcagtctgcatacaacactcaggtctaggcagccacgtggcatcctggcgcttcagtgtggaggccagaagaggagaggaatcctcaccaaacagtcaggacagatcatcgagagagaaggaatctacattccctcgccaaatgcaacactagaagtgaacacagacttggaagttggcaacgtgcttgagaaatgctaggtgagaaagcagagaccagaaaactgagcaagtggtccaacatcacaaagctcatcccagctggctaggattcaggcctcctgggatcactggscacttatgtcgctgtccaggtgaaacttcagatgtcattagcagac

SEQ ID NO: 3381 - DNA, 487 bp, Homo sapiens
  CDS 172..462
aaataccgaaagccacccgcttccgactgcagcgaatccaggccggtgccagcagcggcttctttctcaagataattgctatccactgggataaagctcaatatccagttcaggaaatgggaaacactgatatatgactcatcccatggaacagaatatagtctacgtggaatgtcacactgtgcttctagtggcaaagtttgcatatatgtatgtatcagtgtatctttaaatttgcctttgtgttgcaagcacttgttatatccttcctattattcctattatttaaatcaatttttattttgcaagactactggtaaagattttggaatgaaatkttctggggaaccgagtcaccctaatttaaaaaataaaaatatctcagtaatttggacaataggtttaatgtatgaggttaaatatatacctgcttattataaatatgcagaatcatttcttgtttagaaaatatttcaaatattttatg

SEQ ID NO: 3382 - DNA, 738 bp, Homo sapiens
  CDS 302..577
agtacctctacgccgtctcccgcccactgggscctctggctagccgggctacagagtaagcctccagcagggtagagtgacaactccccgatcggaagttactgttgaagctaaggcggccataactgataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagatcgaaaaaaaaaaaaaaa

SEQ ID NO: 3383 - DNA, 486 bp, Homo sapiens
  CDS 132..338
gccataaaggccgccgcgcgcccacgcgctcgcttgctgcgcgtgccggcgctccttcctcctcggctcgcgtctcactcagtgtaccttctagtcctgcctcagcctcccgagtagctggaattacaattatgcgccaccctgctcagctaatttttgtatttttagtggagacgggatttcaccatgttggccgggctggtctcgagcccctgacctcaggtgatctgcctgcctcacctgggattacaggcatgagccactgcgcctggccggaaggagctttttctaatctcttttgtcatacgcccttatcacccaggctggtctctgactcctgaccttaagtgatctgcccacctcagcctcccaaagtgctgggattacaggtgtgtgcaccatgtccagcttattttttgagacaaggtcactctgtcactcaggctagagtgcagtggtacgatcttggctcactgcaacctctgc

SEQ ID NO: 3384 - DNA, 560 bp, Homo sapiens
  CDS 48..461
ctgacgtcttccggaaacgtgcacttgcaagctgcccgcaatacgttatggcgaccaaacgccttttcggggctacccggacgtgggccggctggggggcctgggagctcctaaaccccgccacttccggaagactcctggcccgggattatgccaagaaaccagttatgaagggggccaaatcgggaaaaggtgcagtgaccagcgaggccctcaaggaccccgacgtatgcacagatcctgtccagctcaccacatatgccatgggcgtcaacatctacaaggaagggcaggatgtacccctgaaaccggatgctgagtaccctgaatggctgtttgagatgaacttgggtcccccaaagaccctggaggagctggaccccgagagccgggagtactggcggcggctgcggaaacagaacatctggcgccacaaccggctgagcaagaacaagaggttgtagcatggagggcccggcatcgctgacccccacgccgagggcttgccgttttcccggagacgtggacttttgtgagacaagaggcggctccccagcctg

SEQ ID NO: 3385 - DNA, 421 bp, Homo sapiens
  CDS 58..246
gttctcagttgctcgctgggcagacccaggtcgcgctcccactgccgagcccgcgagatgctccccagagctgcctggagcttggtgctgaggaaaggtggaggtggaagacgagggatgcacagctcagaaggcaccacccgtggtgggggaagatgtccccctacaccaactgctatgcccagcgctactaccccatgccagaagagcccttctgcacagaactcaacgctgaggagcaggccctgaaggagaaggagaagggaagctggacccagctgasccacgccgaaaaggtggccttatttcctccaaagccgatcaccttgacggacgagcggwaagcccagcagctgcagcgcatgctggacaatgaaggtgaatccctgtgcagggcctggcctyccgctgggactatgag

SEQ ID NO: 3386 - DNA, 456 bp, Homo sapiens
  CDS 110..277
tacggttttattattatatcgatttatttgtgaggagggaatctgttcatgtagattttaaaagtgcaagagtgtccagcgtcatctgcctctcctgtcccctgaccacatgattttctgttcccataaactagcactgttgagtatatttccagagcatactccaggcgtgtgtaaatacagccttccactcctgcacacacaccgtgtttttacatcagtaacattctgcgcatattgttcagcaccatgccttttccacttaacagtaataatttaaaggtcattccatttcagtacataaagagcgtcctcaggccgggcgcggtggctcgcacctgtaatcctagcactttgggaggctgaggcaggtggatcacctgaggttggaagttgaagaccagcctggccaaaagggcgaaaccctgtctctactgaaaatagaaaaattagctc

SEQ ID NO: 3387 - DNA, 480 bp, Homo sapiens
  CDS 151..318
aaaccagcagtctttatttgcaacttttattggcaaacctggctgccagtaaatacattccttggcatctcccacaatgtaattcactggatggagcggccttgctttttctgtaacgtgtacgtcaattaaaagggccgcctggaaggaatgcgtacggtggctggaagcccagtctcgggtcacctccctccactccaggaacaaaagcgtccgtggtctgtgcctggaagtctgagagggtctccccgatgggctgttcccgcccggaccctgagggatgagagttgcagcctagaaaaccagaaatttttctactaaggacggggctgaattggagggactgtgctgacaaatcctctacttgraaatcccccagctaaggagtatctgcccaaggtcgcggccacccagatgttcggtccccactccttcctccgctgaaaagtcgcaccgatgactaacgttgcctgccggcct

SEQ ID NO: 3388 - DNA, 579 bp, Homo sapiens
  CDS 339..542
atcactctttagaatccctgcaactttgagcaagttcgtgaatctcactaaggctcagtttcctccataaaattaatcaatatcagggcctctgcattggacaactccagagggcaccattggggttataccttgtgtttgcctaaccttcattgcagtrggcaggtgcatgctttctacaatgtcctaaggtctaaaggggtagagttctgtgtgtggcattttaggcctggaaaggatgagagtctacaaaaccagagaaatactgcagagctcctaaagtccttggaatgtcctaagtgggaagggaaagtggctggaagttgacttaatttgcaatgggcaatgatttcatcaatcacgtctatgtaatgaagcctccacaagaaaaaaatcttaacagaagaccttcagagagcttccaggttgctgaccacatggaggtcatkcccagagakggtgtgaaagctccacaccccttttccataccttgccctacttatctcttccatctggctgtttctaagttgcatcctttatattaaagcaataatgttgtaaatgaaaaaaaaaaaaaaa

SEQ ID NO: 3389 - DNA, 566 bp, Homo sapiens
  CDS 22..345
attaacgttcctcaataactaatgtttcccccggaccaactttccgttcagatcaactttccgtctgtgccaacgttcgccgcgattaccgttctgctgtgtacctgttttaagaagaaacaacaaggaagtgaaaccaaagacgggcagcccggcgccaggcccgaaaccaggcctgggcctgcctggcctaaacccagtttcatgtgtgtgaagagaccaccaaacgtgtgtgaagagaccaccaaacaggctttgtttacttcaggccatctggatgtatacgtgcaagtcacaggggatgcgatggcttggcttgggctcagaggcctcacacccagtagctaaaaatcaactcataacttagaaaccgatgttattcatagattccagacattgtatagaagaacgttgtgaaactccctgccctgttctgtttctctcttaccactggtgcatgcagcccctgtcacgtaccacctacttgctcaaatcaatcacgaccctttcatgtgaaatctttagtgctgtgaggagccttaaaagggacagaaattgtgcattcg

SEQ ID NO: 3390 - DNA, 452 bp, Homo sapiens
  CDS 110..277
tagatgacagtctccctgcttttcaccaggtgggtttttcccattgtggtggcatttgagacttgcattctaggagacctgagggtctacttctggttttgtcctgtggatgacccttactggggccatctgtgagggagttggactagacaatatgaagtcatttttcagcatttacagtataggattccaatctattagtggaaaatatgttttctgcccaatcgtatatgttacagggagtgagagtcaacactgcagctaccatttctgtagttgatgccatgtagctgttactagaacattgtacatttcatttctgtaataaagactcctgcttttcagaggccaggcatggtggcttatgcctgtgatcccagcactttgggaggctgaggcgggcagatcacttgaggtcaaaagtttgagactagcctggccaacatggtgaa

SEQ ID NO: 3391 - DNA, 526 bp, Homo sapiens
  CDS 338..487
agtttctggtatttagaagtcatttatccttccgagagaaataataaagtttcatctactgagaaatgttttaatgattctcctcaaattttaataagtatgagaatcagctgggcaactagttaaaatttacttgctgatttaagttccactctttttgtcgacaataatatggcgcccaaacacgtggggcctcagagaagactctggatccggaaggagtatcccaaaaccagagctaaggtaccagctggagcccactgaagcctcaccgagtttgggcttctcctcctgtggaactggaaaccaaaatcatggtattttgaaaaccagaggtatgaatctccctcgtttggcatcccactgggcctggacctgtttcactgctaatgttctgctgccaaaactatacaagctgcctggactattgcagaagagagacagagtcttgctctgttgcccagaatggaatgcagtagcacaatcctaactaatcgtaaccttgaactcctgggttcaagcgatc

SEQ ID NO: 3392 - DNA, 478 bp, Homo sapiens
  CDS 64..393
actacatcatcagcagtggcagcactgactgtctcaacacttggtgggacagcagtggtgtcaatggcagaaacattgctgaatatatctaataatgctgggaatacacctggtccagctaaactcaacagtaactctgtggtgccacagctacttaaccctctactggggacaggtctacttggtgatatgtcatcaataaacaatactttgagtaaccatcaactgactcatctacagtcgctgttaaacaacaatcagatgtttcctccaaatcagcaacagcagcaacttctccaggggtacagaatctccaggcgttccaaggacagtccacaattccttgcccagctaacaataaccccatggcttgtctgtttcagaactttcaggtgagaatgcaggaagatgcagctctcctaaacaaaagaataagcactcagcctgggctcacagcacttcctgagaatccaaacac

SEQ ID NO: 3393 - DNA, 410 bp, Homo sapiens
  CDS 37..360
tgtgaggggcgggacaagtgcccggaggacagacagatggggcgacactggctggtggaggggaggggcaggcgaggagcgggggcaggcccggaagaaatggggacccggcaggcggtgacggaggcggcacgcgcggagatggrwactggggccagccacgaaagcctccgccccctcgaagcgggctccctcgccgccaactctagtgaagaagcagcccttctccccggcgcccgctggtttgcagaggcctgctatgaagagcttgtgcaagtaaagcgtttgctgagcggaaacaggctgcgggtggctgcggcaggcatggagccgacgcggatcttttgcaaacatctttattaatctcatataaaaataaggtccatggacggtcaaaaaaaaaaaaaaaa

SEQ ID NO: 3394 - DNA, 465 bp, Homo sapiens
  CDS 176..355
  misc_feature 21: n=a, g, c or t
attttcccggcaagcggcggngcccgcagcacctgttgcccggtgcgcggcggggaggacggcgggggacatggcctggtagagtcccctggggagacgtgctgagttcagtccggggcagggcagggcgagggagggaaggtccttccctggcgcccgcgcgggctgcggcagcatgaaaaagaagcagacggtgcagggcacttcagcaaactcttcgggaagaagcacaccacgacccccagcacctccctctacgccaccaatccgccctggatcttcacccaggaggccccggaggaggggaccgggggcttcgatggcatctattatggagacaatcggtttaacacagtgagcgagtcaggaacagccacgctgaaagctcggccaagagtccggcccctgctgaccttccttccgctgactgagtttcattcttgttgcccaggctggagtggtaca

SEQ ID NO: 3395 - DNA, 469 bp, Homo sapiens
  CDS 42..452
  misc_feature 456: n=a, g, c or t
caagtattgggacttgtgatttttaattatccagcatatagatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttactataanaaaaaaaaaaaaa

SEQ ID NO: 3396 - DNA, 316 bp, Homo sapiens
  CDS 66..311
  misc_feature 301: n=a, g, c or t
ctctctgcggcttggccgttagasgcggcttgtgtccacgggacgcgggcggatcttctccggccatgaggaagccagccgctggttcttccctcactcctgaaggtgctgctcctgcctctggacctgccgmagcccaggattcgactcaggcctccactccaggcagccctctctctcctaccgaatacgaacgcttcttcgcactgctgactccaacctggaagcagagactacctgccgtctccgtgcaacccacggstgccggaatcccasactcgtccagctggaccaatatganaaccasggcttagtg

SEQ ID NO: 3397 - DNA, 477 bp, Homo sapiens
  CDS 161..373
cacgtcaatgatgacatctgttttgggagctcaggggccagccgaagtaagagatttggtttgttatgtgatgcttgtaaagatcttatatgcatgttgttgaactcttagaagttttcttctcaaaaaggaaaatattttctatcattttgtacaagtaatgcaagctgtcagcctactcacaaatctgaagccatttattggcatgggaagggccggaggtttatggaaaagctgtatttgcactttgaccacttctggctggtctcctagcagctacaacacagattccttttgtgccatagattggctcaagactggtagttccaaactgtggtcaaagccgactcatcctctctgctcccaagacagctagggatgcattcccagccaacagaaacctgcgcggcctcaagccgcctccatagattggctctagactggtagttccaaactgcggtcaaaaccgactcatcc

SEQ ID NO: 3398 - DNA, 451 bp, Homo sapiens
  CDS 222..392
tagtaaaaaaaagtaatgatgtcttcatgtccagatctagatatcttctacttcatgtaactaaagagtaagcacagtgtgaataaagcatcaaataagtacaattatcattttaaaataatgtcttattaatgtaattttaagagaaaaaaattaaacatataaccttaagtggacatagtacttccttaacacgttaatgctgcagggcacagtggctcatgcctgtaatcccatcactttgggaggaggccaaggcaggtggattgcttgagcccaggagtttgaaaccagcctgggcaacatggcaaaaccctgtctttacaagaaaaattttaaaattagccaggcgtggtggtgtgtgcacctgtagtccctgctactcgggaggctgaggcaggaggattgctttatcccgggaggcagaggttgcaatgaactgagatcacgc

SEQ ID NO: 3399 - DNA, 468 bp, Homo sapiens
  CDS 75..236
cctgcttaaacttaggaaggagaattccttttaggatcccatgcttcagtgcagaggtcaatgaattacagcccatgggccaagtttggccttctatgattcaaataaggccatgcttacttcatttgtctacatgctgtctatggctaatattgcactacaacagcaaaatatatatatatatacacacatacatacatatatatgtactattaggccctttacagaaaaaaaattgacttgagtttagatggacattcatgatttagatatagtcatatcacaaaaataggtaaacacatacacacaaacaataatatgtaagcacctcaatcacctgcagtccagctttcagggccggcctggtgggagcagtaactctaattgtcaaacattcactcttcagattaacactgcaaagcccaaggagaggatctctacatttgcatactcaaaaacaagcaaatg

SEQ ID NO: 3400 - DNA, 431 bp, Homo sapiens
  CDS 82..246
tcaatgaataaaatcagcaccgtgcattagaactttgcagactcactgcaaaggawatagcaggaggtaaagtgacctcaaatgaatgtggctttttttgtggggtgcggtgggtgggcagtgctacaacttaataaacaaattgagttttgcaggaagaaaaccttttadccaatctttatactctctcatggtgacatttttcttctgctatcattcccattctttaaacatttttacaatgattagttcattttaaacatgtaacatagctacagttgagttgtttagttgttttataacgtatatgtttttcgagtccatcagtaaactggaattataatcttatttttgytgttttgatcacacaacttttctgcgctctgaaaaatacaactgrtacttacttctcttcaccaaaagtcttttag

SEQ ID NO: 3401 - DNA, 461 bp, Homo sapiens
  CDS 118..402
caaaaataaatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttatwaagcccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaaaccagtgaagagaaacggcataaagatgacaaatgagcctatttgttagtgttcgtgctcaaatgtgatttacgttttaatgtataataata

SEQ ID NO: 3402 - DNA, 499 bp, Homo sapiens
  CDS 138..326
aacatgaaggtcatgcatgtgattcaggacccgccttctaggcagccaaacacttggccatctcaggtgatacccagaggttgcttgatgagcaaggaccagctcagaaccaagcagggaagataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaamtgtggggccyttactcgaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccagg

SEQ ID NO: 3403 - DNA, 471 bp, Homo sapiens
  CDS 211..366
atcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattccttttgaaaagcctgctgttttggaaatgcacagttgacatgttgaaataaaaatgaataccatttttaaatgtttcttaaatgataaagatgtgaccaaacaaaagtcctatactctaatgaatgagaccaaattcaacaagcctttgttatggaacatttactgtgacagcagaatcgataatgcagtcatttccagctttgtgagctgacaccttcatgggtttgtggactttgtgactttttcttcctgtccccaaagtgccatatgctaccttaaaaaatattaaagtgaatccaaaaaaaaaaaaaaa

SEQ ID NO: 3404 - DNA, 482 bp, Homo sapiens
  CDS 1..234
atggaaaaaamtactttaaagttcataatggaacaaaaaagagcytgcattgccaagacaatcctaagccaaaagaacaaagctggaggcatcatgctacctgatttcaaactatactacaaggctaaagtaaccaaaacagcatggtactggtaccaaaamcagagatacagaccaatggaacagaacagagccctcagaaataataccacacatctacaaccatctgatttttgacaaacctgacaaaaccaagaaatgggtaaaggattccctatttaataaatggtgctgggaaaactggctagccatatgtagaaagctgaaactggatcccttcctcacactttatacaaaaattaattcaagatggattaaagatttaaatgttagacctaaaaccataaaaaccctagaagaaaacctaggcaatgccattcaggacataggcacgggcaaggacttcatgtctaaaacaccaa

SEQ ID NO: 3405 - DNA, 508 bp, Homo sapiens
  CDS 196..354
  misc_feature 402: n=a, g, c or t
agaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaaagggargttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatkkgcacatcaactgctcaactgtggattgtttttttacttttcnwtttaaaccggttcgtatatatttttcttcgctgttacgaatttacagcagcawttgtacatgtaaaattaaaggctattttctggtcaaaaaaaaaaaaaaaaam

SEQ ID NO: 3406 - DNA, 726 bp, Homo sapiens
  CDS 222..572
aatttttttctccatctggctctcctctacctccaggcaggctcacccgagatccccgccccgaacsccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagmccagcagatgggagcacctggacttgggggtaggggaggggtgtgtgtgcgcgacatggggaaagagggtggctcccaccgcaagagacagaaggtgaagacatctagaaacattacaccacacacaccgtcatcaaca

SEQ ID NO: 3407 - DNA, 459 bp, Homo sapiens
  CDS 22..210
aagcagtcgcaagacctgagcatggcggccaccaggtgcctgcgctggggcctgagccgagccggagtctggctgctcccaccgcccgcacggtgcccacgccgggcgctgcacaagcagaaagacggcactgagttcaagagcatctacagsctggamaaagctctacccccgaatctcagggctcggacaccgcctggagggtcccggtgagccgggaaggactggacggaaggggcgttttgtcaggctgctgggtgacgttaggaaccccaggcccattggccggatgtggagctacgtcggggggctacgtgatggtcgccgcgggagggggctggctgtctgcgctaacctggccgggagtggggtgctcgctgtagcgcgagatgtgcaggagcccggaargccggctgggtatgcttctttcaaggctgccagcttttctacgttcgtgtc

SEQ ID NO: 3408 - DNA, 455 bp, Homo sapiens
  CDS 10..348
cgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagkaaaatcagcattgagggcaacaaaatgccattgtgaccttgcctggaatgtgtccccatctctactctaagaaatgcgcaatggactctttggagaaagaaagatattttaaaacatttttagtgtgtctgtaaatggttcagcgtgtatcagatgttgtcataggactcacat

SEQ ID NO: 3409 - DNA, 506 bp, Homo sapiens
  CDS 151..423
tttcccgtcggccccttcgcccacgtggagaacgccagggagctgtgagagtgtgcagtcgcgttcctgctgtccggacacttttttcctctactgagactcatctggtagatccgcagccagtcctcccaggggctgaagttgtgaaatatgggttttctaagaagattaatctatcggcgtagaccaatgatctatgtagaatcttctgaggagtccagtgatgagcaacctgacgaakggaatcaccaacttaaagtcaggattctacacctgctgaagagagagaggatgagggagcatctgcagctcaagggcaggagcctgaagctgatagccaggaactggttcagccaaagactgggtgtgagcttggagatggtcctgataccaagagggtgtgcctgcgaaatgaagagcagatgaaactgcccgcagaagggccagagctgaagcggatagccaggaacaggttcacccgaagactgggtgtgagcgcggagatg

SEQ ID NO: 3410 - DNA, 451 bp, Homo sapiens
  CDS 14..184
ttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatstgttaatatgcttatagtggtaagaaatggacttgaggtccaggagatttmattttattcaccctggtcagata

SEQ ID NO: 3411 - DNA, 495 bp, Homo sapiens
  CDS 55..261
tcaataatttttcaggttctgtgagaattttataatttataatttgcagacttaatgtataatctattttgtcctaacaattacaaatatattttttatttcagattgtatatattcctaccagatggagataattacagctttaaaaatttttattttttcattttatttcacacattgacattaaatttttatggacacataataactgtacatatatatggggtagaatgtgatgttttaatacatgtactcaatgtgtaatgatcaaatcagggtaatttgcataatgatttttctgtagggagaaaattcaaaatctactcttctggctattttcaaatatataatatgttattgttaactatactcatcctactatgcaataggacaccagaacttattcctgggttctacatccgttaaggcaaccaaggattggaaatattggaaaaaaaaattgcgtctgtactgaatatgtacagactttttttc

SEQ ID NO: 3412 - DNA, 484 bp, Homo sapiens
  CDS 113..460
  misc_feature 264: n=a, g, c or t
gcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggccccttccatggctccagttggccgactgagacttgcctgggtagcccataagactctgacttcctcagccacctcacssatttcccacstccnaggttccttgatggagctggtggagaaggaacgagcatctactccctacatagagaagcaggtggaccacctcatcaagaaggccacaaggcagaggagctcctggagctacttggtggcagtcacgacttggacagcaatcaagcagcaatggtacttatcmggctctctcacttgctgtctgaaagccagaagataaaggcttgctcatacaggatgc

SEQ ID NO: 3413 - DNA, 390 bp, Homo sapiens
  CDS 39..191
acagacctgagtataatggagacctctagcctctaatcatgggcactaaaggggattgcagacttgaagggattgaaccaactactgcaagtcatgggcattcaatgttttgtaagagacaaccagtcaattcaaagatgcaggcaggcggagaaggatggccatgttcgccaaagcataatggaagatgttgatgaaaccgcactgttgaaacaaatggagcgggagaaaatgcctcctcctccaaagccaaaggaaacgtttgtgagtgaaaggtgttgctattaatccttactcaggaacaaccaccataaaccaagaatatcccaggccaacaaggacatagtcgttgtattcaaagctgcaataaatagagattgactcaaaaaa

SEQ ID NO: 3414 - DNA, 473 bp, Homo sapiens
  CDS 71..223
wtycmaataaamtawtctttgcttttcctgtttcttaaaataaacttacttgattaggaatttagtaagaatgccactgattctccaattcagaacaactgaccaaaatatctatttgtcaagtcagctactttataactcattctgtaaacagggatatggaatgattcttatgaacaattttttttggaagcttgtaaatttatttagtgtcttatcattttaataattttaaccacattccaatgaaatcctggaaatggtatttttaaatattaacattatttcacttattagtagttatatactatttccaaacctcttttttacatgagacttaaattatctgtgacttaaaatgaattttctatgaggcacaatgktataaactgttgtaagacaaaatgacaagccacaaaaacttatttaacacttattttgtatcttaagtcatagtatttaggagctctgtc

SEQ ID NO: 3415 - DNA, 585 bp, Homo sapiens
  CDS 215..430
actttagcctgtggcagtgaggcttgcaggttctgactgctgggattggcgatttccctctggctagagcttgtttatatgctccttccattgatgggcatcagctgagttttgttccattttgttttctgctctaacagggcagcactgagttcaatgcctcacagttgttgcactttgcctctctccagtgcacagaatcactctccgcaccatgccacagctgcttgggaatgggggcgggatggtgtttgtgattcaagactgtttttcctacctcttcaatgcctctttcagcaatatgaagttaaaaccaggcccagtccggagcacaagcccacttgagccagcagcgcgcctcagcaagacagcagaagcaggaagagagccggccggaagacacttaccctggccggaagacatgtacccctgaggatcgcgagaggccatccggttgctgcgtartcccgtcagactggaacacttcctgtttacaggacactgtaaaacccctgctcagcactcatttggtgctgacgccattttatgtctcataccgtctgcacccaggcgcccaataaaaca

SEQ ID NO: 3416 - DNA, 519 bp, Homo sapiens
  CDS 19..171
gttctcttagctcctttgatggtcactgatttgttcttagagttaaaaaatcctctgctcatttttctcattcattttgcaccccctttcttctcttcagctactgttgaggctattgaggctgatgaaggtaaattggccagtcccctttctgktgtascctgcaacagataagggctctgctgggtgtattcatttttttgctgtagcttgtacagagtgtgtgggtgttgagctaacagttgtggctcagtattaaccaaaatgttcttgctttaaaggggaaaatgtccttctatggtttgtttgtttgtttctttcccttaaagctatgtttgacttttgtatatgatgaatactataatcacagaaaacaaaaggattatatattttgaatgatgtggggtgggggttatggcagctgttttgaccagtagcttataaaacaataatctttgagctgaaccatgtccctccctcaaatcactttcaggcagcactgaagagagtaaaaatagc

SEQ ID NO: 3417 - DNA, 547 bp, Homo sapiens
  CDS 1..507
atggaaacgggacccagcgaagaacctagcggccgaaaagagtcccaggacatgtgccccccgggattactggtatttgctggctcctcggaacaagatgccaacttggctaagcagttctggatctcggcgtcgatgtatccccctagcgaatctcagctggtgctgcgcagagacagcagtcagcgtctgccggtggcgcggcccaggaggagcagagggtctgaaaacagccactcctcgcagtcttttcaccttgcgagtaacayraatagagacatctttgccgaagccctaaagatacaggaatctgaggagaaagtaaagtatctccaaaaggctaaaacaagagaagagattctccaactcttaagamaacaaagagaagaaaggatctcgaaagaactgatttcccttccgtataaaccaaaagccaaagaacacaaagcaaagaaagtggtatcagagtcagataaagaggaccaagaagaagtcaaaactttggactaatttgcttgacacatggcagaggatggctcacttatac

SEQ ID NO: 3418 - DNA, 509 bp, Homo sapiens
  CDS 50..277
tcttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggcaaggctggcttggtggatgactttgagaagaagtttaatgcgctgaaggttcccgtgcccttgtgtttgtagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgacattgaggacttgaatgaagctttccag

SEQ ID NO: 3419 - DNA, 519 bp, Homo sapiens
  CDS 117..371
cgtatttaatcttaaaaaaaatcttttagtgtttgccagagcattttaatctgaaaatatttaaaaatactcgcctgtgatcccagcacttcaggaggccgaggcaggtggattacatgaggtcaggagttcgagaccagcttgggcaatattgcgagaccccgactctactgaaagtacagaaaattacccgggcgtggtggcggtcacctgtgatcccagctgcttgggaggctggggcgggagagtcgcttgagcctgggaggcgaaggttgcagcgagcagagatcatgccactgcactccagcacgggcgacagagcgagactccgtctcaaaaaaaaaacaaaaaaaaaaactcacctgttagtataactaatgctccaggaagctgccacatatttacctcaggacctatttctatcttcgccccaccgcacgctgaactagacacttaaggacctagtgtagaggactatgaagaggattgbtataaggagttaaaggctaaacctgattg

SEQ ID NO: 3420 - DNA, 436 bp, Homo sapiens
  CDS 125..358
  misc_feature 267,433: n=a, g, c or t
actcactttctctgatgttttgaaggcctggtgttcgctgatttcacgttccttaatttcttctttgtgccttttttttttccttttcgctgccagtaataaaagagtttattacttktcagcaatgatgaatgttcgtgtggcatccagcgttgagttcctattaaggcgaaagagaatgaaagacgtagataacctcaaaagtataaaagaagaatgggtttgtgaaaaggatctgataatcaacctcttggtaataatcaasantcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgasatttcagaagttattccgatggtgccantca

SEQ ID NO: 3421 - DNA, 472 bp, Homo sapiens
  CDS 174..458
tattttcgctgttgctggctttttcaggagctgctcgctcgcagccagagacgctgctttttttttccgggttcggagccgttccggatgctttaggctgccggatgtctgatctccgrataactgaggcgtttctgtacatggattatctgggaaaacaacaataaactagaatgtctgaatgcatccagatctcatttgctgtttgtagaattgggatttacacgtgttttagagcactttgctgcaagggaccaccacctgcacgaccagaatatgacctggtttgcataggcctcacaggttctggcaaaaccattctgttgtccaaactctgcagtgaaagccccgataacgtcgtgtcgaccacaggttttagtattaaagcagtgccattccagaatgccatcttgaatgtaaaagaacttggagatttcatttccttgtgggggcagcgttagactgagggtct

SEQ ID NO: 3422 - DNA, 594 bp, Homo sapiens
  CDS 98..571
gctgttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtacaagagaaaattcaggactgaaaaaaaaaaaaaaatgcgaa

SEQ ID NO: 3423 - DNA, 429 bp, Homo sapiens
  CDS 98..421
gctgttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggrrgccggctactaccaagggatctcaagggggtaatatttggtattaggacag

SEQ ID NO: 3424 - DNA, 386 bp, Homo sapiens
  CDS 43..198
gtttccgggagcgccgcgtggttagcgtcggcggcttttggcatggcgactttttctggcccggctgggcaatcctgtcgcttaatccgcagaagatctcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctgcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactc

SEQ ID NO: 3425 - DNA, 442 bp, Homo sapiens
  CDS 96..425
tgttaactcaaggatatattaatttttgtcaggataaagtattttattttattggtatctttcccctccctcttctagaaaatacagtagcagccatgatagaagacaaaggaccaagagtgacagactactttgtcgtagctggtctcactgacacatctactcttttggatcaagaaataaatcgtttagatactaagtcaactggacctaaagctccaattacagacattgccattattatcaaatcagctggagaaacagtacctgaaggttacacctgtgtagaagccactccatcagctctccaagcaaacttgaactatggaagtctgaaaagcccagaacttttcctctgttataagagagggagagataaaccaccgcttacagatattgggtatggtgacttcttttctttgctatagtgaaggagtaaaat

SEQ ID NO: 3426 - DNA, 431 bp, Homo sapiens
  CDS 98..340
  misc_feature 255,258: n=a, g, c or t
gctgttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctncantkaaakccccgataacgtcgtgtcgaccacaggttttagtattaaagcagtgccattccagaatgccatcttgaatgtaaaataactttgaagggctgataacatccggaaatacttgagccgctactaccaaggatctcaaagggtaatatttgtattagacagttgcctct

SEQ ID NO: 3427 - DNA, 484 bp, Homo sapiens
  CDS 98..442
gctgttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagagatgatttagaagctgctagaaatgagctgcactcagctctttcagcat

SEQ ID NO: 3428 - DNA, 455 bp, Homo sapiens
  CDS 111..341
agaggagctcggcctgcgctgcgccacgatgtccggggagtcagccaggagcttggggaagggaagcgcgcccccggggccggtcccggagctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccaggggaagaagctgttgccggatgacccctatgagaaagcttgccagaagatgatcttagagttgttttctaaggtgccatccttggtaggaagctttattagaagccaaaataaagaagactatgctggcctaaa

SEQ ID NO: 3429 - DNA, 363 bp, Homo sapiens
  CDS 201..350
  misc_feature 345: n=a, g, c or t
ctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccgagagccagctcagtacctgaggggctgctctatgctgtgtatgcgcctctctggcatccgagacatcctcttggctggcgcttgctgcaggggggaccccccccgtccccaggtgaaccaagggtctgctcsggggcccatttcsagcttggccgcmgtctgtaaccttgggmaantcacttgacctctgtgtg

SEQ ID NO: 3430 - DNA, 804 bp, Homo sapiens
  CDS 618..782
aaacggcagcctcaaccgcctggcagcggcggtttcttctcttcgtgaaaatcgtgatctcatctctccgtccatgggcgaaaaaacagccatcaccaggccattcacgctttgtgcttttgttaggagagcccaggcagccctgcagcccacatctagggtacaaacggaacggcggcgttttccttgtatcatttagaggaaatttttgagctgaacagtattttttttctccctctctctctctctgaaatattgctgagatttaaaggatgacgaagacaacagattcatagctgggtcttgctgttttcctgacgctgaccacagcggatctaggtggctatttcgttggtgcacaggcgttcacagaggcagagaggggagaaagttgtcaaacagattcacagactgtcaaagtgcggcttaaaccgagttcctgggctccctcactggcttcgtccacttaaacttttaacgtacacatgtagagagctgaaactccaggggtaacatgggacaggtcctcttgatttaatgaaaacagaagatcaactggaccgggtagcaagaaataaggcttaagaagcactggtttctctgcagaagacagcaagatgccccagggaatgtttgtgaaaaaggatgactggatgggaagcaagctgaagaaaaagaaggaaagaaagagagaaatcagtaaatcaccacacaagaggtggagaagaggacttataaatattgtttctatgacatttgaaaataaatgttttactccatgctaaaaaaaaaaaaaaatgcgaa

SEQ ID NO: 3431 - DNA, 524 bp, Homo sapiens
  CDS 13..285
cttctttccaaaatggcagcctccagtcgckcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagctgatcattgagaatcgagacatgcccaggacctagcaagccggggaccagccaccagtggcggccagggaccaccttcagcatccactctctgtttgagmtgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgt

SEQ ID NO: 3432 - DNA, 479 bp, Homo sapiens
  CDS 22..294
cctaatcgaaaactttccaaaatggcagcctccagtcgcgcacaagtgttagctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaggactgctgtcttt

SEQ ID NO: 3433 - DNA, 473 bp, Homo sapiens
  CDS 152..424
aaaggaaagagtgtacaagatggtaagatatcaaataattttcaaatgtgatacttttcaaatatttccagatttatctccatcagcttttaaggggtagaaactgagaagcaaaaaacagccggaaatttggctgtaactcacaccttttatgtgtgaagctccccaaacagtggggtgtcctgcattcaaatatattttagtacctattcaccaaggaaatgtgctaatgaaaattttctttcttaaatttgcatttccttattatgctaaaatagctactgatttttcttcaattttgattatgtatggggttctaccgaacaccatttttaaccccctacatataattgcacaaaaatgtacacctgtggataaaatggttttaatttctctcattgacttggtgatttcagtgggagtttaacacaggctagacggscccagtaatggggtgggggtgtattaggtgt

SEQ ID NO: 3434 - DNA, 489 bp, Homo sapiens
  CDS 263..442
aaaaacataaaaaggagagacaggcctagcctcccagcctgcatctttcacccctgctggatkcctcctgcccttgaacatcagactccaagttcttcagttttgggactggctctccttgctcctcagcttgcagagagcctattgagcctattgtgggaccttgtgatcgtaagctgaggaccagaggagtgactctcgcacagcggctcggtgcctgagctggaattccaaccagggctgtcgcctctaaagccctgccatggcagtgctgccagctcactctccttgggctcccttcccacctcccacatccccatgtccccatggactcctggtgccacggcacagctgcatgggggtgattcatgctggacacctgagacacaaggagaggaggcagggagctgccgaaagaggttcagttaaaaacttccaacaatgagggaagatgggatttcctcattttggccaggccggtcttgagct

SEQ ID NO: 3435 - DNA, 588 bp, Homo sapiens
  CDS 218..460
ggaaactgctcacaggaagtacctgttttacccgacccctccakggtaaaacggaaaggttcggaatttgcctctgcgccrtctttttttgcctgttacctgtgacgtccttggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaatgtgttttaaatctttaaaaaaaaaa

SEQ ID NO: 3436 - DNA, 475 bp, Homo sapiens
  CDS 284..469
aaaaggttcggaatttgcctctgcgccatctttttttgcctgttacctgtgacgtccttgtctataccataatctataacagtggtaccagtggccccggtagtaaatatcacagtcatgaagactcacagcctattgtagctagcaagagggaatccatgactcctctgggaagaaaggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattkgatagaat

SEQ ID NO: 3437 - DNA, 462 bp, Homo sapiens
  CDS 63..284
ttaamcmascttgycggcgccattttgtctcggcatcggtggccgtagctccatcgcattttatgtttctggcgagaagggaacggagttttcatcaggtagattggtttttgtgcggccgtcctccaccgtttcctccaggacagcacctagtcgtgtccggagagtctcagagctgtcagaaaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtggtctctatgaataaagaaaagcaaatagaatcttatcaggtaccagcatcaagatgatttatggtaataaggtactcagtctttgcttaaaataaattttacgtttatcaaagcaaaaaaaaaaaaaaaa

SEQ ID NO: 3438 - DNA, 556 bp, Homo sapiens
  CDS 284..526
aaaaggttcggaatttgcctctgcgccatctttttttgcctgttacctgtgacgtccttgtctataccataatctataacagtggtaccagtggccccggtagtaaatatcacagtcatgaagactcacagcctattgtagctagcaagagggaatccatgactcctctgggaagaaaggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaat

SEQ ID NO: 3439 - DNA, 449 bp, Homo sapiens
  CDS 1..222
atgaggaatctaggctcaaaggaaaatcagtttgactggctaaaagctcatctggcaagtttaaatcactccggaaacatacagagctgcagtcattggtttgacaagaacagaaagatacttgtctctgttgttgctagtattaaaagagaatttattggccgggcgcggtggctcacacctgtagtctcgactctttgggaggctgaggcaggcggatcatgaggtcaggaggtcgagaccatcctggctaacacggtaaaaccctgtctctactaaaaaatacaaaaaaattagctgggcgtgatggcgggctcctgtggtcacagctactctggaggctgaggcaggagaatggtgtgaacccgggaggtggagcttgcagtgagccgagtttgcgccactgcactccagcctgggcgacagagtgagactctgtctcaaaaaaa

SEQ ID NO: 3440 - DNA, 651 bp, Homo sapiens
  CDS 155..640
aagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttttgggccaggaatgtgcccaaatttggactagctcatctcatggctctggggctgggtccatggctggcagtggaaatccctgatctgattcagaagggcgtcatccaacacaaatgagaaatgca

SEQ ID NO: 3441 - DNA, 453 bp, Homo sapiens
  CDS 34..207
cttgctctttcgcccaggctggagtgcagtggcatgatctcagctcactgcagcgtctgccttccgggttcgagagattctcctgcctcagcctccagagtagctgggtctacaggcgtgtgccaccacgcctggctgattgtttgtatttttagtagagacagggtttcgccgtgttggcaggatggtctcgatctcctgacctcatgatccgcccgcctctgcctcccagggtgctgggattgcaggcgtgacaccgcgcccggccataaactatttattaacagataaggcctacagacttatttcttcttggatacacccacggtacaggtacggccatggcggctcacgctgtattcccagcactttgggaggccgagatgggcagatcacgaggtcaggagattgagaccatcctggctaagatggcgaaaccccgtctctactaaa

SEQ ID NO: 3442 - DNA, 450 bp, Homo sapiens
  CDS 16..285
tccggagtcgccaacatgtcgaccgccatgaatttcgggaccaagagcttccagccgcggcccccggacaagggcagcttcccgctggatcacttaggtgaatgtaaaagctttaaagagaaattcatgaagtgtcttcataacaataattttgaaaatgctttgtgcagaaaggaatcaaaagaatatttagaatgcaggatggagagaaaattgatgctacaagaaccattggagaaactgggatttggagacttgactagtggaaaatcagaggcaaaaaaatgaattttgatgagaagacccctgggccgtgttcagtggtcttctcatcaaaattcatttttttgcctctgatccccaaaggaatgtaaaaaggagccccagcaggctcaggaggtgggaacaggggtgggtggccagggcatcagtgctacctcttctcagtct

SEQ ID NO: 3443 - DNA, 515 bp, Homo sapiens
  CDS 280..504
  misc_feature 16: n=a, g, c or t
agtaacaatgcaaganttgatgtcagtctataaaaggaagtaggaactgtccctggctttcaggctccaacatcctccccctgtcaagatgtggcacctcaaactttgtgcagtcctcatgatcttcctgttgctgttgggccagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtattttwawwwttwaargsmrrwkkwmssyttwaawtkgkyyycmwttyyttcttagaatgttgatatatggatagcataacta

SEQ ID NO: 3444 - DNA, 439 bp, Homo sapiens
  CDS 158..322
  misc_feature 44: n=a, g, c or t
aattctagagggtggggcgtaccaaaagacgctccaggcgccanctgggtgcttcgcggttgaggaggcgcagggaccgggggccagtagtggcgtaaacacgggccccggccgtgtccggtcgcactcggtagcccgcatggctgcctagcgaagtatgacaacttttcaacttgagtgcacacactgtccccggaatcccgcgttccagggaggaagcgcctttgacagcgcgcgccggttcgtggggcccgacggcgtgggctgtggttgcggacctggcggagatggcgcgttcgcttcgattgtaggccattccttttaggagctgagaaaggatccgtttttacagcattctcgacctgtgattcttggtggggaaaactagttatgtggataaaaatacagttagcaaaataaaaatgccaattttaaaaaa

SEQ ID NO: 3445 - DNA, 422 bp, Homo sapiens
  CDS 70..261
aaragtcctagctagggtcccaagtgacagccagcatcaactataacatgtaaaggagccagtcttcagatgattssagcctcagccttcaggccavtcarsckggkgccaaatrgagtagggatgagctgtccccacagagacctgcccagtgcacattgtgagaragtcttcaggtgcgctatggcaaggtgtggagcgactatgtgggtggtcgcaacggagacctggaggagatctttctgcaccctggggaatcagtgatccaggtttctgggaagtacaagtggtacctgaagaagctggtatttgtgacagacaagggccgctatctgtcttttgggaaagacagtggcacaagtttcaatgccgtccccttgcaccccaacaccgtgctccgcttcatcagtggccggtctggt

SEQ ID NO: 3446 - DNA, 741 bp, Homo sapiens
  CDS 76..288
  misc_feature 644: n=a, g, c or t
tttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtcmwttgragaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtagsccaaatgttgaagttaagttttccaataatgtgacttcttaaaagttttattaaaggggaggggcaaaatattggcaaatwawttncagtgtggtgtattattaaatagaaaaaaaaaattttgtttmctaggttgaaggtctaattgatacgtttgacttatgatgaccatttatgcacttt

SEQ ID NO: 3447 - DNA, 495 bp, Homo sapiens
  CDS 79..360
acaggcaatagtctacaaaaaggaggtgctatcctccagaatgcagaataaataaatcagagatctccatagagtgctatgctcctaataagaatacatgggtcaaggaaccaggggaaagaagcaggaatcatcattcttaccattattctcaatggccctctggggaaatgcatgtttcctgtcgccttaactctgggctctgcaggtttagaagtccttgtcttcaaaggaggcacactcttgccaggggacagagcaagagtttcattgaactacgggtgtctcctggacattttggactccttgtgtacaagattaacaggtaagaaggggcgtctccatctgggcaagtgtgattaactccgataactagaggagataggactgcttttggtcaactgagacatggaggaatacatatagaacctaggcgatccacttaggtatttctcagttctccttagcccccactgtaatggtaaatgaacatag

SEQ ID NO: 3448 - DNA, 518 bp, Homo sapiens
  CDS 73..402
agtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcaswtktacctgatgatcaaggcattccttcctaaaatgcttgctcagaaatctggcaatattatcaacatgtcttctgtggcttccagcgtcaaaggagttgtgaacagatgtgtgtacagcaca

SEQ ID NO: 3449 - DNA, 508 bp, Homo sapiens
  CDS 247..474
tgacatcaatagcacaaacaacaaaagagagaatagataaattagagttcatcaaaataaacaagttttgttttgcaaattatacaataaaaaatgtggaggtgacccatagcatgagataaaatgttagcaaattatatctttaagaagggacttgtatctaaaatatattaaggactcttacaactcagactaaaatgaaataaaaaaaagaatcagagtagacatttctcagaagaagaagacatgcatatggctaataagcacatgaaaaggtgcttaacatcattacacatcagggaattgcatatcaaagccacagtgagagactacacccactggggtggcaaaaagtcagataatattggtgaagttgtagagaaatgggaatccttatatgtagcaagtatcgtacccttatatgtaacccttataagtaacccttatatgcatcagcaagtattggtgaagttgtagagaaatgggaacgcttctatgtagagagggg

SEQ ID NO: 3450 - DNA, 503 bp, Homo sapiens
  CDS 102..395
ttctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttcyaatggrtattccattggagagactaattcccacagttcccttgagactcaactatattcactgggtagaagatctgatcggtcaccaggattctgacaaaagtactctccgaagaggaattgacataggtatatcattttaaattcttttttggctaaacagtttttcataagttttgcgagatcaaattctttgtaactt

SEQ ID NO: 3451 - DNA, 452 bp, Homo sapiens
  CDS 31..231
tgtaggtgttttattctagtgtagccattcatgactcttctgtatgcattgcataccatatccactctcacagttatgccttcttctaccttatactcgccatatcactgcctcctacgtaaaaccacacaaatacaaatcaaagagatgaaacagatagataaactcagtcttgtggtggctcacacctgtaatcccagcactttgggaggccgaggcgggtggaccacctgaggtcaggagttcgagaccagcctgaccaacatggagaaaccccgtctctactaaaaatacaaaattagccaggtgtggtggtgcatgtctgtaatcccagctactcaggaggctgaggcaggagaattgcttgaacccgggaggcagaggttgcggtgagctgagatcgtgccattgcccttcagcctgggcaacaagagcaaaactccgtctcaaaa

SEQ ID NO: 3452 - DNA, 413 bp, Homo sapiens
  CDS 13..180
aaggatcgctccatgaccacgtacgctggcggcccstcttccggcttacctcaggggctggtatcgcgggcctgttctttcatcagaaagatctatattttgctaataaaggaacgctttgtgtccaataaggttttcgtcattacgcatgaaaacgccaccttaagcttatgtcgcctgtgaatatttaagggaaaaaaacatcccggcaaccaactgctaggcgacggacgctaagcacctcctccccgcggacgtcagcacccgccttttcccgaagtcgcaacacgcaggcgcgctccggctcgctcaccacgcacggaagkstcyttgcgccaggagacgccccgcccagcccctggccgactataaagtgtcgagcttctcctcgcgakracttagtgctcatgctc

SEQ ID NO: 3453 - DNA, 325 bp, Homo sapiens
  CDS 13..180
  misc_feature 36: n=a, g, c or t
aaggatcgctccatgaccacgtacgctggcggccsntcttccggcttacctcaggggctggtatcgcgggcctgttctttcatcagaaagatctatattttgctaataaaggaacgctttgtgtccaataaggttttcgtcattacgcatgaaaacgccaccttaagcttatgtcgcctgtgaatatttaagggaaaaaaacatcccggcaaccaactgctaggcgacggacgctaagccctcctccccgcggacgtcagcacccgccttttcccgaagtcgcaacacgcaggcgcgctccggctcgctcaccacgcacggaagt

SEQ ID NO: 3454 - DNA, 283 bp, Homo sapiens
  CDS 89..244
cccagtttctccgtcagcctgcgggtcccggctggcggctgcttccggtagagagcggtgtagagcgagcaggtctcagctcctcgtcatgtcatacggtcccttagacatgtaccggaacccggggccctcgggscaaccytccgggacttcagcagcatcatccagacgtgaagcggcaacatccagcggatcagccaagccactgcttcagataaagaattttgatgagccagctaggaactaagcaggactcaagcaagctacagggaaaatctgcaac

SEQ ID NO: 3455 - DNA, 540 bp, Homo sapiens
  CDS 175..498
gcagccattggatccggagaccggatcgatcaggtccggcgggctccttaccctcgccgtgcccccactccttattcggacctacctgacagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgttctgaacgctgtcgtctgtctgtttcctc

SEQ ID NO: 3456 - DNA, 450 bp, Homo sapiens
  CDS 248..406
agttattttcgcctgccatagtgtacaccagtcttgaaacttgttactgtcgtagagcaaccaaaaatttgagaataccgaattgtattccctacccgtccccaggatgtcccattttgaaaatatggagccctgcgatctggattggctcataagaatgttaaatctaaaaagactgatcgtatccgtcatgcacctaatcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggctttgtagtgccacccacttccaaaccagctttggtctctcaatctgga

SEQ ID NO: 3457 - DNA, 571 bp, Homo sapiens
  CDS 248..553
agttattttcgcctgccatagtgtacaccagtcttgaaacttgttactgtcgtagagcaaccaaaaatttgagaataccgaattgtattccctacccgtccccaggatgtcccattttgaaaatatggagccctgcgatctggattggctcataagaatgttaaatctaaaaagactgatcgtatccgtcatgcacctaatcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttactagctaaagagtgtacgt

SEQ ID NO: 3458 - DNA, 478 bp, Homo sapiens
  CDS 313..471
gtgtgtgtcctttgtaaagcgtgcttcgctgggctctgtggggtctattgaccttggctccaggttccctgctgcttcctgtgccttcctcagcctagtacgactacaacagagaaatggtcccagtgggaaatcagatactgagtcttagatgaagatttccagtgagaagaaacagataggatgagaagcttagaagagtaattgcccttaagaaagggatcaataacattcggggatgtggccatagacttctctcatcaggagtgggaatatctcagcctggttcagaagaccttgtaccaggaggtgatgatggagaactatgacaacttagtatcattgggacattccgtatctaagccagatttaatcaccttattggagcaaggaaaakagccatggatgattgtgagggaagaaacaagaggagagtgtacagagctacagagtaaaaattgtggattcaactgagaga

SEQ ID NO: 3459 - DNA, 565 bp, Homo sapiens
  CDS 114..353
tttcmggcttcgctgctggtgtcggctccgagagctctggcttatcaggactccatagttctccaacagagaaatcttgaaaaggactgaccagtttttgcagttctaaaaccatggcccatggttcagtgacattcagggatgtggccatagacttctcacaggaagaatgggaattcctggatcctgctcagagggacttatatagggatgtaatgtgggagaactacagcaacttcatttcactaggaccttccatttctaaaccagatgtgattaccttattggatgaagaaaggaaggaacctgggatggttgtgagggaagggacaagaagatactgccctggtgagtgagggctgagcaggcattgagaaatcactactgcaggtaatagctaaactgattagggtggaggcacacccttgagatgttggggtctctcttcaaaaagcccctggcctatggaggcagggcttgggacttgaagcaaattaagatcttttaagcctggactagcaaaggaactttctattgatcttgaatgcacactgtttctcatctt

SEQ ID NO: 3460 - DNA, 543 bp, Homo sapiens
  CDS 118..330
aatagcgtccctagcgcgatggcgtatcggcgcaggcgcactctgccggcaacgccgaggcgcttctgcatctgtgggccgagcattcttcaggtcatctgaaccttctgagaaaacatggtcaacgtcttgaaaggagtgcttatagaatgtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccataaaatttaaaaaaaaaaaaagctttaasagtt

SEQ ID NO: 3461 - DNA, 495 bp, Homo sapiens
  CDS 232..462
agaacctgtacagagaggtgatgctggagaactacaggaacgtggtctccctgggtaaggcaagcatcactaattcctgtgttcattgattcacatttatctggtgtattagtctgttctcacactgctaataaagaaatacccaagactgggtaatttgtaaaggaaagggggtttaatggactcagttccacatggccggggagggctcacaatcatggtggaaggcgaatgaggaacaaagtcacatcttacgtggcggtaggcaagagagcttgtgcaggggaactcccatttgtaaaaccgtcagatctcgtgagacttattcattaccacgagaacagtatggggaaaaccacctccaccatgattcagttatctccccctggctccacccttgacgtcgggattattacaattcaaggtgagatttggatggcaacacagccaaaccatgtcatctagcatctactatgtgtctggcaccatgctggg

SEQ ID NO: 3462 - DNA, 546 bp, Homo sapiens
  CDS 82..252
aacggattagcaccttaacggattagcaccttaacggattagcgtggcaagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacaggtatgggtgacattcagtctgagacttcaactgcttttttgtttgaataggcaggatgcattggtgtttacagtgttccatctcattataggaaattgtagacatacaaaagtagatggattgatatttcagcccaatacgctcatcacgctcatcaccattatcagctcacagccagttgtaactctgtgatacccaccctcccctcttattattttgaagcagattctggacatcatatcatttcatccataaatattttattatcttggaaagagaaggattcttttaaaaatataatcctaataccattatcagtccttaaaataattgataatcat

SEQ ID NO: 3463 - DNA, 577 bp, Homo sapiens
  CDS 300..461
  misc_feature 67: n=a, g, c or t
tgaaagagttgggaagggtcgagtctcactccttcttttcaaagttgaggagatggaagcccagggntattaacatcaagaccattcaactaggtggtggcagagccaggattgaaacttacattctttaaaataaaagcttgcaaataactttgtaatacagttaaggtaacctagcatggattaatttttaattcattgatgactctaattataaaaatgtcacatggcttaaaaaaatttttgctttttaaaaataccctgagtaaccaacatgatggggctgggcacaatagctcatgcctgtaagcccagcactttgggaagctgaggcgggcagatcacctgaggacaagagttcgagaccggcctggccaacatggcaaaaccccatctctactaaaaatacaagaattagccggtgtggtggtgggcactgtaatcctatctacttgggaggctaagacaggagaatcacttgaacccgggacacagaggttgcagtgagccgagatcgcgccattgcactccagcctgggtgacaagagtgaaactccatctaaaaaaaaaaaattar

SEQ ID NO: 3464 - DNA, 481 bp, Homo sapiens
  CDS 112..303
tacacctgattaattatttctgttcaaaaatgccaagaattaaaaatatattgaacccttgactttcctccttccggaagagatcagaggaagatctctcttatatacaagatgccagcctttcctaaagggcagagccaagttcacggggcctgggaggcctgctttaagaatacaaaattagggccaggcgtggaggctcacgcctgtaatcccagcactttgggaggccgaggcaggcggatcacctggggttgggagatcgagaccagcctgaccaacgtggagaaaccccatctctactgaaaatacaaaattatctgggcctggtggcgcatgctgtaatcccagctactcgggaggctgaggcaggacaatcgcttgaaaccgggaggcggaggttgtggtgagccgagattgcgccattgcactccagcctgggcaacaagagcgaaactttgtctcaaaaaaaaaaaaaaaa

SEQ ID NO: 3465 - DNA, 526 bp, Homo sapiens
  CDS 43..342
gcagatcctctacgtgtgtcctcgcgagacaagctcaccgaaatggccgcgtccagtcaaggaaactttgagggaaattttgagtcactggaccttgcggaatttgctaagaagcagccatggtggcgtaastgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaasagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctgg

SEQ ID NO: 3466 - DNA, 978 bp, Homo sapiens
  CDS 530..742
cttttsttttccgtgctacctgcagakggcgtccatacggcgttgttctggagttcccagwcgtaaacttaaatgggaaattttcacaatgtccggagcccttgatgtcctgcaaatgaaggaggaggatgtccttaagttccttgcagcaggaacccacttaggtgggcaccaatcttgacattccagataggaacagtacattctataaaaggaaaagtgatggcatcttatatcataaatctcaasgaggacctggggagaagcttctgctggmcagctcgtgcaatttgttgccattgaaaamccygcbgawdkgccaagggktaawaccccccaggraatactggccagagggctgtgctgaaagtttgctgctgccactggagccaactccaattgsatggccgcttcacttcctggaaccttcaactaaccagattccaggcagccttccgtggagccacggcttcttgtggttactgacccccagggctgacccaccagccctctcacggagggcatctttatgttaaccctacctaccaatttgcgctgtgtaacacagattctcctctgkgcykgtgtggacattgccatcccatgcaacaacaagtggagctcactcagtgggtttgatgtggtagatgccggctcgggaagtttttgcgcatgcgtgcacaccatttcccatgaacacccctgggaggtcatgcctcagctctgctktctacagagatcctgaagagatttgaaaaagaagagcaggctgctgcttgaaaaggcagtgaccaaggaggaatttcagggtgaattkgactgctccagctcctgaaggttcactgctactcagcctgaggttacagactggtycctgaaggtgtgcaggtgccctctgtgcctattcagcagttccctactgaagactggagcactcaccctgccacggaagactggtctgcagctcccactgctcag

SEQ ID NO: 3467 - DNA, 511 bp, Homo sapiens
  CDS 10..189
ctttctagcatgttgccctttttcaaccacatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggctggttcgctacaacaatgtcttccacaactcaaactcccaccgctcacacaaccggtccactcctgccttttcactcacacagctcccgactgcttcttgcagaggctgagagtcccccccccaccttttttttcatttagatgtaacaaacctagtagtttatgttcatcaattgtctgtatatctctatattttatccatgtactcttttgatgtatagaagtagtttgaaactcaa

SEQ ID NO: 3468 - DNA, 546 bp, Homo sapiens
  CDS 303..503
  misc_feature 114,435: n=a, g, c or t
atatatatcctcctggaatactggccagagggcatgctgaagtttgctgctgccactggagccactccaattgctgaccgctttactcctggaaccttcactaactagatccangcagccttcccggagccaccgcttcttgtgcttactgaacccagggctgaccaccagcctctcacggaggcatcttatgttaacctacctaccattgctctgtgtaaacagattctcctctgtgctgtgtggacattgccatcccatgcaacaacaagggagctcactcagtgggtttgatgtggtagatgccggctcgggaagttttgcgcatgcgtgacaccatttcccatgaacacccctgggaggtcatgcctcagctctgcttctacagagatcctgaagagattgaaaaagaagagcaggctgctgctgmaaaangmatgaccaaggaggaatttcagggtgaatggackgctccagctcctsgagttcactgctactcagcctgaggttacagactgggctgaagtggcagtgcctctgtgctat

SEQ ID NO: 3469 - DNA, 495 bp, Homo sapiens
  CDS 191..436
  misc_feature 410,415: n=a, g, c or t
atatatatcctcctggaatactggccagagggcatgctgaagtttgctgstgccactggagccactcsaattgctgaccgctttactcctggaaccttcactaactagatccaggcagccttcccggagccaccgcttcttgtgcttastgaacccagggctgascaccagcctctcacgraggcatcttatgttaacctacctaccattgctctgtgtasacagattctcctctgtgctgtgtggacattgccatcccatgcaacaacaagggagctcactcagtgggtttgatgtggtagatgccggctcgggaaagttttgcgcatgcgtgacaccatttcccatgaacacccctgggaggtcatgcstcagstctgsktctacagagatcctgaagagattgarangrgancaggctgctgctgaaaagcagtgaccaaggacgaatttcagggtgatggactgctcagctcctgagttcactgctactca

SEQ ID NO: 3470 - DNA, 484 bp, Homo sapiens
  CDS 152..451
  misc_feature 69: n=a, g, c or t
ccaagcgccatggccgctgccgcccgagcccgggtcgcgtacttgctgaggcaactgcaacgcgcagcncagttgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgaggtggaaccaacggattcaagcttcatggaagctattgagtttgcccaaaagggagcttttgatgcctatgttgctgtcggtggtggctctaccatggacacctgtaagctgctaatctgtatgcatccagccctcattctgattt

SEQ ID NO: 3471 - DNA, 512 bp, Homo sapiens
  CDS 37..405
ataaaaacagctgggctcccttggagacagagcgccatgggaaaccgggtctgctgcggaggaagctggagctgcccatcaactttccagaagaaaaagaaaagaggaagccaaacaagacggacactgaagccgcagccacaacagctgcagcagaatctcccaaagggccatgaaacaacaggacatacgtatgaacgggtgttacagcatcaagggtctcaagagaggagtccaggcctcatgtcggaagacagcaacttacattatgctgacattcaagtgtgcagccgtccccatgcccgggaagtgaaacacgtgcatttagaaaacgctacagagtatgcgacccttcgcttcccccaggccacacctcgctatgacagcaagaacgggaccctggtgtgagcgcttgggaggaaggcccagtccatcgttaaccactacacctgtgggggagaacctactgctttggggaattgggtggcaaccagggatgttgtccacgtttt

SEQ ID NO: 3472 - DNA, 492 bp, Homo sapiens
  CDS 156..347
atttttctgctttaagatcctttccatgacttccttgtttaggccagcctccacgatccagctgccaaccatctagcctaccctgatctctgagcaggggtcgtcgtcattttactccagaggagactgaagccaaaagactccccatccccaggatgtcaacctcagtccctcaaggccatacctggacccaacgagtgaagaaagacgatgaggaggaggacccgctggaccagctgatctcccgctctggctgtgctgcctcccactttgcagtgcaggagtgcatggcccagcaccaggactggcggcaatgcagccacaggtgcaggcgttcaaggattgcatgagtgaacagcaggcgaggcggcaagaggagctgcagaggaggcaagaacaagccggtgcccaccactgagaccccaaaccacctatccccagtagatgggcctgcaagaccagcacccagcaagattatagaggaagaaatcc

SEQ ID NO: 3473 - DNA, 438 bp, Homo sapiens
  CDS 78..242
agagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggaggcaccatgcaggagctgcatctrctctggtgggcgcttctcctgggcctggctcaggcctgccctgagccctgcgactgtggggaaaagtatggcttccagatcgccgactgtgcctaccgcgacctagaatccgtgccgcctggcttcccggccaa

SEQ ID NO: 3474 - DNA, 512 bp, Homo sapiens
  CDS 44..256
tcctagccctgaagtagttagagagtcctaggtgaaccatcctatgcagaagaaaaagttttgcagtgttttgtttggaaatttctttgttctaagactatgtgaaattcatctctttttagcagaacttaaaacctacataatacctatcagtgcaggctgcttagtatccagaaatattacttattttggactttggccaggttgggtagtgctgaaagtaactgagtgtcaagtgtggttggaattaaaattttgacccttttatgtacccttagaaggaatctaacattagtatttgattctgaaaaccagttttgaacttggttagtttgatggctacaatctattgtttacttatcaatgatctgtaaagcatcttaaaggttaacattttagaaataaaacaagtttctgcttggttcaatgatgcgcctttagtctcagctacttgggaggatcacttgaggccaggagttcaaggcagccatatggtatgatcatgcctgtga

SEQ ID NO: 3475 - DNA, 497 bp, Homo sapiens
  CDS 13..198
agatagattgtgatgttaaaggtgcatactgtaaaccctaaaatagtcactaaaataacaaaacgaaaagttattgttaataagccaacaaaggaaataaaatcaaatcataaaatacaaaagaaagcagaaaaagaacaaagggcagcctggacaaacaaaactactgagcagcagaatgatagagttagtcctaaataaccatgtgaaacaaacgatgcagacaccctcatttaaaagacagagattggctgggcacggtggttcacacctagaatcccagcactttggttggccaaggcggatgggttgcttgagcccaggagtttgagaccagcctgggcaacatggcaaaaccctgtctctacaaaaagtgcagaaattggctgggcgtggtggcgtgtgctgctgtgaggcgaacagggggattgctgggaagtcgaggctacagggagccaagataaaaaaacaaaaaacaaagatggtcagtttggata

SEQ ID NO: 3476 - DNA, 511 bp, Homo sapiens
  CDS 27..266
gcagtcccccttgaacgcacctcaggatggcccgtactttggaaccactagcaaagaagatctttaaaggagttttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgakagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatattttattgtcaaagataaatgtttcaaaaagaaattga

SEQ ID NO: 3477 - DNA, 528 bp, Homo sapiens
  CDS 37..276
gttgcgcatgcgagtcccccttgaacgcacctcaggatggcccgtactttggaaccactagcaaagaagatctttaaaggagttttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatata

SEQ ID NO: 3478 - DNA, 498 bp, Homo sapiens
  CDS 239..475
  misc_feature 472: n=a, g, c or t
actgggtttcggcgtctggcaagcggttcagctgtctgctccctagcagccggccttcgggtcgggcgtctccgcggctactgcgcttcagttctcccggtgtggccacgagtcggattttggatataagtaatgtgcaggtttcttacatgggtacattggatgacactgaggtttggggtactgttgatcccatcatgcaggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccganaaataaattgtatttttcactcgatg

SEQ ID NO: 3479 - DNA, 478 bp, Homo sapiens
  CDS 173..334
acacctaaggtactgaagtagagttctggctgttccttacggacatctctggtgtcatagctctggtgaagmgttaacgggaagattttatcctgctctgtgctgacaccgtctcacttcgagcatgcaccaagactctagcttcctgtcttaagacctctctgatgcagcaatgtgtgatgctaaggaggatgcagcattcaaggttctatcttggaagcagagactgtgccctcaccagatgctgaacctgctgagcaccctgatcttccacttcaccttcatcagaactgtctttgaggaattgtcacactgtcttctgcaatggatgaactaatttacactctcaacaacagtgtataagcattccttttgctctgcaacctcaccagacatctggacgcgcatgaaatttggtgccgtgactcggatcggcggacctcccttaggagatcaatcccctgtcctcctgctcttt

SEQ ID NO: 3480 - DNA, 531 bp, Homo sapiens
  CDS 253..414
aaagacaagaaatgaagggcagggcatatattttggtaaattttcttctttaggaaatagatgtttataatgtgtatgtgttttagtgactctgaatggaaacttattgtgtaataagtctattaattactaaaggacagggtatattttacagagtaaaaatgattgtgattcaaatcagtgttatttttaactgcatgctaaaccttttaatatgaattatttcatcctcaaatagtgtgcttttgctctatgatcatattaactktattcaacttaaaagtgaaaggatacgaattaattttaaaaagattacctgtcttattagtgcattggggttttaattacgtttatattagagcctgttttcagttttatcaaaatttaagaaataaagtagaagtccaaataggatagtttgtaaaagcataactccgtgtaccatgaaccaacactattaccaggaacaagcagcccagataaaatacctttgaaatcatatctcttgttgcttagggagatcatcggggc

SEQ ID NO: 3481 - DNA, 539 bp, Homo sapiens
  CDS 7..207
tcttaaatgatgtcccttaagtcatatcccactaactttctatatatttctatatttccaacattaatttttatgatgcattacttgatttgcccagaatgtattatggatatatgttcttatcacctttttttctccattaacctgatgtawttawttagccagatatgctgtttatcaacaaagaaaatatatgtggtttatccttgacctcacctggtctttatttggatgccggtagaatccctttctgagatctatagggagggtgggttatgtgcatagcttttgagccagagtctaatgtttagattctagatactaaaatagattatttttctgtttcacatctgttggactaaactagaatcttctataactgtgggagtacaaagaaagatttcctatcactccattggttgtttggttgattgactaattgattgggagccacgcctccctgaaaggatcacaccattgcatgcctatctggsctcctcatctttccccactcccaagctcttggcctagcatttacc

SEQ ID NO: 3482 - DNA, 661 bp, Homo sapiens
  CDS 183..545
ctctgtctcctcattgccacagccaaccggctcccacatatctgcacacacttaaatacaaaggccgggaagggtcagaccaccatccgggtactctaaggtacataaaagagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacgggacgtggacatcgtgttcagcaaagtcaaggccaagaacgcccgaaccatcacgtttcaacagttcaaagaggcagtgaaggaactgggccagaagcgcttcaaagggaagarrtccagatgaagtccctggagaacatttatggactcatggaggggcaaagacccagccaccactgggcgctactaaagcaacaacagtgggtgcartggaccgtttgacagacaccagcaagtacaccggcacccacaaggagcgctttgatgagagtggcaagggcaagggcattgcgggacgggaagagatgactgacaacacaggctatgtgagtggt

SEQ ID NO: 3483 - DNA, 556 bp, Homo sapiens
  CDS 137..337
acacatatctgcacacacttaaatacaaaggccgggaagggtcagaccaccatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtgacatcgtgttcagcaaagtcaagtgaggagccaaaaatatggaggtgggggtgagaagaacctgcgaggtagttggccacggaagggttcacgtggtggaacatttgcagtgggcctaccaagcaccacagggtacctggcgctgtgctatcctttgtcttcragacactcactgattgataggacaaaagaggccaaatctgagtgaggmagagttggccttggaaggtaatgcattcatgctccaaagtttctggattctgtctacta

SEQ ID NO: 3484 - DNA, 518 bp, Homo sapiens
  CDS 152..370
acagccaaccggctcccacatatctgcacacacttaaatacaaaggccgggaagggtcagaccaccatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtgacatcgtgttcagcaaagtcaaggccaagaactcccgaaccatcacgtttcaacagttcaaagaggcagtgaaggaactgggccagaagcgcttcaaagggaagagtccagatgaagtcctggagaacatttatggactcatggagggcaaagacccagccaccactggcgctactaaagcaacaacagtgggtgcagtggaccgtttgacagacac

SEQ ID NO: 3485 - DNA, 546 bp, Homo sapiens
  CDS 117..290
aatcagttcaggctgcgcggaggagagaaggaagtgctgatgtggagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaagtgaggagccaaaaatatggaggtgggggtgagaagaacctgcgaggtagttggccacggaagggttcacgtggtggaacatttgcagtgggcctaccaagcaccacagggtacctggcgctgtgctatcctttgtcttcgagacactcactgattgataggacaaaagaggccaaatctgagtgaggcaagagttggaccttggaaggtaatgcattcatgctccaaagtttctggatttctgtctaactgaccag

SEQ ID NO: 3486 - DNA, 478 bp, Homo sapiens
  CDS 89..307
  misc_feature 19,23,447: n=a, g, c or t
accatccgggtactctaantccncccksccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtgacatcgtgttcagcaaagtcaaggccaagaacgcccgaaccatcacgtttcaacagttcaaagaggcagtgaaggaactgtgccagaagcgcttcaaagggaagagtccagatgaagtcctggagaacatttatggactcatggagggcaaagacccagccaccactggcgctactaaagcaacaacagtgggtgcagtkgaccgtttnacagacaccatcaagtacaccggcacccaca

SEQ ID NO: 3487 - DNA, 561 bp, Homo sapiens
  CDS 89..553
  misc_feature 239: n=a, g, c or t
accatccgggtactctaagtccwccctcccccttctccttcacccccaagtgtctcccacgactgccctccccgacctctagctgaccatggcatcagaggcagawmaaacattccatcggtttgctgcgtttggagaatcatcaagcagtggcactgaaatgaacaacaagaacttctccaagctgtgcaaagactgtggcatcatggmtggcaagacagtcacctccacggacgtgnacatcgtgttcagcamagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagasccagccaccactggcgctactaaagcaacaacagtgggtgcagtggaccgtttgacagacaccagcaagtacaccggcacccacaakgmgcgctttgatgagastggcaagggcaagggcattgcgggacgggaagagatgactgacacacaggctatgtgagtggt

SEQ ID NO: 3488 - DNA, 478 bp, Homo sapiens
  CDS 89..307
accatccgggtactctaagtccdccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtgacatcgtgttcagcaaagtcaaggccaagaacgcccgaaccatcacgtttcaacagttcaaagaggcagtgaaggaactggccagaagcgcttcaaagggaagagtccagatgaagtcctggagaacatttatggactcatggagggcaaagacccagccaccactggcgctactaaagcaacaacagtgggtgcagtggacsgtttgacagacaccagcaagtacaccggsacccacaa

SEQ ID NO: 3489 - DNA, 527 bp, Homo sapiens
  CDS 256..411
ttcccggagagggggagccgcggggacgcagcgacagactcggggtgctggcagcggcagcccacgcctcccagggattgcaggcctgggcgccggggttggaccagtctcccgggcatggcacgccctggttattctgtacccgtgatttgtggcggggcaagacgttaagttgggtgacaccgaggtgagccacggtcctcggcaccagatgaggaaccactgtctcaataaggtctcagtgctgtgtgtgtaatggttaccgtgagagcttccctgcaatccgaatttgtgtgtctcattctcagtgacaccagtgatgctgttaaacaaggacaatccggttcatggattgtgacaacgcacgctgacatcaagcagaccctgccgtcagtacagagggcaccacagtgaccaggaactgctgtcctttcataccaggttttaggaggctttaccagaaggaatggaaaatgctggtgggcagtaagattgaaacagcatctgaggactggkttctgcacaaa

SEQ ID NO: 3490 - DNA, 482 bp, Homo sapiens
  CDS 107..454
agggcgtcccggagcaggccaacgggactacgggaagcagcgggcagcggccsggggaggcacctcggagatctgggtgcaaaagcccagggttaggaaccgtagcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacggaaccaagcgtttaatgaagacaatctcaaattcatcctcatggactgcatggcccaggctttggtgcagtacctggaggagcccctcacccaagtggcggcatcttaacggcattggtggaagctggggtcagaaaagagaaatgaccatttggaggggcggggcctcctagaagaaccttcttagacaatgggggg

SEQ ID NO: 3491 - DNA, 561 bp, Homo sapiens
  CDS 120..359
aactacaactcccagggcgtcccggagcaggccaacgggactacgggaagcagcgggcagcggcccggggaggcacctcggagatctgggtgcaaaagcccagggttaggaaccgtagcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggcccaggctttggtgcagtacctggaggagcccctcacccaagtggcggcatcttaacggcattggtggaagctggggtcagaaaagagaaatgaccatttggaggggcggggctcctagaa

SEQ ID NO: 3492 - DNA, 522 bp, Homo sapiens
  CDS 119..358
aactacaactcccagggcgtcccggagcaggccaacgggactacgggaagcagcgggcagcgcccggggaggcacctcggagatctgggtgcaaaagcccagggttaggaaccgtagcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggcccaggctttggtgcagtacctggaggagcccctcacccaagtggcggcatcttaacggcattkgtggaagctggggggtcag

SEQ ID NO: 3493 - DNA, 477 bp, Homo sapiens
  CDS 205..411
agcaacagcggacsagmttggagaccagcagcagggagctccaagccgcggagtatttggaaaagcatcagatcaaggaggtggttagctacctcaccagcgccctccttttctttcggccggaaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaagccctaaaaaccctgggtctatgcactgaagatgaagatttacaagatgatggacataaaataactttggataaattcaaggaggaagtgaacaagaggatgaaggaaatatggtcagcattttaataacaccataaatccaagataataagtaattctataaagttttccagtttcattaattcagaa

SEQ ID NO: 3494 - DNA, 494 bp, Homo sapiens
  CDS 204..419
agcaacagcggacsagmttggagaccagcagcagggagctccaagccgcggagtatttggaaaagcatcagatcaaggaggtggttagctacctcaccagcgccctccttttctttcggccggaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaagccctaaaaaccctgggtctatgcactgaagatgaagatttacaagatgatggacataaaataactttggataaattcaaggaggaagtatgtatacatccagcttctctacaagcatttgccagaaaattttaaataaggagaaacaaagctgctgctccaactgaagtaaatggtctcgtaacgtcagcagcaacgggcaagccg

SEQ ID NO: 3495 - DNA, 533 bp, Homo sapiens
  CDS 213..521
acctgtttctcttgcacctgacgtgcagctgctcctacccacctctcctggctgagccttgcctgatacagcagcccggaggcaccacttgcttcccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaagtgctgtatgagatccctgacacctatgcccaaacagagggagatgcagaacccccgaggcctgacgctggaggccccaacagcgactttaacacccgcctggagaagattgtggacaagagcacaaagggcaagcacgtcaaggtctccaactcaggacgcttcaaggagaagaagaaagtgagagccacgctggcagagaaccctaacctctttgatgatcacgaggaaggacggtcatcaaagtgaagggctgag

SEQ ID NO: 3496 - DNA, 470 bp, Homo sapiens
  CDS 109..264
agaggaaaaagtttcaggactcatggagagctaaaattttcaagagtatcaagcagaacaggatttcgctgcatgaactaaaccaatctttttgactttttgcttaatatgtttgctgatcctttgtttcattttcagagtctcaaaacttttcttttgagctattggcagcttttaacaatttggtatactcctatgaacaaaatttggagcacatttgtttctctttatgtgatttctccagaatttggaaactttagtcactgaaaactaagctgtgctttctttaaaccctccaaactgaagccacacaacttaaatttcagaagaaaataagagaaacttattcacatccaaaagccactttcacacctgcctactaatgtatggacttcagcgtaacgtggcctatatcgatttttccaggattgttcttttgtttgttgctgctttttctcccttccttccca

SEQ ID NO: 3497 - DNA, 520 bp, Homo sapiens
  CDS 160..327
ttagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccagkggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgayacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctc

SEQ ID NO: 3498 - DNA, 684 bp, Homo sapiens
  CDS 186..515
ttgacgagccgggccggaagaagaggtagggcgccgcgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccacccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggcacagccacttcctgcctcctgaggactcctctgacggcaggaaaactggacatgaatgactgcccccccgcccctcccctgcagagtggccagatggagtcctgagccctggacatgggcccggctttcctggatatcaggacttccaataaataaagactctgtatactgcaaaaaaaaaaaaaaaa

SEQ ID NO: 3499 - DNA, 465 bp, Homo sapiens
  CDS 56..328
gaagggaccaccgggaacagacggatcggcagggcggggcggaacggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataatatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggat

SEQ ID NO: 3500 - DNA, 609 bp, Homo sapiens
  CDS 366..593
gcgtgcgcgtgcgttggggcctcagcctttatctccactctgcggagattcacgcctggaaaacgctcttctgagagratctgtggaggtcaacccargagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgaggtatggatgttcccatccctaatttgcaaaataggtaactgaggctcaggagagctagactagtttgtgcacagccgagaagtggtcaagctagaatgggaccccaggtttgtgctccctactctccaccgataacctatcaaagggctttgcaagagcttttgactaatcgtctgtcaatggttcttcattcacgtattaattgcacatcagtatgtgccaaatctactagacattggagaaacagtaggaacaacacatggtaccggcacatggatctttcaggaaaacgarkaggtaataaacaggaaaaagcccgagtctgatgctaagaagaaa

SEQ ID NO: 3501 - DNA, 511 bp, Homo sapiens
  CDS 69..239
agcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttaaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagttaaagttctattataatccaaatttca

SEQ ID NO: 3502 - DNA, 490 bp, Homo sapiens
  CDS 112..276
  misc_feature 337..338: n=a, g, c or t
gtgtggtgatctcaattacttkacctgagtagactactswagcagcatttgaagctgcagtcttgaaacacatgcaggctggaaaagtcgcwaaagaattacwtatttgagatggsacatgtttctgcagrrrctcaagatgtttctcctaaagatgaatcaactggttcaaaagcctcctctgggtctccattgtgkgaacacataatccctggggattcagacttaaggtcaakgactgaatcaatgattttcaggtkttgccacaaggatccttgataaaaaggccacattakactttatgtctctgagccagatrragataatgattwkchhnntctgacctttcccagtaaactttggaaaatagctgaaagtgaccaattcaagtctaattcataggataagaatgmaacttgcatagtgactaatgaagaactcttcaagaaagaaaatttggraataaaggctccttacagaatatttcaaa

SEQ ID NO: 3503 - DNA, 513 bp, Homo sapiens
  CDS 119..277
gtgtggtgatctcaattactttacctgagtagactactgaagcagcatttgaagctgcagtcttgaaacacatgcaggctggaaaagtcgctaaagaattacttatttgagatggcacatgtttctgcagaaactcaagatgtttctcctaaagatgratcaactgggttcaaaagcctcctctgggtctccattgtgtgaacacataatccctggggattcagacttaaggtcaatgactgaatcaatgattttcaggttttgccacaaggatccttgataaaaaggccacattatactttatgtctctgagccagataaagataatgattttccttctctgacctttcccagtaaactttggaaaatagctgaaagtgaccaattcaagtctaattcataggataagaatgaaacttgcatagtgactaatgaagaactcttcaagaaagaaaatttggaaataaaggctccttacagaatatttcaaactgacagtatgaaaatcttaat

SEQ ID NO: 3504 - DNA, 394 bp, Homo sapiens
  CDS 54..257
aaccaagaggctggcgacatgctaggtcaggttgtccggagaatcggggctgaatgggagagatcttgagggcaagagcctcagagaccttcaggcaccgagctcgtgaaggtttccaagtgcccctctctagctgctcccagggggaattagtggkttgctacagtagtttaagagggtcgtggtttttcgcaacccgggcggcgagatggcgctttggtgtaagcgaggaggacagtacaggacatgagtcctggtgagggacccgaggagcaggacagagaagacggcccctgaatcccatttggccccttgctggctggaggtgtgaaaaccagcggtggaggcagccttcggggcctgcatttgagaataagggtgtcactagttccag

SEQ ID NO: 3505 - DNA, 502 bp, Homo sapiens
  CDS 15..218
atgtatgattttggatgagctgtacacccaaggattctgttctgcaactccatcctcctgtgtcactgaatatcaactctgaaagagcaaacctaacaggagaaaggacaaccaggatgaggatgtcaccaactgaattaaacttaagtccagaagcctcctgttggccttggaatatggccaaggctctctctgtccctgtaaaagagaggggcaaatagtctccaagagaacgccctcatgctcagcacatatttgcatgggagggggagatgggtgggaggagatgaaaatatcagcttttcttattcctttttattccttttaaaatggtatgccaacttaagtatttacagggtggcccaaatagaacaagatgcactcgctgtgattttaagacaagctgtataaacagaactccactgcaagagggagggccgggccaggagaatctccgcttgtccaagacaggggcctaaggagggtctccacactgctgcta

SEQ ID NO: 3506 - DNA, 478 bp, Homo sapiens
  CDS 1..153
atgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaaactatgttttcaacaagcaaaaatatagtattctaagattaaaatgtcattac

SEQ ID NO: 3507 - DNA, 497 bp, Homo sapiens
  CDS 6..206
acttaatgtcctccactgtatgcaacagccccacaaatgaattgttctcacctcacatccctccctcactcaacccaccaatgccaatagtgttcatactaagaaacacagaatcccagggagcttcatttcactttcccaaaggagtagccttagctctttgggccactacagtttttaaactctgtggcgtaaccatgactgtgtgatatcttggtacacagaggccctctggtcgtgatttgtgctgctaggcaaacattctgatcatccccattctggacacacggaagggtaggagcaatgtgtccagcaatgggcaatgagctgtgagccagagagcacgccccttctgcaatgaacaatgaattgtcaatgaacaatccacaaaggtgctcttttttcctggccacagctggagacgttgtaacaatggctgctccatgagtatgggtcctagagggaagacagtgataattcagagtagaacctcctgc

SEQ ID NO: 3508 - DNA, 470 bp, Homo sapiens
  CDS 62..250
cttttcaagaggttagggaaagtttttagtattcagattgaagtttttcttcagatcttgaatgtttgaaaatttttttattttagcttttagtggacatataataattgaacatatttctggggtaaacagtgatgtttggaagcacataatgtatagtgatcagataagtgtgattagaatatccatcatctcaaacatttatcgtttcttcgtgctgggaacattcaatatcctccttctagctgtttgaaaatacagaatatattattgttatggtcatcccgcagtggtatagaacactagaacttactcttccaatggagctgtaattttgtatcctttaacaaatctcttctcatccccccacccctgctatccattcccagcctcaagtatcctctgttctacttatttctatgagatcacccttttttagctttcacagatgaatgagaacatgcagtatt

SEQ ID NO: 3509 - DNA, 557 bp, Homo sapiens
  CDS 89..313
ctgagtcagtctcgccagctgccggtctttcgggggctccgtaactttctatccgtccgcgtcagsccttgccaccctcatctccaatatgcctggtccgacccccagtggcactaacgtgggatcctcagggcgctctcccagcaaagcagtggccgcccgggcgsgggatccactgtccggcagaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaacttttt

SEQ ID NO: 3510 - DNA, 495 bp, Homo sapiens
  CDS 87..242
  misc_feature 470: n=a, g, c or t
gagtcagtctcgccagctgccggtctttcgggggctccgtaactttctatccgtccgcgtcagccyttgccaccctcatctccaatatgcctggtccgacccccagtggcactaacgtgggatcctcagggcgctctcccagcaaagcagtggccgcccgggcgsgggatccactgtccggcagagactttaacagagaacctgctcaagtcatttctatcccaggtacccaccataaggcatgacacaataaataatgactgaaggaaggaatcaagcaaccaagttgtttgggatttttgaaggaactagtggggtttatctagggaggaaaaaatcttgaacacatgcatggaaacttctgaaggatgtgaagagggatgtgacattttctggttgcaacaggaaaaatgccagctgtgggacaaggaktgcaggccgcacaacctcggcaggcaccgggggggatntggcgattctacacagaagattcac

SEQ ID NO: 3511 - DNA, 477 bp, Homo sapiens
  CDS 48..272
gtaactttctatccgtccgcgtcasccttgccaccctcatctccaatatgcctggtccgacccccagtggcactaacgtgggatcctcagggcgctctcccagcaaagcagtggccgcccgggcgsgggatccactgtccggcagaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtagactatctgttcatgagagaaatttctctgtaagcttgctgttttacaggggatttatcaataattga

SEQ ID NO: 3512 - DNA, 492 bp, Homo sapiens
  CDS 204..476
atcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgcccctttgagatgctgtctaacctccacgagctgcttccgaatcacctgatggagacgctttattcccgcaagagtgaagaggacaagaaaaaatgtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaacacgaaagagcctccaatgtccaccatagttgtcagaaaact

SEQ ID NO: 3513 - DNA, 461 bp, Homo sapiens
  CDS 6..209
ttaaaatgttcatactacccaaagctagctctagacacaatgcaatccctatcaaaataccaatgacattcttcaaagaaatagaaaaaacaatactaaaatttgtatggaaccacaaaagaccccaaataaccaaagcaatcctgaataaaaagaaaaaaaaactggaggcatcacactgcctggcttcaaaatatactacaaggctatagtaaccaaagcagcatggtactgccataaaaacagacacatagaccagtggaacagaatagagaacccagaaataaatggatcggctataaatgcatggaatttttgattgtttggagacaacgtctcactctgtcatccagcctggagtgcagtggtgtgatcttggctcactgcaacctccgcctctcagactcaagctgtcctcccgccttggcctcccgagtagctgggactagggcgcgcaccac

SEQ ID NO: 3514 - DNA, 469 bp, Homo sapiens
  CDS 46..348
ggagcgcggctgcgcggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggcccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgaggacccccaagaggcccatttcccccaataaaagagatttgggagtcttaaaaaaaaaaaaaaaaaag

SEQ ID NO: 3515 - DNA, 325 bp, Homo sapiens
  CDS 17..214
agaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaagatgacacctttgaggccctgtgcatcgagccgttttccagcccgccagagctgcccgatgtgatgaagccccaggactcgggaagcagtgccaatgaacaagccgtgcagtgagacccccaagaggcccatttccccccaataaaagagatttgggagttctgaaaaaaaa

SEQ ID NO: 3516 - DNA, 255 bp, Homo sapiens
  CDS 34..207
cttgctctttcgcccaggctggagtgcagtggcatgatctcagctcactgcagcgtctgccttccgggttcgagagattctcctgcctcagcctccagagtagctgggtctacaggcgtgtgccaccacgcctggctgattgtttgtatttttagtagagacagggtttcgccgtgttggcaggatggtctcgatctcctgacctcatgatccgcccgcctctgcctcccagggtgctgggattgcaggcgtgac

SEQ ID NO: 3517 - DNA, 297 bp, Homo sapiens
  CDS 21..215
tatacagacagggtctcgttatgttgacaaggctggtcttgaattcctggcctcaagtaatcctcccacttcagscytcccaatatgctgggattacaggcatgaggcgccaagcctggcactggttttgtttttgttcttgkttgtatccctcaatggacatgtgtatcacagaaatagaacttgataaatacttgttaaataatgractaaattaatgttttaattatggratattattctaaagatgtttaggraaagrataagtggtcagttttagkaactttgtaagttaaa

SEQ ID NO: 3518 - DNA, 754 bp, Homo sapiens
  CDS 452..727
aagcatccgccggacgccggaagtggttctccgcccctgccactgggccatggagactgtggcacagtagactgtagtgtgaggctcgcgggggcagtggccatggaggcgtgctgaacgagctggtgtctgtggaggacctgctgaagtttgaaaagaaatttcagtctgagaaggcagcaggctcggtgtccaagagcacgcagtttgagtacgcctggtgcctggtgcggasaagtacaatgatgacatccgtaaaggcatcgtgctgctcgaggagctgctgcccaaaggkagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggcatcgtgggaggcatggccctgggtgtggcgggactggccggactcatcggacttgctgtgtccaagtccaaatcctgaaggagacgcgggasccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaaaaa

SEQ ID NO: 3519 - DNA, 657 bp, Homo sapiens
  CDS 364..630
ctccgcccctgccactgggccatggagactgtggcacagtagactgtagtgtgaggctcgcgggggcagtggccatggaggcgtgctgaacgagctggtgtctgtggaggacctgctggtgaggcctggcccggacagagggaaagggaaggtcggagggcgggtcctgaggagagtcagagctgctgcccaaakggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcawtgacaaggccatgaagaaagatggactcgtgggcatggccatcgtgggaggcatggccctgggtgtggcgggactggccggactcatcggacttgctgtgtccaagtccaaatcctgaaggagacgcgggasccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaaaaa

SEQ ID NO: 3520 - DNA, 490 bp, Homo sapiens
  CDS 240..434
tttcaataaaagtatagattacctacatggattgttgactgcatggagggttggcactcctaatccctgagtagttcaaaggtcagttgaattgtactaatagcagattgtctaaacaggaaattaagaaaacaatcccatttatgataataaccaaaaaatttaaatacttaggcacaaatttaagccaaaaggtagaagacctgtatattgaagacattaaaacactgataaaataaatggaagaaaacacaaataaatggaaagatatcatgtgttcatggattgaaataattaacattgtgaaaatgtctgtcctacctaaagcaatctacagattcagtgcaatcaatcccaatcaaaatttcaatgtcatttatcacagaaatagaaaacaaatacttaaatttgtatggaatcacaaagattccaagtagcaaaatcaatcttgagcagtaaaataaagctgggccaggagtggtggttcaca

SEQ ID NO: 3521 - DNA, 517 bp, Homo sapiens
  CDS 291..494
ccctctagcgatttgtttaggaaaagtgatgacatgaactagtagtggagaatcgcagcgccgctccccgccctggggagggaggggagccccggagagcctgccggtgggagctggaagcaggctcccggctgakcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgcsagaggaaagttcccccaggcggaccccgcagagcattccctaccaggacctccctcaacctggtcaatgcagacggacagtacctcttctgcaggtactggaaacccacaggcacacccaaggccctmatstttgtgtcccatggagccggagagcamagtggccgctatgaagagctggctcggatgctga

SEQ ID NO: 3522 - DNA, 530 bp, Homo sapiens
  CDS 93..332
atttggtgacgggtgaggcggcccgamatcgtaggacttccgaaagcagcggcgtcgtttgcttcactgcttggaagtgtgagtgcgcgaagatgcgaaaggtggttttgattaccggggctagcagtggcattggcctggccctctgcaagcggctgctggcggaagatgatgagcttcatctgtgtttggcgtgcaggaatatgagcaaggcagaagctgtctgtgctgctctgctggcctctcaccccactgcgaggtcaccattgtccaggtggatgtcagcaacctgcagtcattcttccgggcctccaaggaacttaagcaaaggatgatcaagaaatggttgtatgtgatccgtgttgaagaccatttgcaggtttcagagattagaccgtatatatctaaatgctgggatcatgcctaatccacaactaaatatcaaagcacttctctttggcctcttttcaagctgaaggcctgctgacccagggtgataagatcactgctgatggacttcaggagtgttt

SEQ ID NO: 3523 - DNA, 503 bp, Homo sapiens
  CDS 134..382
accaattaattcgactgctctctgatccacttgaagaactcagctggaaatcaaacaaagccaacctaaaaaaaaacgtctaacactagagaattagagtttgtcaaaggtgttaaaaataaaatgagtgtgaatgtcctacaaggtttatgagaaagttcagaaggaaagtaaagaaagactaagcagcaagacttttagtattcctgtatcctggagaaggcagcactcgagccaccatcttggaagtgaagatcaggccctcagcagacacaaaacctgccagtgccatgatcttggatttttcaacctgcaggactgtaagacatacatttttattatttatatattactcatgctaaggtattctgttatagctgcataaaaaagaataagacagaataagacagaagctgtgtgggcctgcatgagaacttcaattaactgtccattctctaaacaaamcaaagaaattggagatatgcagacagacagacagacac

SEQ ID NO: 3524 - DNA, 545 bp, Homo sapiens
  CDS 43..348
agtgttctcgcgagaggcgggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggkattttcatttttct

SEQ ID NO: 3525 - DNA, 572 bp, Homo sapiens
  CDS 150..356
actgcctccgggcccgtctttctcaattgggaccggaaaacgttgtcgctcatcctatgacgcgaaagtaaccgagactatcaggatccggagacggaaatgtccgaagccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatggttgatatatcactacttgtgtcttttaacaaaatgaaaaagattgactactgatgggaagttmaattgccagagcattgagaaagttcagctgttgtagagcttgaatttggaaggcaccagaatccggagaaaaaacctctggggggaaagaccaaaggatgaggatgaacgcacagtgtatgtggagttacttcccaaaaatgttaatcacagct

SEQ ID NO: 3526 - DNA, 457 bp, Homo sapiens
  CDS 200..370
taagaaaagaaactgtctccataacataagtgcaagatgaagcagcaagtgctgataaagaggctgcagcaagctatccagaagatctagctaaggtcattgatgaaatggttgcaccaaacagcagattttcaatgtagacaaccttctattggaagaaagatgccatgtagcatttttatagctagaggagaagtcaatgcctgacctcaaagcttcacaggacaggcttactctctttttaggggctaatatagctggtaactttaagtcgaagctattgctcatttaccgttctgaaaatcctagggcacttaagaattatgctaaatctattctgcctgtgctctataaatggaacaacaaagcctgaatgatagcacatctgtttatagtatggtttactgaatattttaagcccattgttgagacctccttcgcaaaaaaaaaaaaaaaa

SEQ ID NO: 3527 - DNA, 614 bp, Homo sapiens
  CDS 195..389
  misc_feature 457,497: n=a, g, c or t
tgaaagccgcagtttggcaccatcttttccatctcctgctccttccgccttcccgccatccgccctccacacgattcagcccggtggtgttagccccctggactcgattcctgaggcaaacagtgccccttaaggtcggcgacagcttcttctgggttcactgcagtccaaccggttccctaccctctgccattatgaacatccgcaacgctcagccagacgacctgatgaatatgcaacactgcaacctcctttgccttcctgagaactaccagatgaaatactatttatatcatggcctttcctggccccagctttcttacatcgctgaggatgaggacgggaagattgtgggctatgttctggccaaaatgggaggaggaaccagatgatgtcccgcatgggccatatcacctcactggccgtgaagcgttcacaccggcgcctcgsctggccnagaagctgatggaccaggcctccagggccatgatagaganctttaacgccaaatacgtgtctctgcacgtcaggaagagtamcsgscagccttgcacctttattctacacctcacttcagattagtgaggtggamctaaatactatgcagatggggg

SEQ ID NO: 3528 - DNA, 502 bp, Homo sapiens
  CDS 147..482
aaacagcgcggggtccgctatggcgcggcagcaggggcgtactggcgacccggagtgatgagcccgcccgagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaaactggaagccaagtacaagaagctggagaagcgatgagaaacttatttctatgggacagagtcttttttttttaattgtggaagaatgtctt

SEQ ID NO: 3529 - DNA, 476 bp, Homo sapiens
  CDS 214..435
  misc_feature 38: n=a, g, c or t
aaagcttcgagtccgtccccggtgctgcstgcgcgttnacctgagtctcgctggagctcttctcgcccgcccacctcatctcaacccactttccgcggggagcgcgccaagctgggccttcctcggatcaggcgtcccctgaagtcggcacgcccctctgcgtcccccttcggtcccgctagaccccgtccgggctgccgtcgcctcgtcgctatggcgcccaccatccagacccaggcccagcgggaggatggccacaggccaattcccaccggactctgcctgagaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctggggggtcacatcgatctcatcaat

SEQ ID NO: 3530 - DNA, 454 bp, Homo sapiens
  CDS 105..254
acagcaaggttaccaagaagcagatgggctgtgaaggagacaaacccttctgtctaaacacaaatagcattgataattaattagctgaagcagcaggggaaattatgaaaatgtgtgaaagctgtgaggcatgtaaagccttcctactccagatttggtctactcaccagcagcatctccatcgcctaagagttttattagacatgcgcaacgtcaagccctactccagacacaccgaattagaacctgcattttaacaagatccccagtgactcatatacaaacaaaagactgagaagcacaggcctagaagatgtctcctcccactgacaaagggcaaagaaaggagttgtctcagaacttggagtaaaaaatactctcctgtggtgatagagagaaaagtgtggagggcaaagaggggagcctgtgtatatgtgtgtgtatgtgtgagaga

SEQ ID NO: 3531 - DNA, 385 bp, Homo sapiens
  CDS 200..376
agttcagctgctgtccagacccggatcggcaacagtgccgcctccagacgttctcctgccgctckcccgcccgtcccagcgcccccagccctcccgcgargcgccccgggacgaaggatccaccagtctgtcggcgcccgccgttctcgtggtcgccgtcgccgtcgtcgtggtggtagtctccgccgtcgcctgggccatggcaattacatccacgtccctcccggctccccggagtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttat

SEQ ID NO: 3532 - DNA, 511 bp, Homo sapiens
  CDS 149..496
  misc_feature 48,204: n=a, g, c or t
aggatgtttacggcggccgaggttggagcggcgctgctcggccgcggncacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttganagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgascatggggtggracttcactcagatgtgatagagtatgcaa

SEQ ID NO: 3533 - DNA, 454 bp, Homo sapiens
  CDS 56..280
  misc_feature 66: n=a, g, c or t
aaccaaaaatcattattgtaacataaatggtcttagtaccaggaagtactggcacatgaggactgncccctctgctaaagaccaagaatcatgtccccatgaccccttgccccagcacatccattttcaatcatctgcaaggaacctctgtgctgaaaacaggaggaaagcacagggcgctgcagccctgcccacagggccattccacagccaggccagctcagcaaaggcagggagagaagaaacccactccccacccaatccttatgaccaagggctatgacaaacagctggcacgtaccacggggctcagtctggattctctaaacccaagagggagtgcgtaaagctgacacctcacaaaagcccctcctttaattaaaacagccatcccttcacaagtccattcattcacgcgtgctgcattcatttatgtggcatgaccttcagagca

SEQ ID NO: 3534 - DNA, 787 bp, Homo sapiens
  CDS 138..347
tgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtacttacagtttcctttaaaaaaaaaaaaagtaamcctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatgg

SEQ ID NO: 3535 - DNA, 482 bp, Homo sapiens
  CDS 56..244
  misc_feature 308: n=a, g, c or t
ttaraactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacntaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctccaa

SEQ ID NO: 3536 - DNA, 428 bp, Homo sapiens
  CDS 55..234
  misc_feature 204: n=a, g, c or t
akkacaaaatcacattttcctattcatcttggctcatcttaatgttgattttagatggtaaaattaacattattgaacatttaccatgtgccaagctgtaggctaaattctttctatgtattgtatcatttagtcctcacggtgaacccatgtggtgcgtaccatcattacttgaggaaacttaggcttagagaccgcgtwaankgcsaaktttmaggccatacatccagaaagtaacggagccagactgaaaaccgtatctgtgtgatcacagaagccctattctctaatcagtacactgtgtatacatgagcaagtattaacacaatcatcctggagttccctcagaaaaaaaaaggsctcagctttgccatataactgagagtttatcattaaataagtttatggaatatatctgcatgtaaagt

SEQ ID NO: 3537 - DNA, 424 bp, Homo sapiens
  CDS 153..326
ttgggtactaggcttagtaactgggtgaccaaatggtctgtacaacagacctctgtggcatgagtttacctatataacaaacctgcatgtgtaatcctgggcctaaagtaaaagtttaaaaaaaataaaaattaggccgggtgcggtggcacatgcctgtaatcccagcactttgggaggccaaggtaagsggrttcccctttdaarcccrggatttcaagmccagcctggccaacatgkgaaaccccatcactactaaaaatacaaaaattagccaggcacagtggcacatgcctgtaatcccagctagtcaggaggctgaggcatgagaattgcttgaacccaggaggcagaagttgcagtgagctgaggttgtgccactacacttcagcctgggcaacagagcaagattctgtctcaaaaa

SEQ ID NO: 3538 - DNA, 495 bp, Homo sapiens
  CDS 282..461
attttcttaatttttcagaactttaaacagatatgtaatttaaaagatgcagcccctcctgtgcatgccctcctcatgctgcccctctgttccagggcccacctttcctgtcctttgaggaggacccgcggcagcaggcactggagctggtggtgcaggaggtctccagcgtgctcaggtcggcggaggagaaggtggtggtctgtcacgtggtgggccaggctattcagttcttggtcagcgagacgcctgccttgggtgctggatgccggctgtacgacatgcggctctcccctttccatttacagctggagttccacatgaaggagaagagagaggacctccagattagctggtctttcatcagtgtgccggaaatggccgttaatatccagcccaaacactgggggaggaccaggtggctgagacaagtgcgatgtctgacgttctcaaggacatcttgaagcatttggctggttctgcctctccatcagg

SEQ ID NO: 3539 - DNA, 498 bp, Homo sapiens
  CDS 211..390
acatcagctggtttagtgggggccgctccctggggctgagggaccagggcactctgatgctggcagacaagcccttcttcctggtgctggaggaagatggcacaactgtagagacagaagaagagtcctcccttccaagctctggcaggcaatacagtgvtcctggtcctccagaaggggcagaaatgggagcccccatcagaacaggggatgaggcacccactgtctgtctcccataagcctgccaagaagatggatgtggcccgcataacctttgacctgaacaagctgagcccacaggacttcatcagctgcctgaacgtgaagvcgactttctatgatgtgtactccatttcctatgatctacactgcatgaggctgagtgcatggtgaagtgagcaaattgggatttgctggggacacctccatggsamcctccatcccatcctatctctttcctcatctggactcatctgatctaaaaaaaaaaaaaaatgg

SEQ ID NO: 3540 - DNA, 500 bp, Homo sapiens
  CDS 237..485
gatattttgactagcctttctgattattaaaaacccttctttgatattattttccagggcatcttggatgatggtgttagatcatcatcagtaagcatttaatagatagtcactgtatgtactagctgtgctaataaaaatataaactctaggatttacaaaattgggtgaaatatggtctgcagaaaacaggcaatcataaatgcattagaaatatatgcccacatcagccaggmatgatggctcacatctgtaatcccagaacttttggaggccgaagtgggtggatcaccgaggtcgggagttcaggaccagtctggctaacatggcggaactccgtctctactaaagatacaaaaattggccggatgtggtggtgtgtgcctgtggtcccagctacttgggaggctggggcaggagaatcgcttgaacccgggagcggaggtttcagtgaactgagatcagccactgcactccagcctgggtgacagagtgagact

SEQ ID NO: 3541 - DNA, 463 bp, Homo sapiens
  CDS 128..304
  misc_feature 201: n=a, g, c or t
tctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcmntttaattcctaawakgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgt

SEQ ID NO: 3542 - DNA, 526 bp, Homo sapiens
  CDS 240..437
tgcatatatttttgcaatattccaggcatcttattaaattcagatttagcaatttacctatatactatttgcagttttcattacttgctattaaccctaaaggactagatcattgaattagttgttttgctgagcctttttggctgctgtatagggtatcactaagataatgagtgagcctacctacccatscagcgtgggamawkgsckgaaaccttttttrrttyctgtatatctgaatgcacattttacatgaaaaggtatgtattctatttgaatacatcatgaatttaggagtttacaaaggtctcaggatgtctgacaagatctcctggcawamcccagccgratggatgattttcatccttgagaatgatgaactcattaatttgtatatgaagagcaataaacagagtctcctctttcttgaacaaaagtagggrtatgaaacaactttctccccaactggaccccagcagaaagcatccagctgtgatggtgggcatgatatgcagtcagtcagaca

SEQ ID NO: 3543 - DNA, 520 bp, Homo sapiens
  CDS 202..405
atatagctgctgctgctgccatgcgcagwgctgctgtaacagctcttcctgttctgctcccctgagaacagtgtggtggggagaggcagggctgaggtggtctacgaatgtggcaggtagggaaggggagatgtctgtctcttgagaagagagaggcatgtgtgccggcatccttgatgggttcaaagagaaaggttggagatgatagtgggtgagaagcaggctggtgagactgggctgaggttggagaaggggcagccgggggcactgctgagggtttgccgtgcacgcctcggacggagcacggtggggtggcggggagcagatagtgctgcctccctgcggcagacaggagaggaacctcaactcagtccatttcatagcctgataggggaagtggggagttgacaggatggtttwaaaataagacgtgaaagttcagttacctgytctagactttgcctgagaacttgtaaattaatcagtgagacctaakktggtgacatgtcagtagcatcak

SEQ ID NO: 3544 - DNA, 406 bp, Homo sapiens
  CDS 184..366
tcttcctgcctcacagcctcccaaggtactcagattgtaggtgtgagccaccacgcctggccaccatctattacttttgaaatcttcaaaagacttgcttactcaatgtcagctgatggttggtaaaaataatttggcctttagtgttaagtgagacatcataagggtattgaggtatacattatggagattgatgtcaggtcagaatattggagttatacatctatttctgagttaatactcagctcccacgagaaagaaagtagttttaaggtccagcttcttagtctacttgaagcaaattttttttcttttatatttctgaatataaatatactcttatatgggctaaaaagaccccatgaataaatagcaggttcagtagttgaggagtggagtttagtag

SEQ ID NO: 3545 - DNA, 281 bp, Homo sapiens
  CDS 34..207
cttgctctttcgcccaggctggagtgcagtggcatgatctcagctcactgcagcgtctgccttccgggttcgagagattctcctgcctcagcctccagagtagctgggtctacaggcgtgtgccaccacgcctggctgattgtttgtatttttagtagagacagggtttcgccgtgttggcaggatggtctcgatctcctgacctcatgatccgcccgcctctgcctcccagggtgctgggattgcaggcgtgacaccgcgcccggccataaactatttat

SEQ ID NO: 3546 - DNA, 466 bp, Homo sapiens
  CDS 105..398
aagaggaaattgcggtagtgaccctcgggcctcgccatgaagagccgctttagcaccattgacctccgcgccgtactcgcggastgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggttgactgaaatagtagccagcgcacctaagggtgaactactgaagagggtgcttaacccattacttccctatg

SEQ ID NO: 3547 - DNA, 470 bp, Homo sapiens
  CDS 37..402
aagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggtttcgaactgatgaggcagatgatgttaaatttgctgttcgtgaacgctatccacttgatcatgctagagctgctg

SEQ ID NO: 3548 - DNA, 496 bp, Homo sapiens
  CDS 74..433
agattcagcagcggcacagctggagaaggtcgtggagcagcaccttgcctgcagggtgttctgagaatcagccatgtcatccctttacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggccsggccagatggtggcaccggtaaccggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcat

SEQ ID NO: 3549 - DNA, 475 bp, Homo sapiens
  CDS 1..156
atgcccatgtggaatgccagatgtgagcctagctggtatagttggaaaaaacatccagcaagaactgtttccctcacagtaataattccaggagcttctacacatacacacattccaacaatactggaatgtttctgcttcatgaagcagaaagagtagaacctgtggtggtggaaatgtaagtgcagttacacattgcttaatgacagggatacgttccgagaaatgtgtgtcattaggtgactttgtcactgtgggaacatcagagagtgtacttgcacaaacctagatgctgtagcctactacatgccccggctgtatggcgtggcctattgcttccaggctacagacagtatagcatttaactataattaatactgtagggaactgtaacagaatggttaggtatttgtatagctaaacatattgaaacatagaaaagttacagtgaaaatataatatcaaagataaaaaa

SEQ ID NO: 3550 - DNA, 401 bp, Homo sapiens
  CDS 59..247
  misc_feature 247: n=a, g, c or t
aaraatgagtgcggcggmctcgcsgmgtcggagcggggttggaagarcgagaaactagatgrggctcaggccctggcgcggagttgcgcgyccgyakacmcgacttccagccgtgmgacgggctgtctatctgtgccacgcacagscatggcaagtgcttcaagctgcactggtgctgtcacctaggatggtgtcactgcaaatacatgtatcagcctatgacccctgtggaacagcttccaagscntgagattcctgccaggcctcgggaacccacaaacaccattcagatctcagtctcgctcaccgaacactttttgaaatttgcatctgtcttccagcctccccttccccctgactcaccgaggtactgtatgatttcagacctttttattgacaac

SEQ ID NO: 3551 - DNA, 494 bp, Homo sapiens
  CDS 186..428
aatctctgcgaaasttccaggttcgctcatcgtaggtcactggaaaaaattgtagcattgctaaagagtatttcagagaaaattttgcatgcaaaaatttaggaagatgagtgaaactcatcawttctgtaatctctgtgaaagcttccagtccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcaggaccactggcagtacctatgtggaataagcatggatgctagttcactgtggagttgagatgcattttacataattatgagtttgttcatataaagaaaagctgtggaaaagagtcttaga

SEQ ID NO: 3552 - DNA, 490 bp, Homo sapiens
  CDS 135..344
  misc_feature 42: n=a, g, c or t
gaaccctccccgccccccgtcgccaacattccttcgttcccntaaatcagcctcttgccccattgctctttgcaggggtagaagaaggaagtgtagcggccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagtcctaggttcctgggagtttctgggatgtgccccaaatgggatatgtttttcttatatacaagttgttcactttgaaatggaagatgctgctcctgtcagtactattacctgcctctatacttgttgctgagaagttctctctcttcac

SEQ ID NO: 3553 - DNA, 523 bp, Homo sapiens
  CDS 21..494
atgtctgggagggagggaagatggcagccgtggcggcaggcggcctggtgggaaaggggcgcgacatcagcctagcggccctgcagcgccacgacccctatatcaaccgcatcgtggacgtggccagccaggtggctctgtacaccttcgcccatcgggccaacgagtgggagaaaactgatgtggaaggaaccttatttgtttatacaaggtctgcttctccaaagcatggattcaccattatgaataggctgagcatggaaaataggacagaacctattactaaagacttggatttccaactccaggaccctttccttctctacagaaatgccagattgtccatctatggaatttggttttatgataaggaagaatgccaaagaattgcagagcttatgaaaaacctaactcagtatgaacagttgaaagcccatcagggaactggagcaggaatttccccagtgatcctcaattcaggagagggcaagaagtagacattttacgaatgctcatcaaggcc

SEQ ID NO: 3554 - DNA, 234 bp, Homo sapiens
  CDS 34..207
cttgctctttcgcmcaggctggagtgcagtggcatgatctcagctcactgcagcgtctgccttccgggttcgagagattctcctgcctcagcctccagagtagctgggtctacaggcgtgtgccaccacgcctggctgattgtttgtatttttagtagagacagggtttcgccgtgttggcaggatggtctcgatctcctgacctcatgatccgcccgmctctgcctcccaggg

SEQ ID NO: 3555 - DNA, 664 bp, Homo sapiens
  CDS 185..448
aacgtcactactgagcgccgggcgktttccgttggcggcggattcgaacgttcggactgaggtttttctgcctgaagaagcgtcatacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataagtgatgtgtgtgtttgtattttttttctggcatgaaatatctcaagtaaatgcataggactatttaacccttttatgggaattactattatttttatttta

SEQ ID NO: 3556 - DNA, 581 bp, Homo sapiens
  CDS 185..448
aacgtcactactgagcgccgggcgktttccgttggcggcggattcgaacgttcggactgaggtttttctgcctgaagaagcgtcatacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataagtcaaaaaaaaaaaaaaa

SEQ ID NO: 3557 - DNA, 244 bp, Homo sapiens
  CDS 34..201
ctcagcatctggagtagctgggattacaggcacatgccaccacgtctggataatttttgtatttttagtagagacggggtttcaccatgctggtcaagctggtctccaactcctgacctcaagtcatctgcccgtgtcggtctccggaagtgctgggattacaggcctgagccaccacactccacccctaatcaccccttctaataaagacacagctcatgtaggatgagagctaaaaaaaaaa

SEQ ID NO: 3558 - DNA, 462 bp, Homo sapiens
  CDS 16..303
tttattttgaagcaaatgcctcgtctggaagtccagtccttcctcgactttgcaccacattacttcaattatattacaaatgctgttcaacaaaagaggcccacggcgttggccaaaattcttggagtttacagaattggttataagaactctcagaacaacactgagaagaagttagatctccttgtcatggaaaatcttttctacgggagaaagatggcacaggtttttgatttgaagggctctcttaggaatcggaatgtaaaaactgacactggaaaagagagttgtgatgtggtcctctagatgaaaatctcctaaagatggttcgagacaaccctctatatattcgttctcattccaaagctgtgctgagaacctcgatccatagtgactcccatttcctttctagcacctcattatagattattctttgctgggttgggcgagatgatactagca

SEQ ID NO: 3559 - DNA, 548 bp, Homo sapiens
  CDS 287..460
actttcatactcagggacaccgtccccactccgccccccgccctccgtaagtgctatttttacatcgaatgccctagtctggaagtaggtaaactgaaactaagctcaaatcaaaaggagaaaggctggaaaacaagaggctacaagctccagaagctccgagcgaggatgaaaattagccagcccacaggtgggctctgcgcggccctgaaagtcgcactctgacctgaccctttccgcctctcgtttttccttccagcctagcttcaaagttctgtattgcagaatgaaatcggcgcctttccccagcggtttttccaaatacgagcaaaggaggcacaaaacgcaggttccagaaactgtgcctgcaaccattcgtcttatttcccgacacacgggcccctgctccccgctaaggctggggtcctggacacgagttttgcgctctgatagaagggcttagattccagattgacacttgggggsttaagcctgctcctcaatctactgatccggtccagcttaagatccagtagaaagaaaacata

SEQ ID NO: 3560 - DNA, 461 bp, Homo sapiens
  CDS 159..344
cgacctccggggaggagagagggattgaaggttaagttgatcttcaatggccaatgatttaatcaatcatgcctgtgtaatgaagccttcataaaaacctaaaaaaggacggggtttggagagcttcctgtaagcgaacccgtgaaggttccaggaggatggcgcacccggaaagggcgtggaagctccgcgscccttcccacagactttcccccatccatctcttcatctggtgttcatcgatagcctttgtaatgtccttaatagtaaaccggaaaacatgtacacctaacagcatggtaaggaagccccagaaggatgtttctaaagaccatgagggagtctgaaacctgaaatcatgccaaggactctctgsttstctttcacttggggtgtctatctgatgctgccacaaccagttgaaacgtataacattaacaataaaaattagtttttttgta

SEQ ID NO: 3561 - DNA, 540 bp, Homo sapiens
  CDS 30..347
arycagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaagttagaaaagttctgtgttagggccgggcgcggtastcacgcctgtaatcccagcactttgggatgcccgaggcgggtggat

SEQ ID NO: 3562 - DNA, 453 bp, Homo sapiens
  CDS 40..204
  misc_feature 286: n=a, g, c or t
atgatgtcatcaagatcctgtcctggaattgtccactgaatgcttatcaggaatattaataacattaaacgaaattgttctcttcccaaattttggatacttcaatattctcagttaagaagaatggcatatgaacatgggaaaataagagcagtaaacgaattagaggatagatacatttattttcaccatccattaactaaatgacttggctgaaatgaccttttgctgtgactgaaaacaaaacaaaacatagtaatcccagcactttgggaagcggaggcgngtggatcacttgaggtcaggagtttgaaaccagcctgaccaacatgataaaaccccgtctctaccaaacatataaaawattaaccgagcgtggtggcatatgcctgtaatcccagctactcgggaggctgaggcaggagaatcgcttgaacctgggagacagaggtt

SEQ ID NO: 3563 - DNA, 465 bp, Homo sapiens
  CDS 69..302
aaaccattttacaagaggaatgcaagccgggtctctgcatcgggctttaggaacgacctgctgcagtgatgcctcggcaaccacagtcccacgatgaaggacaactgagaaccagatgtgcacagaaccaccgttcagggagtctggacccagccctgtctgcacgttatctaaacggtgacagcagcagctttggagtcccctctgccggctccaccaccacgttgctgctgggcctcggcatcaagccctgccaggtggccagaaaggcaggtggccgggcaggcaggcatcacttaacctagcgacaatcaagcctgtgcctggcatgaagtcaggcccccggagtgctggctgaacctgaggcctttcctagccgtcagttttgctgggcactgtgctctcaacatgctccggggcgacacaccatcctccctcctgcttcaacacagggcagctctgcag

SEQ ID NO: 3564 - DNA, 553 bp, Homo sapiens
  CDS 136..294
aacacgggaacacccacctttagagatgagacacaagcaggagaagagggattaaacctgctagttttggaaaaaaaaaaaaggaaagaaaagaaaagaaagaaagaaaaacaaaaaacaacaacaaacagaaaaatgcaaaactgcagaacacgcagtggaggttggattcagaggacatggggatcagtgtgggctgtgctggtcaaggagggcttccagggagaggcaactgaggattcactgcaattgttccttgagaagatgaggatcaggtcgggaattggaaacatctgagggctcaattcaacctggcttctaaaacgaacatggtgaacatagatcaactactgaacttcttttaacctctggcatcctatctggtgaattktggggaggaaacagggtcccacccgctgctgcacaagaggggtgtgtgcaggaccgtcaccttgtgtctgctgtagcaggagacccctggccatgcgagactgaacccatgattgcagctgatcttactctgtctcttctctgtgtgagtaaagtgttgttc

SEQ ID NO: 3565 - DNA, 491 bp, Homo sapiens
  CDS 101..370
ataatgagatcaggaggaacattctacctgagaaagacagattgcaatgactgagatgattttgctaattttttttccagcctatttccttaatagctgaatgagtgccaggaagctgcgaaatctgtcttacaaaaaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccaggcaagtacatctgggaatcagcttccattcttttgtttttattacttcaacaaaatgttgcagtgtttctaactttaaatttattcaactagttttccatggggttgttttgattcactgatttgactatttggaggtaggtaggaagaaaagggggtctagatcattagtctaagatttattttttttc

SEQ ID NO: 3566 - DNA, 494 bp, Homo sapiens
  CDS 101..370
ataatgagatcaggaggaacattctacctgagaaagacagattgcaatgactgagatgattttgctaattttttttccagcctatttccttaatagctgaatgagtgccaggaagctgcgaaatctgtcttacaaaaaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccaggcaagtacatctgggaatcagcttccattcttttgtttttattacttcaacaaaatgttgcagtgtttctaactttaaatttattcaactagttttccatggggttgttttgattcactgatttgactatttggaggtaggtaggagaaagggggtctagatcattagtctaagatttatttttttaaggatg

SEQ ID NO: 3567 - DNA, 459 bp, Homo sapiens
  CDS 172..360
atgattctggggaaactctaccaccatctgtgtgccttgcctagcaatatgtcactatccaggtatgttcctggcagaaaagttgcataacttgggggttaaagacaggaatatggcacaatgcccattgtgggcagtgtccagacagaagaagagactcatatcacctaaatgacaaacccaggatatgtcacaatgtatcctgttgaaaggaccaggacaatggaagaagagtcaaatcaccaggatgccgattttagtgatttatcaagattccccctgttaacagggattaggaaggagagttgcctgcattcatctgtgatgatgaaagtccttactgtcagccaagtgtgcatatgagactcacaatttcctctgtttgctaaccactattatgacactctctattcaacccaacggttttataaaacatttgtcattgttaaaaaaaaaaaa

SEQ ID NO: 3568 - DNA, 538 bp, Homo sapiens
  CDS 316..492
atctttggttatataagggaggttcaggaagccattcgttctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttctaactgcctacctgcataaagaaaataaaatcttttaaatcaaaaaaaaaaaaaaaaaagct

SEQ ID NO: 3569 - DNA, 595 bp, Homo sapiens
  CDS 378..554
atctttggttatataagggaggttcaggaagccattcgttctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttctaactgcctacctgcataaagaaaataaaatcttttaaaccaaaaaaaaaaaaaaaa

SEQ ID NO: 3570 - DNA, 265 bp, Homo sapiens
  CDS 7..171
agaaagatggcggagcaagagcaaagaaaaatccctttggttccagaaaatctcctgaaaaagaggaaggcttatcaagccctcaaagccacccaggcaaagcaggcacttttggcaaagaargaggtaatggtggggaaccaagagaaagtaattagaatttttatttggtgagttttatcccgcatgtgttggactacatttggtattgacgagctccccccaacggtttgacagaccagcagaagaaaggaaaagggctcar

SEQ ID NO: 3571 - DNA, 522 bp, Homo sapiens
  CDS 341..517
ctttctttcgcgtctgsgtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttctaactgcctacctgcataaag

SEQ ID NO: 3572 - DNA, 555 bp, Homo sapiens
  CDS 338..514
  misc_feature 541: n=a, g, c or t
ctttcgcgtctgcggtgctcggggtgtggtacttctgctggttgcagtcaggcttcatacgctattgtcctgcccgttagagcagccagcgggtacagaatggattttggaagagggagtcaccactggacctccagggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcattctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttctaactgcctacctgcataaagaaaataaaatcttttaaaccanaaaaaaaaaaaaaa

SEQ ID NO: 3573 - DNA, 504 bp, Homo sapiens
  CDS 131..310
tattattatgtcttcaagttcattaatatttccttctgcaataactagtttgttgtgaatcccacccagtgtattttttgttgtgcacagtatccatttcctctctaggattttgatttgggtcttgttaatgttgtccatgtcttcattgaacattttgcacatatggaattcagctgtaataattgttttaatgtccacctccactaatgttaaaagttgcatcagctctgggtcaatttcaattgatcaaatgccatccttgaatgagatttgtattgttttgcttctctgcaagcctggtaatttttgattggatgccagatattgtgaattttatcttgtacatgctggatattcgaatattcctaaacctacttcagagctatttttctggtactcagttaaggcccctggaagtaatctgattccttcaggtctagctttaaagatttactgggtggaaatgtaatattaattataattaactatgattataattat

SEQ ID NO: 3574 - DNA, 557 bp, Homo sapiens
  CDS 5..244
  misc_feature 528,541: n=a, g, c or t
agaaatgaactgtagtaggtgtgtagtttggggaagtcaaatggccattttatgtatgtgcatttggtatcatgggccgtggaacagaatatatgttggacctctgaaaagttgtaaggggccaattctaagtattcttcacggcakccagaagttaatggtggtagcagctgaggtatggttgttggacgaggccgattttttttttttaacatggaacaatgaaaccaacaacaaacatttttaaaattaaaatggataatttgtaaatagtttttagcttttaaaatttaaagtgtttttgagtgtgaaaagttgagtaaaactatttgcaactggttttcagaaaaragaaaagaaacaacaaaggaattgaaacaggcagggagatcttaatacctaatttcatcatttctgaaaatgtactgttttagaatgtattacaatatcaatgtgaatatcttgaatcctgttacaaatcctgcactgtattaaacatgtaaattaattgtttgtctgattagccantctcaccacccanatggggaggtatacat

SEQ ID NO: 3575 - DNA, 494 bp, Homo sapiens
  CDS 185..361
  misc_feature 418: n=a, g, c or t
aaagagaaatgagactaaaaggtcgttcccccaactgttaaaaatgtgtgcagatatcaacgtctcttctacatactggtacaggtgcractgmcagggccccctgatataacaagagtaaccaaaggtccctaagagcctggccctggggacctatggtttgctttgcgtccttagtaaccccatgataaaggggtactactgttatccccatttttcctacgaggcatggagaggatccatggctcgcccaggggcacccggggaaatgggttgccgagcgcgaaataatccagagcctgcccactcagccacaaggctcagcggctccacaggtccagacacctccttcacatctttgtaggttctgctcattcagaacagccagaactccactcaaacacactttctgtaaaanmgtgttgatttttttttactaaaccttgcagaatatgggtaattcctgcttcttttatctttctctgtgtattaaa

SEQ ID NO: 3576 - DNA, 282 bp, Homo sapiens
  CDS 34..207
cttgctctttcgcccaggctggagtgcagtggcatgatctcagctcactgcagcgtctgccttccgggttcgagagattctcctgcctcagcctccagagtagctgggtctacaggcgtgtgccaccacgcctggctgattgtttgtatttttagtagagacagggtttcgccgtgttggcaggatggtctcgatctcctgacctcatgatccgcccgcctctgcctcccagggtgctgggattgcaggcgtgacaaccgcgcccggccataaactatttat

SEQ ID NO: 3577 - DNA, 313 bp, Homo sapiens
  CDS 81..269
awttcccggcgggtcccggcctctgcgtgcacgcgcctgcgtgctcgcgctcgcggttctggcgctgctggaaaggaataatgctgacagcatggtctgcasakkssatgctctgtgaacgaatcgccatagccaaggaactgatcaagagagcagaatcactttctagatcaagaaaaggtggcatagaaggtggtgcaaagctgtgcagcaaattgaaggcaggaattaaaattcttgcagaaagtagaagctgggaaagtagctattaaagagtctcatttacagagcactaacctaacacacctgagar

SEQ ID NO: 3578 - DNA, 413 bp, Homo sapiens
  CDS 255..404
agaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaatgtaag

SEQ ID NO: 3579 - DNA, 308 bp, Homo sapiens
  CDS 16..195
gccgcggcgggacaaatgcagagcgcacgcgcttggctgcctggcgactgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcgggcttatggtgaaggctctggtgctgattgtagacgccatgtccaaaagttaaatctactacagggacaagtttcaragctgccactcaggtctctagaagaaactgtcagtgccagtraag

SEQ ID NO: 3580 - DNA, 407 bp, Homo sapiens
  CDS 109..285
  misc_feature 224: n=a, g, c or t
ctcctgcacgcgcctcgagatcgcgcgctgcaccgcccactggaaggcgcgcgtcascgtcgtctgaggtcctccagcagcgggctgscgscragggcctcctcctggatgtccgtgctcctgccgtccccgaagaagtcgcacgcgggacgaggtgggaaccaaagctccgctctacctgggagtccctggagcccctgggaaattctctctctgcagcggcngaagtccccggggcccatcgcggagacgcctggtcactgctctaccgctgctgctgaaagatgagtttctaagtttgatgtttagggcggggtcagggcgggggcggaggtaattcaaggacccttgccaagtgggatgctgcaactgccccgccattcagagacgctcctttgctcccagtc

SEQ ID NO: 3581 - DNA, 492 bp, Homo sapiens
  CDS 91..426
atttcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacaggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatac

SEQ ID NO: 3582 - DNA, 527 bp, Homo sapiens
  CDS 318..476
aaacacatccaagcttaagacggtgaggtcagcttcacattctcaggaactctccttctttgggtctggctgaagttgaggatctcttactctctaggccacggaattaacccgagcaggcatggaggcctctgctctcacctcatcagcagtgaccagtgtggccaaagtggtcagggtggcctctggctctgcgtagttttgcccctggccaggattgctacagttgtgattggaggagttgtggctgtgyccatggtgctcagtgccatgggcttcactgcggcgggaatcgctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaag

SEQ ID NO: 3583 - DNA, 516 bp, Homo sapiens
  CDS 91..315
tataaatagcaccctagtgagtgctgtcgtccagtctctcttgggtgtggtttgaatgatctcgggatgcatgactaaaatggaattacgatggcagatcggaaacgcgtttataaacaagtgatggtttgtgagtcgactgtcaagaccaggaggtggtgcaccgtgggaggttgccttccctcccatcacttctttttgtttttgagtcagggtcttgctctgttacccaagctggagtgcagtggcggtaccttgactcactgcgacctccacctctcaggctcagcgattctcccacctcagcctcctgagtagctggaattgtaggcgtgcaccaccacgcgcastagtttttgtattttttgtagagacggggtttcaccatattgcccaggctggtcgtgaactgctggactcgagtgatccacctgcctcggcttcccaaagtgctgggattacaggcgtgagcaccgcgctggagggacagatgtgccgtcttgtcctgcctgtttc

SEQ ID NO: 3584 - DNA, 510 bp, Homo sapiens
  CDS 293..451
aaaacacatccaagcttaagacggtgaggtcagcttcacattctcaggaactctccttctttgggccacggaattaacccgagcaggcatggaggcctctgctctcacctcatcagcagtgaccagtgtggccaaagtggtcagggtggcctctggctctgcgtagttttgcccctggccaggattgctacagttgtgattggaggagttgtggccatggcggctgtgccatggtgctcagtgccatgggcttcactgcggcgggaatcgctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccag

SEQ ID NO: 3585 - DNA, 396 bp, Homo sapiens
  CDS 14..304
caccttttgcaacatgacaattttatgccaagagaatgaaaatgtcaggtatttccattacagagagtcacattttcccttgattgtttcaggcagaaagaaagcgactcagattaatctgtttagaactattttcagttatctgtatatgtcatacatgctgtcatgttctaagaccactttgttcttggatactgctttccaaaatctatgggattctactcttaaaaaaaaaaaagaatatctcgctttacatatcattttattctggggaagcctaattagcacattaatatcagagagctgamaacctcctacatgttattttaggattccatgtgcaagaccatattattcyagttatttgaatggcacgtattctccamagcttgctaa

SEQ ID NO: 3586 - DNA, 472 bp, Homo sapiens
  CDS 148..396
acagctttactcctgccagcttgggaaaaggccggagaaggtgaaattctgtgtgctccctccggcgagagactttgtcagctcccgcacagtaacgtggaagtccaagaatccgagtggaggctcaccgaggcgaaggggccaaccatgggaaaggagagtggatgggactcaggcagggctgctgtagcastgttggtcggaggatttgtggctgtggggactgtgctcgtggcgctcagtgccatgggcttcacctcagtaggaatcgccgcatcctccatagcagccaagatgatgtctacagcagccattgccaacgggggcggagkttgctgctggcagtctggtggctattctgcagtcagtgggggcagctggactctctgtgacatctaaagttatcgggggctttgctgggacastcttggggcctggctgggttcaccccttccagctgaacaccacactg

SEQ ID NO: 3587 - DNA, 489 bp, Homo sapiens
  CDS 28..300
caagccacactggagagattagaaggaatgctttctcagtctgtgagcagccagtataatatggctggggtcaggacagaagattcaataagagattatgaagatgggatggaggtggataccacaccaacagttgctggacagtttgaggatcagatgttgatcactgaaaatgatttatgcaagtttaagattctgctcctaagtgtaggagagaacttggtgcctcttccactctggagtgaagttaatgaaagtctttttccttttccaaaagcccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaa

SEQ ID NO: 3588 - DNA, 558 bp, Homo sapiens
  CDS 170..337
gaataggattggtgaaagagtgaaagagtgttgtgtgcttttgctgagtttaggatggtgtcaattgtgcctcaggagaagagtttagacattctgtcctgatgaatgtaatcaagtctttatttcatggtttctcttaacgcaaatacgtacagtttcatattcgtcgatgagggtgagaggaaaactatcgccaacagaaagaatccagataggaagagagaaaaagaaagaccagagatggttcatgtgggctgctcctcataaccctgctcaaacactactgaggcatcaggatcttcaagattcatatgaggaaactgaagcgaaagaatgttgactaattttgtcaaggtcacacaactgatgcttcagttgcccaccaggagccaattcatgttcccttgcagggaaatggacaagggacctgctgctggcttatacgaggaaaggccgtctcacctgggggctttggggaaaagtttgctttcagatggagaaagagatggagcctctcaaggagaaagcatttccctctggtgcttcccttctttgtgc

SEQ ID NO: 3589 - DNA, 637 bp, Homo sapiens
  CDS 410..622
agaattttttatgaggcggctcagggccaccagctagttgctccaacaaatcaaccatcagcagcactgccttttatgacctagccttggaagtcatcccagcatcacttttgtcacattattcagtcacctctccatctagagaatgtcacagattttgttgacatttaaaattgccacctcccacctcaagaagcccagctggtgtgggaggcaagactggtccagacgatggcaccaagactaccaaaaataagctgccccaggaaaaaacggctggaggtgagtggtctggtgggaagaacactggactaggatcctggccctggcttctgttgttcctgaatatggctctctctctactcaagaagcggagcctggtgacaatggctagtgtgccactagcgttatgctctcaagagtcagccctgtgctgcaaggttcccacaaggcaagtgamctgcttcctaagcagctctacattctcagtgagcagtggggaagttccttctctctggaacttaagaggttcatctgtgggaccagcttacccagcattctacagttccaagtacagaaaggtaccaaggcccaaattcaatgcctggagggactaaacttttaagactgagctcct

SEQ ID NO: 3590 - DNA, 477 bp, Homo sapiens
  CDS 4..177
actatgctggtcacaattaatgaggggcgtgtgtgtaggaccctagagatttctcctgagatccagcccaatagcattccaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaaaaaaaaaaaaaatgcgaa

SEQ ID NO: 3591 - DNA, 459 bp, Homo sapiens
  CDS 97..255
aggaaagttccccaactccctactcgacccaggaagtccagctggcctcacctctcaattccaccaggaagaataaagcatcagaggctcattgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaacttgaaaaagaagcaatgaaggatgcagttttaaaagtcgtaaaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcakgaaactgttaaggcagcaataatagaagagcagaaacgaagtg

SEQ ID NO: 3592 - DNA, 553 bp, Homo sapiens
  CDS 72..314
  misc_feature 493,496,498,501: n=a, g, c or t
attttcccagtctccgcagaaactgatctgttctattaagtcttttttatatcctaaatatccagagtcttatgcaacttaacaggcaaacccgttcagtgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgactacagamtttgsggamggtaagscaaatggttwatggatacaatgckgcctataatcgctacttcaggaagcgccgaggggccaaatgagactgagggaagaaaaaaaatctcttttttctggaggctggcacctgattttgtatccccctgtagcagcattactgaaatacataggcttatatacaatgcttctttcctgtatattctcttgtctggctgcaccccttbntwngnatncagattgataagtaatgaaagtgcactgcagtgagggtcaaaggagagtcaa

SEQ ID NO: 3593 - DNA, 492 bp, Homo sapiens
  CDS 90..464
accactacgcatgtgtgtcaactctagggttgggtgctggggttgcggctttcggttaacaccgcagcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaaaaaaaaaaaaat

SEQ ID NO: 3594 - DNA, 512 bp, Homo sapiens
  CDS 84..404
aaaatacaagttcaatgaatgacgcagcagctctgagaggaacataaggaaaacacccaagccggagtctctcacaagcttgaatgtgtgttctggagctgaaggatgcacggttgttaagcccctgttcttttccgttgtttaatctaatgttctttggaataaaaacctccctgccaagtagtacttggttttatgctcaacatgctttgactgttgaaaagagacctttggcacacattgaagggatggtgatggagatgccaatccatggaatcaggtggcacagctatgttggtagctatagcagaagtcttcttggcaaagattcctccagggaaggaaggtaccattggagaaccatgcatgaagacagggaagaaatgattggaatcatgaaacattaaactggaaggaagccctaggcaaacctaactcatgggaaaacagacacccacatgttacccagtttagtaccaaaaccaaggctggtatttgcataaatatacttt

SEQ ID NO: 3595 - DNA, 571 bp, Homo sapiens
  CDS 255..461
agcatgctcagccccctcaccccctgtactaccttgggactctgcagagtcctcgacagtaagaaggctctcacctgttatgcccctggaccttggacttctcaacctccataactggtgcctgtgcagcagtattcactgtgataggaagtgagaagcagtctgagtgttcattgctgagggaatcaagggcaaaatatcatggatgcactcatggacaaataagcagcagtttgaagcaacaccctagatggatgtacagccatcaagaggatcttaaagtgtggtctttagtggaaaaaaagcttattttgggagaggccagctgccatgtcatgaagacactcaagaagccctgtgaagaggaagcaaggcctgccaacaacagccagcaccaactttccagccaagggattgagccatctcacagtggatcctccagcccccaccaagccttcatatgaccaaaccaataccaacatgtaactgtgacctcatgtgagtcccaagccagaatacccatctcctgtctcagaaatgatgagaataataaatatatgtgctcacacac

SEQ ID NO: 3596 - DNA, 482 bp, Homo sapiens
  CDS 175..342
agtttcgggggaggcggaagagaaagagagagagaggacacagggaaacttacagcaaaagtttcgatgtttatagctttcttggggaagaaaacacatgcacagatcctggtgttaggaatattttaagcatgtatcttcaatattattcatccaggaccgaagtaagtcctgatgcaggaaatgagtgactttcacagctttctgagcccctactcaacccaggaagtccagctggcacctcctctggatcacaagtttcaagtgaacctggatatttcaaataatctttcttttgccgtaaattacaagattttccagtttgaccactggcgcttaacctaactacatactgaaggcacttcaagctggtgtgggtggacgttctttcctgttgaaaagagaacaaaaccctcaacaaggagcagctggagacaaacttggagcgaggaaaagcagaaagtgttgcgamrttaatcatt

SEQ ID NO: 3597 - DNA, 560 bp, Homo sapiens
  CDS 108..539
agatacccgatcctcggtcgcgcgggtcgcccccgccccgacctccccggctgacgcgctctgggctcggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatctagacttatkaagatgatcgc

SEQ ID NO: 3598 - DNA, 826 bp, Homo sapiens
  CDS 130..327
  misc_feature 163: n=a, g, c or t
tcagtgttcctggagtctcgctgcccagatgccacggaatcagttgaagccaggtctccagctggggtggacgtgcccaccagctgccgaascaatgacgccaggtccggtggacgtgacaagcaggacatgacatggtccggtgtgacggcgaggacagagnaggcgcgtccggccwtcctgaacaccttaggctggtggggctgcggcaagaagcgggtctgtttctttacttcctccacggagtcggcacactatggctgccctctggyycccagaacccacaacatgaaagaaatggtgctacccagctcaagcctgggcctttgaatccggacacaaaaccctctagcttggaaatgaatatgctgcactttacaaccactgcactacctgactcaggaatcggctctggaagctagaggaaccagacctcatcagcccaacatcaaagacaccatcggaacagcagcgcccgcagcacccaccccgcaccggcgactccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttcactaagtcatttgcactggttggagttgtggagacggccttgaagtctcagtacgagtgtgcgtgagtgtgagcaccttggcaagtgctgtgcagggccggcgcctcatctggc

SEQ ID NO: 3599 - DNA, 946 bp, Homo sapiens
  CDS 265..924
agagtcagggaatgttagtagtatggtgtgactggagtgaagttagcacttagtggtatcatttctggcttgagcaaatggttttttgatgtattattaactgagatggaaaacatgaagcaaagcaggtttatttaagatgatgggcaagcttggtatacctgttggacaactgaatgaaactatctggtagtaagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaacaggcacacaagtgtgaggagttgctaatgctaagctcagaggctcc

SEQ ID NO: 3600 - DNA, 477 bp, Homo sapiens
  CDS 80..292
  misc_feature 121: n=a, g, c or t
taggcagcaaggtagcgtggccggcgcccgagctggggttgtgtccctgctgggctgccgttccagctggactgccgccatggaactcagcgccgaatacctccgcgagaagctgcagcgngacctggaggcggasatgtggaggtggaggacacgaccctcaaccgttgctcctgtagcttccgagtcctggtggtgtcggccaagttcgaggggaaaccgctgcttcagagacacaggttctgtacagagtaatgagatgtgtgacggctgcaaaccaggtgtttttttctgaggctgtgttgacagctgctaatgactgtgttggtgttgctcggcagcttggatcctagcatgactatacattgtgacatggtcattacatatggattacaccaactggagaattgccagacttgtggtaccaattatatcatctcagtcttgaatttactcacgctgatttgttgaacagat

SEQ ID NO: 3601 - DNA, 394 bp, Homo sapiens
  CDS 73..237
aaaggtagcgtggccggcgcccgagctggggttgtgtccctgctgggctgccgttccagctggactgccgccatggaactcagcgccgaatacctccgcgagaagctgcagcgggacctggaggcggasatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggacctaaaaaaaaaaaaaaaaagg

SEQ ID NO: 3602 - DNA, 480 bp, Homo sapiens
  CDS 95..265
tcaatgaccttcaccccatagtgtctagtatagagctatgttacattgaatggcaaaagtgactttgtagaggtgtcgtttatccggatgctgcatgattaagaccaccatactcttatcaagcatacaggtgttaatgtctattttaaagaggagagaactcaagaagttctgtagaaactgctttcttcatcatatctcaaaggatttgctgaggatttcagaggtgccacgagttgagagaagtgagccaaaaaaactcatctgaagtgtttggacagatgaaatcaatggctgctgattaaatgagaggcacacagcaagtacactgtaaaataattaaatagtaattgaaaatacctgcagaaagtttgattagcatctgaggaactaacaaaagtagccagataataacaaatgcatttccaaagcctgtttaattctatcaatgtaccttagtaaatatgtagttagtctcat

SEQ ID NO: 3603 - DNA, 460 bp, Homo sapiens
  CDS 196..402
  misc_feature 192..194: n=a, g, c or t
agtgtctagtatagagctatgttacattgaatggcaaaagtgactttgtagagaggacttccattgatcaatagccactcagatgttctgtgtttgccatgagtatcggacttcagtcttctggaaagatggctgtggtgcctaaacacatctgtgcctggcctcacccgcgggtgtcgtttatccggatrnnncatgattaagaccaccatactcttatcaagcatacaggtgttaatgtctattttaaagaggagagaactcaagaagttctgtagaaactgctttcttcatcatatctcaaaggatttgctgaggatttcagaggtgccacgagttgagagaagtgagccaaaaaactcatctgaagtgtttggacagatgaaatcaatggctgctgattaavtgagaggcacacagcaagtacactgtaaaataattaaatagtaattgaaaatac

SEQ ID NO: 3604 - DNA, 441 bp, Homo sapiens
  CDS 58..255
agagcctgaggaagagggcggcgacggtggtggtgactgagcggasccggtgacaggatggtgagggctgcagttgcggcgaccaaggcctggctctcgggtggggtgctgcgttgttgggagccgtggggaggccgagggcgaggaattgggaaatcccggagcctcggcgtcagggcccaggcgctggcctggkaaaggcccagaagaggtctagggaaggaagggakcggccacctctgggtgcggctggcctaggtctcgtatcccggccccaaggggcagaggcatccaaggggtaaaaaggcccctctagcagcccgacctgtcacgagacacgcacgcccgagccagggaaggcctttggtcctatacctcgaatgttccggggataggggcacggtcctccgtttccagacggttcctactcgtttcccgcaa

SEQ ID NO: 3605 - DNA, 486 bp, Homo sapiens
  CDS 50..466
aggaagagggcggcgacggtggtggtgactgagcggasccggtgacaggatgttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgcccactggggcatataatgcctstgtgaaacaaa

SEQ ID NO: 3606 - DNA, 469 bp, Homo sapiens
  CDS 75..443
aagtgggcgggtcgcgaggagcctgaggaagagggcggcgacggtggtggtgactgagcggasccggtgacaggatggctgggcacagattggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaattttgaagcatttgagcatgaaataaatt

SEQ ID NO: 3607 - DNA, 488 bp, Homo sapiens
  CDS 9..434
aatataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaatcacttgcaagacaagatccagaagctttatkaacgamagataaaggagggaatggatatgaactacattatccaaaggaagaaagaatttcgga

SEQ ID NO: 3608 - DNA, 501 bp, Homo sapiens
  CDS 11..220
attcaacatcatggatgatccgaagagtgaacagcagcgcatactgcgccgccaccaacgcgagaggcaggagctgcaggcccagatccggagcttaaaaaactcggtccccaagaccgacaagacgaaaagaaagcagttgctccaagacgtggcccgcatggagggccgagatggctcagaagcaccggcaggagctggagaagttccaagacgacagtagcattgaatctgtcgtcgaagacctggccaagatgaatctggaaaaccggcctccccgctcctccaaagcccacagaaagagagaaagacagcgagactccgtctccgaaaaagaaaaaaaaggaaatgtttaagtttcatgtgttctgggaaaaataaatctagtagactagctcgggggagtcttcaggttttcctatgaatgtcttgggattactttagacaaaaattggagtttatgtgatcaaaatgccttgtgaaggccttttgctgagtttt

SEQ ID NO: 3609 - DNA, 638 bp, Homo sapiens
  CDS 326..478
agaattttttaattggcatgagacggttcctcaactgttaaattaaccaactttgacctgtctttagaaaaaggcttatttgtatgattttgggctaactccccggggaccatattaaatgacaaaatgctcctttgggtgacacaccctacaaagtatttgctgttacgaacataaacgcccacattcttaatatctaatatttttgaccagtgatgttttatgctgtcatctgaaccctagagaagcagtgtcagaggaaaccttggtgtcacatgtgtcttagcaaaagggttaccatgatcgagggtcatgtgaccaaaagatgctccagagaagcttgagaatttgtttcaagttgggaggagggttggagatacaaaaatcactctgctctacaggactcttcagctgtctatgcaagaaattccgttttctctttcagcacctggaaagacacagcagcccaccgaggcgataggtgattcactaagcacaagaggaatgttttctaagcaaggcgtcccttgcctctcaaacaaatgccctccaagtttgttagggtttctattcctgcaacttgtggtatcaaaaccacttcctggaattgtcaaagcactgccaaaataaatgttttt

SEQ ID NO: 3610 - DNA, 490 bp, Homo sapiens
  CDS 242..475
cactggattatttgaatattaatggattttccttgtaaatgtgatgaggatgacgatcccaagaaggacttccctgtgtctttcagaagacagaggagagctcctgccactcttaggggttcatgtcgtgaactcttcatctgtattcaaaaaatgaaaacctaagaactttgatctaagctgttctaagatttgctcaacccaaacctttcaggatactcctttgaggaaggttttacccatggcagtagctataagactttctgctgatacacagtgggaggattcaccagggaagagtatcttggagttacacatgagctgcaccaagatccctgagcgatgtgaagctgataaaaaagagtctacatccagctgggtgtggtggcttacacctgtaatcccagcactttgggaggctgatgcgggaggatcacctgaggtcaggagttcgagaccagcctggccaacatggtgaaacccgtctcta

SEQ ID NO: 3611 - DNA, 453 bp, Homo sapiens
  CDS 14..181
  misc_feature 138: n=a, g, c or t
cgtgataacttacatgccagtgtgcgatgtgggaaagaaaaagaaggcatcagacatcacggaagggctctgtatatttckcttttcggaaccacctccattgacccttattacacaaaccctgactgagccaaggancccaaacagtgcagatctaagaactttcgaagactacctgccctgacagctatttcaatgctagcggggaatttcagcaacaaccaatttaactgagcacaaatgatgtgctgactgaagtttggtaaaaagcatgtagttgagattcaaaagtaaatgctgtctcctctctgagttgcttgtgattgttaatagactgaaaactgaccaaattggcaagaaagcaaatagttttacttakatggctatacaattatcctcaattactaaattcagttggtgagcaccataattactttgtaatataaagggcas

SEQ ID NO: 3612 - DNA, 699 bp, Homo sapiens
  CDS 159..566
  misc_feature 109: n=a, g, c or t
aaaaacggaggcgacgcgggggcttggagcgcagagcggtttggtcgttcgttgggcggtgctggtttttcgctcgtcgactgcggctcttcctcgggcagcggaasgncgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcascatcggtgcgctgcaggaggctagcgaagwacctggtgggtctgttcgaagataccaacctgtgtgccatccacgctaagagagtcaccatcatgcccaaagacatccagttggctcgccggatacgggagagagagcttaagtgaaggcagtttttatggcgttttgtagtaaattctgtaaaatactttggttttatttgtgactttttttgtaagaaattgtttataatatgttgcatttgtacttaagtcattccatctttcactcaggatg

SEQ ID NO: 3613 - DNA, 377 bp, Homo sapiens
  CDS 129..344
  misc_feature 80,342: n=a, g, c or t
gagcgcagaggtttggtcgttcgtttggcggtgttggtttttcgctcgtcgactgcggctcttcctcgggcagcggaasncgcgcggtcgtagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgccccttccagaggttnggtgagggagatcgcgcaggatttcaaaaccgacc

SEQ ID NO: 3614 - DNA, 493 bp, Homo sapiens
  CDS 93..350
  misc_feature 252: n=a, g, c or t
aggaagtaagatcctggcctgtgcagctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcgnaggaaggcgaggtaggaagagrtgtactgatgargctgaaagrattacccagrgattgtgtwactggctgctcgccgggcttctgtaggattgaagaataagaacaaaagagcactacgtgtgagaagctcacttgaaagtcccaaattgaaataaacactgttttgatgagaaggggcctcctttttaatattctttccatgtggaatcatcagcagtaaagagatctatagatctggaa

SEQ ID NO: 3615 - DNA, 491 bp, Homo sapiens
  CDS 137..406
caggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaagttagttccaatttttattttcaatatttatagtgtcatcatgaaataccttattactgaatttgttggtaagaaagtaaatttgcaacttgcaaaataggatttttctttgtgctaaagaaggtactgttttcaattgaattgaagaataagcttttgtttagatttttatataatgagac

SEQ ID NO: 3616 - DNA, 549 bp, Homo sapiens
  CDS 120..335
asawrwrkmagaagtagaaaaagggacacaaactaagaagggtgctgagcgctcgtcacctggagggacttgtgcctctctcagtggtagtagaggggctacttcttcctgccacggtcatgattgagaggcaacgggtggcgagtctacaggggacgtcgtcgagcagacatgggataactttaagggagaagacagacaaggggaggggctcctgtgatgggatcagtcagatgcctgcctggccgctccccctgaggggacttgggctcctcttaacattggcaggctggtataaacttccggctcagatcaagctatgcctgatgctgccttaagccttatgaggtcgccacggaaccgcagaaactcctggagggcagagctgtgtctgccatcttcatcattgcattaccaccaccaagcacagtgcctggcacaaaagagttgctcaataaataaatcaggatgaatggataaatacatggataggcactttgagctacagatgagtttaaatactttgtgkttttcttagtcaaacatgtg

SEQ ID NO: 3617 - DNA, 489 bp, Homo sapiens
  CDS 189..353
aacagaatgattactatcagtggtggaagcatctgtacctcttcaaataccctcttcgtaaaaatgtatgcttgaaaggcaaaatgatttatttgtgcctcacaaccaattagcaatgaagataattcagaaaaagggagcaatgagcttaggatgaaaagctagagaagaggtaagagttgacctggatgggatgtgaagagctkgcagagcaaaggcaggcatcccaaatggagagaacctkaggagagtgcagacctcttgtggaargtagaactgagtgtggacaaacctggagtaagagggatattatcactgctttaaaggagagtactatgcatgaaggaagtatttaagtgatgcttgttgcattgagctgataaggacatactgctacagactcagcaattgagttgattttatggatggcacggtcactctctcagccatgctggggcacaaccttaaataggagtctaagtgggaaca

SEQ ID NO: 3618 - DNA, 753 bp, Homo sapiens
  CDS 123..575
ctttttcctgattggccgtgttgtacggcggcttctcgcgcastgatgacctggaagtgatgcctaaagctgtggaccgcgtgggctcgcctccctgggactaggtttcagcggccgctgcgatgaccaaaataaaggcagatcccgacggcccgaggctcaggcggaggcgtgttccggggagcgcacctaccaggagctgctggtcaaccagaaccccatcgcgcacccctggcttctcgccgcctcacgcgaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcatccaagcgccccacctgtgtgataatggtcaagccccatgaggagtaccaggaggcttacgatgagtgcctggaggaggtgcagtccctgcccctacccctatgaggggctccggtagcacctggggcacctgccgctggaagctattgggctggcagcaggacgactggctgtcctcctgcccacccacactgacggcatcttcccagttccccaaggcacgccttcttcccaggcagctctaacagccctttcatgagggtaatgctagtctttctgt

SEQ ID NO: 3619 - DNA, 393 bp, Homo sapiens
  CDS 33..296
  misc_feature 205: n=a, g, c or t
tatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggsncccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctga

SEQ ID NO: 3620 - DNA, 482 bp, Homo sapiens
  CDS 48..416
  misc_feature 398: n=a, g, c or t
accgcgtgggctcgcctccctgggactaggtttcagcggccgctgcgatgaccaaaataaaggcagatcccgacggcccgaggctcaggcggaggcgtgttccggggagcgcacctaccaggagctgctggtcaaccagaaccccatcgcgcmsccctggcttctcgccgcctcacgcgaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagcgcanccaagcgccccacctgtgtgataatggtcaagccccatgaggagtaccaggaggcttacgatgagtgcctggaggagggtgcag

SEQ ID NO: 3621 - DNA, 423 bp, Homo sapiens
  CDS 82..300
agacttgaagatgtgtgattattttcagtaggcagacatctaaccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgcatagacactagagaagagttggttgatcgtgtttttgatgaaagcctcaacttccaaaagattcctccattagttcattccaaaacaccagaaggaaacaacggtcgatctggtgatccaagac

SEQ ID NO: 3622 - DNA, 479 bp, Homo sapiens
  CDS 133..282
aggtacacacgctctggcccagggcagaagtcaacaaatggcggctctcacccatccctgctgctaggacttggacttgagtctcctcacttgcctggcctaagaggcacttctccttgccaagtggatgtaatgctgggtccagctgttctcactgcagttctgctactgactcaccatgtgatggaacaaccaactgtcctgaaacctcgatttcttcatctgcaaaataatcatctgcgcccctccagcctcagagcactgctgccagaaccaagcatgtaaatgactgaaagtgctgtgaacacagggaggtgtaacaggcaacacagcgaggtggagaaaatcctgcgttctgtgtcaaaaacctggactccaattccacctctcactagcggaggagccttgckctaaggctgaggtcttgtactgtctgaatccctttactgtaaaaagaggtaacaataaagatacctaaa

SEQ ID NO: 3623 - DNA, 505 bp, Homo sapiens
  CDS 28..366
caattgtgcttcaggcctcctgcagagatgctgggtccccaagtctggtcttctgtgaggcaggggctaagcaggagcttgtccaggaatgtgggggtctgggcctcaggggaggggaagaaggtggacattgcgggtatctacccccctgtgaccacccccttcactgccactgcagaggtggactatgggaaactggaggagaatctgcacaaactgggcaccttccccttccgaggcttcgtggtccagggctccaatggcgagtttcctttcctgaccagcagtgagcgcctcgaggtggtgagccgtgtgcgccaggccatgcccaagaacaggctcctgctagctggctccggatgcgagtgagctgtggggggcgtctgcgccctggccaatgtcctgggggctcaggtgtgccagctgtagcgactgtgctgcacggggcaatgggaagatgcccagaaactgcagcaccgcctcattgagccaaacgctgcgggtt

SEQ ID NO: 3624 - DNA, 479 bp, Homo sapiens
  CDS 117..476
agtaacagagccttgagagagactcttagctaaagtctaatcctccttccattcttccttcacaggaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttkggggcacggcgtgtcctgcccagtgggtattaaaaaataattgctccccacatggtgggcctttgaggttccagtaa

SEQ ID NO: 3625 - DNA, 422 bp, Homo sapiens
  CDS 37..393
acgtcagggggcggtgtcggagtgaatgggggcagcatgaggccgggcggctttttgggcgccggacagcggctgagtagagccatgagccgatgtgttttggagcctcgccccccgggtaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggctgcttatgaacgccaacgggcgcasgtggcccgggctgcggactgtttgggctgactgccgaggaagtctacctggtgcatgatgagctggacaagcccctggggagac

SEQ ID NO: 3626 - DNA, 407 bp, Homo sapiens
  CDS 51..239
ttttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcatttt

SEQ ID NO: 3627 - DNA, 553 bp, Homo sapiens
  CDS 36..452
gcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctagggtttgggatttcttcagttccaacaaaaggtctgtcatctgataacaaacctatggttaacttggataagctgaaggaaagagctcaaagatttggtttgaatgtctcttcaatctccagaaagtctgaagatgatgaga

SEQ ID NO: 3628 - DNA, 522 bp, Homo sapiens
  CDS 1..486
atgatgaggcgcaccctggaaaaccggaacgctcaaacgaaacaactgcaaacagctgtctcaaatgtggagaagcattttggagaactgtgccaaatcttcgctgcctatgtccggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttattgtatcctttgaatttgggtctttaaaaaaatgtttaaggtatggagtacaaaagtaaatgtatatagaaatttgtgcatttttactttta

SEQ ID NO: 3629 - DNA, 850 bp, Homo sapiens
  CDS 524..835
agtactgttgcttctccattcccgagttagtccatctcctgattgaatttcattgtcaggcagtcttttcaagttacaggtgcagtggcttctatgttttgggttgatgctgaattagggagtgatatttaycttgatggtatcataactatwgtggattcaaaatatggattaaaacatttarcagaagagaaacctgatggccttatcaatgaagctactagrcaagttgctttggcagatgccattctcattaatataaacagacytggttccagaagaagatgtaaagaaaytaagarcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccakgaaatgcaaaggaagaacatcttaatatgtttattcagaatctcctgtgggaaaagaatatgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcat

SEQ ID NO: 3630 - DNA, 583 bp, Homo sapiens
  CDS 161..355
agtcctttggatattaatctgactgggttggctggtgcacctaaataatacatatatcctcctcaaccccatcggtctctctgattcctaaatcatccccaaacatttctggtggcccatatggggattggagataacagatttactgtctcctttgcccatgggactagggccctggggctgtggaagacctggcatccaaggcatgccatgggggagtttcacccggatggagactggctctccccgcatcctgcccagcagtgcaactgaacctgagatggggctgcaggatgacaccagcacttcaggaaccgcgttgcaggtgtcacaccttggattcaccatagctggctgaaactagcagcagcagtgactcccgactatgaccagtggattaaccaacaagaccctgattgccccacccgaatagacctacggcgaatcccaaccaccagtaagaaggacaactgccctgctctgaccacactggaggctggtcagtctacacatggctgaagcttgaagatcttgcaagctctgctctagtcacatcctggaagctgactagtctacacacagc

SEQ ID NO: 3631 - DNA, 500 bp, Homo sapiens
  CDS 123..482
cggacggctgcagcatcgcgtggggatcgaaagcgggggcttctgggacgcagctctggagacgcggcctcggaccagccatttcggtgtagaagtggcagcacggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttaagctgttgaaaatggacagataga

SEQ ID NO: 3632 - DNA, 476 bp, Homo sapiens
  CDS 29..271
ggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggcgtttggcatctctgccctcatcgtgggtttcgactttgatggcactcctaggctctatcagactgacccctcg

SEQ ID NO: 3633 - DNA, 464 bp, Homo sapiens
  CDS 208..402
taattttaaattttaatgcaaaattttaatttgtctttattttttatcatttgaactgataagcactttttgtgtcaatataaaatatactaaaactgatgaaatgcyaaggacatgtctkgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaa

SEQ ID NO: 3634 - DNA, 408 bp, Homo sapiens
  CDS 4..156
gtaatggccaaaaagtggaaacaagctaaatattcttcgactgacgaatggataaagaaaatgtggtatatctatatgatggackatcackckassakkcaaaraaacaaaatactgaatcatgctgcggtatggatgaatttgaaaacattgtgctgagtgagagaggccggacgcagaagtccacatattgtgtgattccatttatatgaaatgttcagaaagggcaaatctatagagacagaaagcaaattcgtgattgcctagcgtggggtgcagaaaaaagtggggattggagggtgataactcaggggtgcagggtttctttggggggtgatgaaaatgttctaaaattaattatgggtgattatggttacacagcgttatgaatatactaaagaccattaa

SEQ ID NO: 3635 - DNA, 483 bp, Homo sapiens
  CDS 234..404
tgaacttaaagatatatctgaagagattacctataatgcagcacagagataaaaagtgaaatacagatgagaaactgagacatggaagaaaataaaagggcccaagacacatctaataaatgtcataaaaggagaaaaaggaggagaagcatcagaagaaaaagtggtttacaacttttcaaaattaaactcaattttaagatgaggaatcaaaatgagtgtcaagtaggataatgaaagtggatctaacacctagacacatcacagtgataatgcaaaacagaaatcttgaaaagaaggaagggagggaaggaaagaaaagaaaaacagaaaagacatgctacctaaaaggaaagatgattgggcacaagatgtcagaagacaggagaataataccttcaaactgatagaggaaaagtagcaattaagagtggggcaaaataaagacattttcagacaaagataaggtttttttcatagact

SEQ ID NO: 3636 - DNA, 419 bp, Homo sapiens
  CDS 110..292
gattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagttcacactcgtctccatggccggcgttcaccgagaccattcacgccgacagcgtggccaagcgtccggagcacaatagatctgaagccttgaaggtgtcctgtggcaagtgtggcaatgggttgggccacgagttcctgaacgacggccccaagccggggcagtcccgattctgaatattcagcagctcgctgaagtttgtc

SEQ ID NO: 3637 - DNA, 488 bp, Homo sapiens
  CDS 21..257
aagcagctgcagagatatccatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctctcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccmaattagaggccaggttgagaacttt

SEQ ID NO: 3638 - DNA, 474 bp, Homo sapiens
  CDS 112..390
ctggaacttttgactatggcacctcgcacggcaaagggactttgcacatgtgattaattagggaagctgagatgagatcatcctgggcaatctacacgggccctcaatccaatggcaaatatccttatgagggacagaagacagacaccgaggagggggccatgtgaagacacagcagagccgggaggtgtgcgaccacttgccgcagaacgcctggagccgccagaagctgaaaaagggctccgaatccaaaagtcagcagcacacagtacccaacgctggggaggtagaggacacgctctggaccacgaagcccactcggaagaacaggttactcgcggggagaaatgggataacgagaaatcccaggcccagagtaaggatcctggatgatgaaaagtatttaaataaatggctatttccagacttctcaagaaaaacatcctactccacattaaaaaaaaaaaaaaaaaa

SEQ ID NO: 3639 - DNA, 486 bp, Homo sapiens
  CDS 215..427
atcttggagatgggagacgggcgatggctgtggtccttctgctaatgcaaacaacaaaacgggcacactagtcacccccgagggaggccaccatcactgtaactgttggccaaagctacaaaagaagcgagggaatccaaccgagcgcmscmactgagaacagcttcccctgccttctgcggcggcagaagtgaagtgcctgaggaccggaaggatggtgcagtcctgctccgcctacggctgcaagaaccgctacgacaaggacaagcccgtttctttccacaagtttcctcttactcgacccagtctttttaaagaatgggaggcagctgtcagaagaaaaaactttaaacccaccaagtatagcagtatttgttcakagcactttactccagactgctttaagagagagtgcacarcaagttactgaaagagaatgctgtgcccacaatatttctttgtacgagccacatgacaagaaagaag

SEQ ID NO: 3640 - DNA, 404 bp, Homo sapiens
  CDS 16..291
agttgtgttgtgccaatggtggagaagaaaacttcggttcgctcccaggaccccgggcagcggcgggtgctggaccgggctgcccggcasgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggcctaactacctgacggcctgtgcgggacccccatcgcggccccagcgssccttctgtgctgtctgtggcttcccatccccctacacctgtgtcagct

SEQ ID NO: 3641 - DNA, 487 bp, Homo sapiens
  CDS 19..294
gacagttgtgttgtgccaatggtggagaagaaaacttcggttcgctcccaggaccccgggcagcggcgggtgctggaccgggctgcccggcasgtcgcatcaaccggcagctggaggccctggagaatgacaacttccaggatgacccccacgcaggactccctcagctcggcaagagactgcctcagtttgatgacgatgcggacactggaaagaaaaagaagaaaacccgaggtgatcattttaaacttcgcttccgaaaaarctttcaggccctgttggaggagcagaacttgagtgtggccgagggcctaactacctgacggcctgtgcgggabccccatcgcggccccagcgccccttctgtgctgtctgtggcttcccatccccctctcagctgcggtgcccggtactgcactgtgcgctgtctgggggaccaccaggagaccagggtgtctgaagtggactgtgtgagcctggggcattc

SEQ ID NO: 3642 - DNA, 484 bp, Homo sapiens
  CDS 16..291
agttgtgttgtgccaatggtggagaagaaaacttcggttcgctcccaggaccccgggcagcggcgggtgctggaccgggctgcscggcacgtcgcatcaaccggcagctggaggccctggagaatgacaacttccaggatgacccccacgcgggactccctcagctcggcaagagactgcctcagtttgatgacgatgcggacactggaaagaaaaagargcaaacccgaggtgatcattttaaacttcgcttccgaaaaaactttcaggccctgttggaggagcagaacttgagtgtggccgagggcctaactacctgacggcctgtgcgggayycccatcgcggccccagcgccccttctgtgctgtctgtggcttccatccccctacacctgtgtcagctgcggtgcccggtactgcactgtgcgctgtctggggacccaccaggagaccaggtgtctgaaagtggactgtgtgacctggg

SEQ ID NO: 3643 - DNA, 457 bp, Homo sapiens
  CDS 174..365
agaaaatgtttgtttgtttatgaagaagttgatggaaaactgcaaacatatgcagaaaaggtagaataataaaaaaggtctaatgaactccattcagctttgaacctatccactcataaccattgactggcctttaaaaaaaagtattggcagaattaatttccacctaggtgatgggaagaaagtgttcgcctgttccagcctgtggctcctgcctggaggttacccagtggtgcgccasgccaagccatcactccccgagggcctcccctgtcaatggtgctggtatcccatgcagctcaccactggctgcgtggaaactcccttttttccaactgtattattggccttctaaggagctgttttagatgttttttctaactgcctcctcccatgccattttaatactacagatgtactaaatvatctgtttatatactgtacctacatctgtgct

SEQ ID NO: 3644 - DNA, 485 bp, Homo sapiens
  CDS 250..429
tttatttaagagacaaagaacgcccttgttttttccaccacgtgatggcgcagacagaagacaaccagcatctatgaaccaggaagcccccaccaggcactgaatctgcccctgcgtggatcttagacttgcagactccagaactaaccttacaatgtctcttctccattaagaaaacctacttcaacatctccattggttctcaacatagaggtccaaattttggtctggagccagagacaatataggatgaagtttgatttgttccaaaacccacagaaatctctaaaatggaagaattttcttagaaccaaaaggcatggaattgatgacatgaaactgactctccaccatgtaccagagatagacctgagaaagcgctcgtgtcctccaggaacttcactcacctggaagagacaagctgtatcgtgagctgggcaacatagtgttcattgtaacttttctttttcaaataaatttctttg

SEQ ID NO: 3645 - DNA, 474 bp, Homo sapiens
  CDS 37..207
cttggcgtggctgcaggggaggccgcggcggggaaaatggcggacgggaaggcgggagacgagaagcctgaaaagtcgcagcgagctggagccgccggagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataamggaaagcatggttttctgataaccagaagctgtgggagcg

SEQ ID NO: 3646 - DNA, 473 bp, Homo sapiens
  CDS 4..153
cagatgtttcattacattaagacttctctggctccactaccctgctacgtttatctgattgagcatccttccctyaaattwkgcgaccactcgttccatagccaagtatcctgtggagtcttgctctgtcacccaggctggagtccgatggtgtgatctcagctcactgcaacctctacctctctggttcaagtgattctcctgcctcaagctccctagtagctgggattacaggtatagaagttggtcctcagcctcaaggggttctgagagctgatatcttggatcaaatgagaaaaatgattaaacatgctcttgattttatacatcatttcaatgaaggtaagtaataatgaaggtaacgttatcaaacttaaccaccaaacatttaaataacaattggaacctgggtcagatttgccatgctaaagatatgaagtgctttttaaaatttttattcacttcagctattc

SEQ ID NO: 3647 - DNA, 527 bp, Homo sapiens
  CDS 246..482
tagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagtggtaactttcattttacagctgctccagacctgaaattaaagcttcacatgtagatgtgatgttaaatttaaagttgaaatgtagtaatttgaagc

SEQ ID NO: 3648 - DNA, 490 bp, Homo sapiens
  CDS 53..253
gatttgtttttagagacatgagacatggaaaatagttaagtaataatataatatgggakgcatggactatcagaggaggcaggcaggactgcccaacctcctcactgggcacgttacgctacttcctcctgacctctatagtcctttgcatttatcaagcactgtcatacgtgttatctcatgcaatgaccagggtgtcaccccctgttttgtaagtgacaaaactgtcactcagagggatgaaatgacatgctaaaggtcatctagttagtaatggtggaatcagggctggagcccagtcttctaagcctagttcctattctgctcttcatcatctgtctcaggatggtaaactgaggcctggaaaggagaaggaactcacccagcctaaagattaagggttttatgctggccacggtggctcatgcctcccaacattttgagaggctgaggtgggaggattgcttgagtcaaggagtttgagcccagc

SEQ ID NO: 3649 - DNA, 536 bp, Homo sapiens
  CDS 197..367
ttcttgcttgtttgactgattttgttgttaggtacgattgcaattatgggacacagcaggtcaagagcggttcaggagcttgattcctagctacattcgtgactccactgtggcagttgttgtttatgatatcacaagtgagtggagggaattatgcatttctaatcttctttcaacctttagcttagctgcatgcatgttcttgtcttgtgcttgtwttccttactggcatgtaaaaataagttttatcatagtaaattacataccagccaggtcagaaatatttgctttggtgtttataccaatatgctttatatgtaactgtgccaggttttttgccccagaaattttcttttgggtccaactatgaatcctcttcaagggtttcttagtatcctgttattcgtaaaccataccataattatagttggaggaatgtttccttgatctcagatttctctaaaataaaatgatctgcatttaagtctcttgccaggttttccaaatcctccaagctttctattgaggctatttac

SEQ ID NO: 3650 - DNA, 484 bp, Homo sapiens
  CDS 301..480
ttggaggtctccgtcgctgtttagaatgtggccacttggctgtttcacagtttttaaagctattttattgaatagtaaagcagtgaacttagcctttgttctttgtgtttctaatttaagcatatagtctatttaatttttgatatgtaaatacacatcaatacatatatatttacccatgtggccctgtgtagtcagtgcatgaggcttgcatagcccaaaaaggtacattccagggttctggggaaagaattttaaaatgccatcctctaatacagacgtttataaaacttaaatgaaatgattgggcttaaccatatgcaagaaagtctgcagaaaataaatcacctagaaactataaatagaaatgtgctgctgaggctgggcacggtggctcacacctgtaatcccagcacttggggggctaagggaggcgtatcacctgaggtcaggagtttgagacaagcctggtcaacatggtgaa

SEQ ID NO: 3651 - DNA, 494 bp, Homo sapiens
  CDS 267..488
  misc_feature 266: n=a, g, c or t
aagtcgcacctggagctgtcctagcgcctagttctctcccggccgcagagctggccgcccagggggagtcgcagagtttggaagaactctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaanatgaatggttttggaagacttgagcatttttcaggagcagtatatgaaggacaatttaaggataatatgtttcatggactggggacttacacattcccaaatggggcaaagtatactggaaatttcaatgaaaatagggtgaaaggtgaaggggaatatactgatatccaakgactagaatggagtggtaactttcattttacagctgctccagacctgaattaaagc

SEQ ID NO: 3652 - DNA, 522 bp, Homo sapiens
  CDS 150..398
atttttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatggggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtamtggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagc

SEQ ID NO: 3653 - DNA, 501 bp, Homo sapiens
  CDS 7..216
gagaccatgatggcggcggcgctggggcccccagaagtgatcgctcagctggagaacgcggctaaagttctgatggcaccaccttccatggtcaataatgaacaacgccagcatgcagagcacatattcttatcatttaggaaatcaaaatcaccatttgcagtttgcaagcatattttggttcttcatgctttggaagtaacagttgaagagaggtgaggaaagtttgtgaaaattgtgatcggtgattagctgccacctgcctgaggtgtcttctgagaggaactaacctctttgtggtgctagagcaaggtcactggataaaaaaaagaacagaaactagtaaagtggactatgtctctttcaagctgccacagccataatggaagcagttgtccgagagtggattctcttggaaaaaggtagcatcgagtctctgcgaacattccttttaacctatgtcttacaaaggcccaagtaagtacatggacggggactgct

SEQ ID NO: 3654 - DNA, 595 bp, Homo sapiens
  CDS 324..554
tttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaaggccgggcgcagtggctcacacctgtaatcccagcactttgggaggccgaggcgggcggatcatgaggtcaggagatcaagaccatcccggctaacacgaaacttacacatgtccaaaaatgattgagatggagcaggcggaggccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggcgatgttttctctggcctgtattcttccctttaaatacccggcagttctgctgaaattactgtcagatcagtatattgagtagatcccagcagactcagctgacacagatctgactgcaty

SEQ ID NO: 3655 - DNA, 490 bp, Homo sapiens
  CDS 209..445
agcgcatggcgcgtcattgaagagagaccatgatggcggcggcgctggggcccccagaagtgatcgctcagctggagaacgcggctaaagttctgatggctggagtgcagtggcacgatcttggctcactgccacctccacctcccgggttcaagcgattctcctgcctcagcctcccgagtagctgggactacaggcaccaccttccatggtcaataatgaacaacgccagcatgcagagcacatattcttatcatttaggaaatcaaaatcaccatttgcagtttgcaagcatattttggaaactagtaaagtggactatgtcctctttcaagctgccacagccataatggaagcagttgtccgagagtggattctcttggaaaaaggtagcatcgagtctctgcgaacattccttttaacctatgtcttacaaaggcccaagtaagtacatggarggggactgctgaaatacttttgctgagcttat

SEQ ID NO: 3656 - DNA, 459 bp, Homo sapiens
  CDS 46..348
  misc_feature 18..19: n=a, g, c or t
ctctttscctsggagcgnncggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcataagtacaagcccctggacctgcggcctaagaagacacgtgccatgcgccgccggctcaacaagcacgaggagaacctgaagaccaagaagcagcagcggtaaggagcggctgtacccgctgcggaagtacgcggtcaaggcctgaggggcgcattgtcaataaagcacagctggctgaaaaaaaaaa

SEQ ID NO: 3657 - DNA, 457 bp, Homo sapiens
  CDS 46..348
ctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagkmaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggccaaaaaaaaar

SEQ ID NO: 3658 - DNA, 456 bp, Homo sapiens
  CDS 145..441
aagtcgcacctggagctgtcctagcgcctagttctctcccggccgcagagctggccgcccagggggagtcgcagagtttggaagaactctctaacacctctcggccaacttcagaagtgtataagatcagctttatctttccaaatggagacmagtaatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtgaaaggtgaaggggaatatactgatatccaaggctagaatggagtggta

SEQ ID NO: 3659 - DNA, 495 bp, Homo sapiens
  CDS 180..464
cccactggctgctctgaaaagccatctttgcattgttcctcatccgcctccttgcccgccgcagtcgcctccgccgcgcgcctcctccgccgccgsgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgagggtagacgaagaagaggaaggaaggtggggaggaagaggaggaggaagaagaaggtgatggtgaggaagaggatggagatgaagatgaggaagctgagtcagctacgggcaagcggggcagctgaagatggatgaggatgacgatgtcgatacaagagcagaa

SEQ ID NO: 3660 - DNA, 480 bp, Homo sapiens
  CDS 179..385
  misc_feature 68: n=a, g, c or t
actggctgctctgaaaagccatctttgcattgttcctcatccgcctccttgctcgccgcagccgcctncgccgcgcgcctcctccgccgccgcggactccggcagctttatcgccagagtccctgaactctcgctttctttttaatcccctgcatcsggatcaccggcgtgccccaccatgtcagacgcagccgtagacaccagctccgaaatcaccaccaaggacttaaaggagaagaaggaagttgtggaagacmcagaaaatggaagagacgcccctgctaacgggaatgctaatgaggaaaatggggagcaggaggctgacaatgaggtagacgaagaagaggaagaaggtrdabvvggaagaggaggaggaagaagaaggtgatggtgaggaagaggatggagatgaagatgaggaagctgagtcagctacgggcaagcgggcagctgaagatgatgaggatgacgatgtcgata

SEQ ID NO: 3661 - DNA, 514 bp, Homo sapiens
  CDS 180..410
  misc_feature 233: n=a, g, c or t
cccactggctgctctgaaaagccatctttgcattgttcctcatccgcctccttgcccgccgcagtsgcctccgcmgcgcgcctmmtccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaangagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgagggaagaggatggagatgaagatgaggaagctgagtcagctacgggcaagcgggcagctgaagatgatgaggatgacgatgtcgataccaagaagcagaagaccgacgaggatgactaga

SEQ ID NO: 3662 - DNA, 362 bp, Homo sapiens
  CDS 76..252
aatatacctttctggcttgctggttctgtcggctgagacaaagcagtcccattcgcagcgggaggccaaatcaaaatgaaattttatttagtctgcactgtccccagattgggtttcagaatgactgctttaggagatagcatggatgtggctgatgcatgctttgcatatgaaactgcagtaggaaaagaaatctacataatcaaaaaaatctgtgctgtgtgtgtgtgtgacaaaaaccctggactccagtgattttgctgccgtgtatgtttcaagcaggccctttcagggttgaaagacgttaaaaaaatttcttaaaataatgttattaataaatattaataaaaaaaaaaaaaaaa

SEQ ID NO: 3663 - DNA, 1043 bp, Homo sapiens
  CDS 295..510
aggcggtgctgcctgtgtcgtcgtccctgtttgttcttcttcaaacctcaggatttctccgtgtttcccagaccgtaacgttccaaaggtagaaacacagatgacagatttttggtcttttcgtcatttcctatatatgtgttcaatggtttggaatagttcaccagtgaagtcatctcaaccagcacagggccttgactcctaacaacaatcacacgaacttggaagaggatccttccccagctgaaacttcacttgagaccttctcattggccatcatcgacatctggattcatgatacagagaaacttgagtaatgatgacaatagcagtccagcctgcatggatgctgacatggatgctgtctcccattcttaccactggatgtcaagaaatgctagatgcgatccagccagtctgtactcgactctcagttccatcttctcaactcacagtgtcttccaaagtccatgccacaccacagcctggaagatctcccaaggctttgaataactcaccagtgaagtcatcttgacctggacagaaattgaatcctcccaagaatccaggagcttggaaggggatcyttccccagatgagccthmccttgaaatctctgccaggcatctgacccagagaaactgccacaccactttacagaggaacaccagggatgttccaggaaccatgcccacaaagcttactaagccatgggactgcatactacactcccaaggacatccacaaagtcaagactcttgcgttttcagactgtgatcatgggctacattctccataccatgttcatatctacagtgaaaaaacaaactcctgcatcctggagacctacaatgagagacacagctgaccttgaccatatttcttacttctcagaagactgtagcagtaattcaggtgctattatttggggcatttatatttcagtaaaccttcttacccctctaatcttacagttcaccccatcagaaaggatggtttcatttaaattggcaatcttaagcaaaaaaaaaaaaaaatgcgaa

SEQ ID NO: 3664 - DNA, 536 bp, Homo sapiens
  CDS 153..416
acttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattyaaaaaaaaaaaaaaaaaaaaa

SEQ ID NO: 3665 - DNA, 464 bp, Homo sapiens
  CDS 177..380
actggctgctctgaaaagccatctttgcattgttcctcatccgcctccttgctcgcsgcagccgcctccgccccgcgcctmmtccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagacacgcccctgctaacgggaatgctaatgaggaaaatggggagcaggaggctgacaaaggtagacgaagaagaggaagaaggtggggaggaagaggaggaggaagaagaaggtgatggatgacgatgtcgataccaagaagcagaagaccgacgaggatgactagacagcaaaaaaggaaaagttaaactaaaaaa

SEQ ID NO: 3666 - DNA, 567 bp, Homo sapiens
  CDS 152..415
  misc_feature 539: n=a, g, c or t
ayyysskcgrgcsgsgtsgsstygsmykwskssscyycsskrcmsckmcmrsymyarsscyagtcggactgcgacacagcccatcccctcgaccgctcgcgtcgcatttggccgcctccctaccgctccaagcccagccctcagccatggcatgccccctggatcaggccattggctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaatttttttaaaaatttgttgtaaactgcatgttttataaaatanaaataaatatcgtttgttatttaaaaaa

SEQ ID NO: 3667 - DNA, 450 bp, Homo sapiens
  CDS 177..383
actggctgctctgaaaagccatctttgcattgttcctcatccgcctccttgcccgccgcagtcgcctccgccgcgcgcctcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaaagaagaggaagaaggtggggaggaagaggaggaggaagaagaaggtgatggtgaggaagaggatggagatgaagatgaggaagctgagtcagctacgggcaagcgggcagct

SEQ ID NO: 3668 - DNA, 467 bp, Homo sapiens
  CDS 70..333
  misc_feature 261,351,357,422: n=a, g, c or t
atcccctcgaccgctcgcgtcgcatttggccgcctccmtaccgctccaagcccagccctcagccatggcatgccccctggatcaggccattggctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccangaggtgaacttccaggagtatgtcaccttcctgggggccttggctttgatctacaatgaagccctcaagggctgaaaataaatagggaanatgganacaccctctggggtcctctctgagtcaaatccagtggtgggtaattgtacaataaattttttttngtcaaatttaaaaaaaaaaaaaaaaaaaaaaaaaaaaaaaaaaaa

SEQ ID NO: 3669 - DNA, 452 bp, Homo sapiens
  CDS 177..380
actggctgctctgaaaagccatctttgcattgttcctcatccgcctccttgctcgccgcagccgcctccgccccgcgcctmmtccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagacacgcccctgctaacgggaatgctaatgaggaaaatggggagcaggaggctgacaaaggtagacgaagaagaggaagaaggtggggaggaagaggaggaggaagaagaaggtgatggatgacgatgtcgataccaagaagcagaagaccgacgaggatgactagacagcaaaaagggaaagtt

SEQ ID NO: 3670 - DNA, 550 bp, Homo sapiens
  CDS 77..364
gagaaacattatgattctatggcagttgatggtgggctggagagggcagtttagagcagaaaaggggctaagttgaatggatcgcagcagttaccattgctgctgggacactgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggrttctaaatgtggtatattgcaaactgcagctttcacatttatggcatttgtcttgttgaaacatcgtggtgcacatttgtttwaaca

SEQ ID NO: 3671 - DNA, 514 bp, Homo sapiens
  CDS 252..401
gttttgagctcggtatcctagtgcacacgccttgcaagcgacggcgccatgagtctgacttccagttccagcgtacgaggtgaagtggggcctgggagcgggtgaggctgttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtactgcckttgttggaggtccaaaaagttcccattctgtgatggggctcacacaaaacataacgaagagactggagacaatgtgggccctctgatcatcaagaaaaaagaaacttaaatggacacttttgatgctgcaaatcagcttcgtgaagttacctgattgtttaattagaatgactaccacctctgtctgattcaccttcgctggattctaaatgtggtata

SEQ ID NO: 3672 - DNA, 597 bp, Homo sapiens
  CDS 145..432
atcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacactgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaactgcagctttcacatttatggcatttgtcttgttgaaacatcgt

SEQ ID NO: 3673 - DNA, 504 bp, Homo sapiens
  CDS 252..401
gttttgagctcggtatcctagtgcacacgccttgcaagcgacggcgccatgagtctgacttccagttccagcgtacgaggtgaagtggggcctgggagcgggtgaggctgttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattct

SEQ ID NO: 3674 - DNA, 426 bp, Homo sapiens
  CDS 30..242
  misc_feature 335: n=a, g, c or t
agtttagagcagaaaaggggctaagttgaatggatcgcagcagttaccattgctgctgggacastgcaattggttatctagcttacaaaagattttatgttaaagatcatcgaaataaagctatgataaaccttcacatccagaaagacaaccccaagatagtacatgcttttgacatggaggatttgggagatakagctgtgtactgccgttgttggaggtccaaaaaggttcccattctgtgatggggctcacacaaaacataacgaagagactggagacaatgtgggccctctgatcatcaagaaaaaagaaacttaaatggacacttddtnatgctgcaaatcagcttgtcgtgaagttacctgattgtttaattagaatgactaccacctctgtctgattcaccttcgctggattctaaat

SEQ ID NO: 3675 - DNA, 504 bp, Homo sapiens; identical to SEQ ID NO: 3673
  CDS 252..401

SEQ ID NO: 3676 - DNA, 586 bp, Homo sapiens
  CDS 96..299
agtgctgcttactgggtcctgaatcggctgcgtgctgttctaggcatctttcaccctgaagtcacgggaacaacgctgaggggcagccagagattatgtgggcttttccatgggaagaaccactctacgttatcaccttctacatagtagcagttgaagccaaatggacagaaagcccgagacaacatgaagttgttctacaagttattttggagaaattgacttaccataccactcatcaacccatgcaaaagcctgtctatgtccaatcagcagaatgtctcggaccacctaaaaagtaaaagaaggagactgaaataatagcatctttgatgaaaactatctggaagacaagttgttaacaattctggggatcttggtgattacagagttcttaatccctctgtccataggtgatgacaattacaggctgcctataggtcctatagtgctcacacacctccagcccttccccatggtgtacacacacttgcagtatattcatctctttgtcttatttgagagtagggctgggtgtgtgtacaaactaatgacaaatacttgacagtcacacagcagtgataca

SEQ ID NO: 3677 - DNA, 465 bp, Homo sapiens
  CDS 65..340
atcccctcgaccgctcgcgtcgcatttggccgcctccctaccgctccaagcccagccctcagccatggcatgccccctggatcaggccattggctccctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaaggstgataaataaatagggaagatggagacaccctctggggtcctctctgagtcaaatccagtggtgggtaattgtacaataaattttttttggtcaaatttaaaaaaaaaaaaaaaaaaaaaaaaaaaaaaaaa

SEQ ID NO: 3678 - DNA, 471 bp, Homo sapiens
  CDS 219..455
aacagaaggctcagttgcccaagtgacgaaggcattgtggggcacgaaccaggctttggtgaatttatctcattatacaccaggagttaatatttaaaaaccagtgtcatataaagaagaaaaaagatatggtgagatacaataccattaacacttcttcagaaacggattttaaagcagaacttccatgactgtgaaatccaaccgggtgcacgaccatgaggaaggatggcgagggaggaaaccgcgctttgttcttgagcaaagaaaattgtgtcacattaaaatggcctcaagcattcatcactatgagaaagacatacttgagctacccatttggtcctaaggaggatgaagcatgctgtgtgacagagacaaccagcagacatttgagccaggacagccttcttttaaaaagtaacatgccagagttggcttcaatagattctagtccttaagaaatgcaaccct

SEQ ID NO: 3679 - DNA, 524 bp, Homo sapiens
  CDS 72..287
agaaaatttaccatccatacatttctacaggaagtattagagggcatgctccattcagtaaaccaagaaagatgaagacatgggatccaggaaacaggagagctgaccgaagagtggtgaaggaaatctctagaacacaggtgaagggagacccaagaaagacagctgtgccccaggcgttaagagcaaccagtccagattggtgcaagttagaagccacagggaacaaacgaaaaatcaagacattaagggaaaaagtaagttgtggaagaaaagtcaagtcaacatgatttcctgtatgtctcagctttgactagcacagccataacaggaacacgaacctgatctcggttacagcataggaacagaaggaagaccaggggagatggatgtctgcttgcctatgtgtggtagagatggtggaggaaccttggagagagatctgccgtgtggagaagttaggagaaaatgcctaacactgaaaaaaatcaagaggcagcaatccaattatattatttaaacta

SEQ ID NO: 3680 - DNA, 941 bp, Homo sapiens
  CDS 387..644
ataaatgctttccaatcartgctcccattcttcattctattcaccacttagttactagaatgtttttctcaactatgaatctgacttcactcccattcttgaaaacctcctgtagttcctgttgtgtacgggataaagactgtgagcccctggagttcagggaccattacttaatcatattccagaacctatcacaatgaatgacacgaagaatatatttgataaaaatctgatgaatgaaccactctaaaatgcaactctaataaagaaaattactgcctattcagttggaactgtaccaygttacaaacgtaaaattatgtatagtctgataaagaaatactrtaatagccttggaaacagctcacatacaattttttttataaatggattcattaccatataactggaccagcttactgaagagtagccctacagcagtcacttcgcagtttgcaattcatttgaggttcaaagctagctcaagggaaaacaacgtgcttaccatggggctgcgcaggtggaaagcagcccagtcttactatgaggatgtccgtttgccatctgggaacaaggaggaagaagcagagactgggcaagactcagagataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaagacagggaggttcctgtggacagaaacatctgcttcctgcttatcctgtatctcagcatctgaatggtcatgactggaacacaggcagacttcagaaataaatacataaatatcccaaaaaaaaaaaaaaatgcgaa

SEQ ID NO: 3681 - DNA, 587 bp, Homo sapiens
  CDS 61..354
gttggctggttatgaaccgttcataacgggcgttaataaccataccctgttagactaagcatggtccacccgcgaatcctctacagagatggccaagcgctggggtcgtggctgcgtcctctaggccagccttgtgcaaaggaccttctcaccacagatcagccagaccatcttcctccttccaagtcatcaaagagttccaagctggtcacctgtcccttgatgttcccaggaaaccaggaaagaggacccctgcattttatcttcccatccagagtggcaggatctctgcctgggaaacaggcttcattcagcacagctgtggtagcattaacaaagcaaagtgggcacatgtagaagttgaagctaaaacattcaagaactccagtctgtttctgtggatgttaagggggtgaagataaaacaatggaggtgatgaggaggaataacttgaagacagtttaaagccacagtgatacaaagaatgaagagaaggaaggtgctggattttactaagaaaacagactgagttcaggagtctcaccagtagaactttatagtattgcgtttcgattacatgtgtgtga

SEQ ID NO: 3682 - DNA, 336 bp, Homo sapiens
  CDS 2..181
gatgatagaggcttgtacaaagaaggccagaactggctggaaaagaaggacgtggtgggaagagcaagagggtttttaccatatggttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaaaaaar

SEQ ID NO: 3683 - DNA, 479 bp, Homo sapiens
  CDS 73..306
tggagggcggcasggcgaccggagcggtaggagcagcaatttatccgtgtgcagccccaaactggaaagaagatgctaattaaagtgaagacgctgaccggaaaggagattgarattgacattgaacctacagacaaggtggagcgaatcaaggagcgtgtggaggagaaagagggaatccccccacaacagcagaggctcatctacagtggcaagcagatgaatgatgagaagacagcagcattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctccccctggatgcccagtaatgtatgtctactggtgggagactgtgaggatccaggattcagtattggccaga

SEQ ID NO: 3684 - DNA, 508 bp, Homo sapiens
  CDS 261..479
attcttgcttctttttctcgctcgctcgctccccctcggaaagctgcgaaagtgctttggcggtttgtccatccgcagcttcggcttttccagtctggtggcccttccggccaccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagctcgacatggattacagagtcttggaaaagtcggtatttcacggcgtatgctccacctgctaacctcccaagtcttaaagcagaaaacaaaggcaatgatcctaatgtaacattgtacctaaagatggcacagggt

SEQ ID NO: 3685 - DNA, 427 bp, Homo sapiens
  CDS 34..183
ttgcattttgcttttatagaggcagtagattcaatgtatatctgcttaagccatcagcaaaaaactaataggcttactacaatttcttcggaaaaacctgcttctggcttcagctcacttcctttgttctacatcccagaagatgcacgtgagggcagctgcctggtaactggaggcttcacttgaccagcactgagcttctgttcactcattcaggtctcacatccatgtcatctccaggactcaccgaaaatagtcagagggatccctctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagaccggcgaga

SEQ ID NO: 3686 - DNA, 392 bp, Homo sapiens
  CDS 44..232
aatacaattctaagaaaaaggtaatccataatgtacatcatagatggttctaagaaagaattttgctaagcactctaacaaaatactgataataaaacataataaaatatttgctcctaatagcactctaacaatattagaatcaaaatcaaatggtctacttagtgcccagctcttgctttctaaaaacagtactccgattagagtaaccacagctcctcaaagaagtggttgattgcaggtctggagaactgaaaatacaagatcagccggaagtatcttgtggtaccagaaagtaagaaagtgctcaaaggatggggacaagctaaaagggcacacaagctaacctgaaagagctaccaatggccaaagctggaaaaaaaaaaaaaaaa

SEQ ID NO: 3687 - DNA, 532 bp, Homo sapiens
  CDS 95..250
tttctaggtcaaacagtatgcacattatgaaggatttaatcccagttgccaaattgtcctccagagaggttttaccaatttctaatactcagtgatggatgggagcctgtttccctctcctttgaatattttcattaaaaaacaaacaaatggccaggcgtggtggctcacacctgtaatcccagcactttggaaggctgaggcaggtgaatcacctgaggtcaggagtttgagaccagcctggccaatgtgacgaaacctcatctctactaaaaatacaaaaattagctgggcatggtgatgggtgcctataatctgagctactccaggaggctgaggcaggagaatcacttgaactcaggaggccgaggttgcagtgagctgggagattgtgccattgcactccagcctgggcaacaagagtgaaactccatctcaaaaaaacaaaaaacaaaacaaaacaaaaaaacatgatggaaatggagtcvtgttttaattcaccttatttattagcaaggttgcacttgttttc

SEQ ID NO: 3688 - DNA, 471 bp, Homo sapiens
  CDS 130..318
cataaagagcttgctgataaaacaagatgcggkwaagaaccagccaaatcccaccaaatccaagatggtgacaaaagtgacctctggtcatcctcactgctcattataggttaattataatgcagtagcatgctaaaaagtcacttccgccagctccatgactttttacaaatgtcatggccatgtttggaagtttacctatatagtctaaaaagggagggatgtaggccgggcgcggtgactcacgcctgtaatcccagcactgtgggaggccaaggcagatggatcacaaggtcaggagatcgagaccatccaggctaacacggtgaaaccccgtctccactaaaaatacaaaaaattagctgggtgtggtggccggcacctgtagttccagctactcacgaggctgaggcaggagaatggcgtgaatccaggaggcggacttgcagtgagcagagatcgcgccactgc

SEQ ID NO: 3689 - DNA, 525 bp, Homo sapiens
  CDS 369..521
agatgaatttctcattcttgtaggctaccatttcttttggcttattacaaaacaacaggatgctgcagctttatcaaagtctacttatttgtccactaaaagtttatggctatacgtttccaactagaacatctgaacaccaatatatggaattctgacaaagttaaaaccaggaagagatcctatgaaggctgacattttgtacatctgttttatagaacaataaaaataagaagaacaagaataagaacagcaacaacatttgcagccactgtctagaccacaggaaacctggtcaacaacatatgggatgtcaccagattcagactcagaagtttccataatgccgttgccaacagctagacacaatgaagaaacggctatatagagagataaagaagcttgctcaaggatacacagccagaaagcaaaagagttggagtttgaacttcgacagtctaactcgaggttctttctctgtgtttaatcagtcaaccacactgcctcttcagaagcacgcataat

SEQ ID NO: 3690 - DNA, 513 bp, Homo sapiens
  CDS 62..493
gtcggcctgcgcctgtcacccccctcctcccggggtttgtagcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagaccttttgttgacaaggacttgtaccata

SEQ ID NO: 3691 - DNA, 564 bp, Homo sapiens
  CDS 301..483
acaaggcatgtagagcaggaaataagcacaatacgggtaaaatgagacaatgtcagaataggacaccttggttgaaagaaaatgtatttgtggaagaaaaaagaaccttctgggagattctgaagtctagtggttgggtgacgaggctgaggcaggagaatggcttgaacctgggaggcagagcttgcagtgagtgtaagaggtaaggagtctgttctgctggggagttctgctatcttccacacatggtttccatcttctaatttaaagctaacctttgaatgagagaaacttctgctgatgtcaaatgaccacaaggatattaacaactggacttggagcctgtcggccgctgttggatacacctcctttaccaaggcggctttcttcactactgccactgaccttgcaaacagctccgacaaaggtcggaatggattcattgatcagctagaccgagcatatgacagtctgtgccttaattgaatcccaaaagggggcagactgggtttttattacagaggccagccgatagcactcattaaaagctccacagacaaaaaa

SEQ ID NO: 3692 - DNA, 452 bp, Homo sapiens
  CDS 70..276
  misc_feature 252: n=a, g, c or t
cgttgggtgaggatgagggagtgaggtgtcagcgtgacctgcacattgctgaagtgcttcgctgggcgaatggtggcatccgttccaggaaacatggggaggggaaagcttggggggctaaagaatgaggatcgttttcatttggggtgtatgttaaatttcaggtggcagagaggcatccagcaggccactcggactggcactcagaagagagacactgagagtcactggcataatgatattatatttgangcccttggagcagatgaacttacctagaaataggatagagaaagagaagaaaagagaactaggcaaaggctaacttgcacatgtatgtgtcaagaagaggagaaattgccaaagttaaaacaggacaggccgggcgcsgtggctcatgccttaatcccagcactttgggaggccaaggtgggcagatcacgtgargtcag

SEQ ID NO: 3693 - DNA, 473 bp, Homo sapiens
  CDS 117..458
cacttcccgacagcctggctcggccactactgggcggggagaccaaggatggaagtgggcttaccggccattaccctctttctcaccagcgccacagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgtgtgtgacttccttggagagaagattgcatctgktttgggtatcagcacccccaaagtaccaatatgccatttgatgaatattatcg

SEQ ID NO: 3694 - DNA, 461 bp, Homo sapiens
  CDS 117..314
acttcccgacagcctggctcggccagcgactgggcggggagaccaaggatggaagtgggcttaccggccattaccctctttctcaccagcgccagagccctgtggtggcgacgacgatggaccaggagccagtgggcggtgtggaacgaggagaagccgtcgcagcctcgggagctgcggccgccgcggcattcggggaatctgcagggcagaatctcactctgttgcccaggctgaagttcatggcgcgatctcggctcgctgcaacctccacctcccgggttcaagcaattctcctgcctcagcctcctgtgtagctgggattataggcacgctccaccgcgcctggctaatttttgtatttttttagtagaggtgggatttcaccatgttagccagggtggtctcacacccttgacctcaagttgtctgsccgcctcagtctcccaaagtgctggggt

SEQ ID NO: 3695 - DNA, 422 bp, Homo sapiens
  CDS 132..284
aaatataatcacttttttatcctaacattagcaggaacaggaacatctctggcaagagtgggaacaatacagagacaggaggaagtgccacactcttaaaaaaccagatctcccaagaactcacagcaagaatgtattcattaccatggggatggtgcgaggccctccatgaggcccccatgatccaatcacctcccaccaggccccacctccaacactggggattacatttcaacatgagatttgggcaggacaaaaatcccaactatttcaaggattctagttaatattgtattgtctactgggaatttgctaagaaagattttaaatgcactaaccaccacccccccgacacacggtaactatatgatacagtggatgtataatttacttggctgtagtaatcactttaccatgtaagk

SEQ ID NO: 3696 - DNA, 365 bp, Homo sapiens
  CDS 63..260
  misc_feature 11..12: n=a, g, c or t
acttggctagnngcggcgcgaggcgggcgctgcggcgcagcagccctgtggtggcgacgacgatggaccaggagccagtgggcggtgtggaacgaggagaagccgtcgcagcctcgggagctgcggccgccgcggcattcggggaatctgcagggcagaatctcactctgttgcccaggctgaagttcatggcgcgatctcggctcgctgcaacctccacctcccgggttcaagcaattctcctgcctcagcctcctgtgtagctgggattataggcacgctccaccgcgcctggctaatttttgtatttttttagtagargtgggatttcaccatgttagccagggtggtctcacacccttgac

SEQ ID NO: 3697 - DNA, 469 bp, Homo sapiens
  CDS 110..328
agatttttgagccactgatctccaggacaagcatggttgagaatcagtgatgtgatctggtggctttgtctcccaagctgcttattttttagtagtgtggtcgttttccatgtttttcctggctgagaccacccatccgtggccasccccttaccccacccctggcccagacgtggccacaatttttgaaaaagtccttgatgttcctgtcctttggaacacttccctcatttgcaattttctatccatgtgtgtgattatttgcttgtttggctcccttattagaccaagctttttggatctgcctattcttatccacttttatttctagcatctcctcagtgcctgagatacagcagatgttgaatgaatgaataaatgaaaagtgcaaggaaggcagtgttacaagataaaaaaaaaagactactgtacccagaagttagcagacactaaacttttggcaagtcaa

SEQ ID NO: 3698 - DNA, 485 bp, Homo sapiens
  CDS 106..366
cacatttagaatagaatataaaaaccttggacacaaaatcaaagttcataccagatcaagaggggacaaaaatggactagaaggaaggttacataaagtggtactatgtcttctgcaatttgtttgttttcttgtaatatttgccctgagctcaccagcgaaataatagatagactccatagaagtcaactcttaaaaatgacttttctgtcattctttacctccatcctatcaagcacacatgaccttggttccattgtgcaggacttaggaacacactttgaatgtaagcagtttcttctagcattgctggaagtaaaaggatgcctcatcttacggaatagagttgtttctggaggtcttgcttaagcgtacatttggaagtgattttttttttcctttacgttttctgttgtagaataaaaaatttctttccacaaaggaattattacacccaaaatatgtttaaaaacaatttaaaagtt

SEQ ID NO: 3699 - DNA, 858 bp, Homo sapiens
  CDS 242..640
aattgagatatcatgccttgctcttgtcagatggctctgtggacagtctagggagagactcgcaggcctgcctgagccagcctgtctttagaaacactcggcttactgakgaakggaaataaggaggtgtgtccacctatttccttttctgctacatttccgacaagtcacttctgaggtgaagacctctttgagggtggccagaaacagctcagcgtctcgttctccctttccaagctggatgggtatacggatccgggtctcagacaagggcgttccagtacgtcagcgatctagtgaatggcctcgtggctctcatgaacagcaacgtcagcagcccggtcaacctggggaaccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcaaaaaaaaaaaaaaatgcgaa

SEQ ID NO: 3700 - DNA, 526 bp, Homo sapiens
  CDS 60..212
caaaagcaataccagaagtaaagggaaatatcagacaatattttattattttttcatagatgttctgccacacaaagaacttggggtgtaaggataaggcaaaagctccaatcccatttttcagttctcctaggatgcacccctcagggagcctggccagagttccgaggcccgtgagcgtcagtgttgctttattttccatcaaagccctctgagaagtgagacctcagcaattccgggagccacatagagacagacttggcaagggaccccctggttctgagccagtagctgccatctggaaattcctcttttagcctctccttagaggtgaatgtgaatgaagcctcccaggcacccgctgaatttctgaggccttgcttaaagctcagaagtggtttaggcatttggaaaatctggttcacatcataaagaacttgatttgaaatgttttctatagaaacaagtgctaagtgtaccgtattatacttgatgttggtcatttctcagtctatttctcagttct

SEQ ID NO: 3701 - DNA, 572 bp, Homo sapiens
  CDS 95..391
gtgagatggggcccaaataggaaaaagtctaggggtgaaggagtggggcaaagtgtaatttggggaacaagcaggcacatccatagaagagacaatgagaccacaggaaaaacaggtaaccatcactgaaaccctgtgggaccaggtgctgacagtttttaaggatatacaaaaggagctgcaggaagatgctcggattcgagggatgagcaactgctccatgacacccatgacatcagcacccaggactggaagcataaggccttcagattccttgatgaccccaaagttgagaagattgcagttcagctctggagagcagccatcaggaggccgtatccacaacctgaagacacagctgttcagtcaatcagcttactaccctggaccctaactctacaatcaaggaagaaggacatctctgcttccgccagcacagcttcagttggggaagatattagcagacatcatcactgaacccagaagagagggtggtgcccatgagtggagatgccagggtctatggctgaaactgggaacttggaaatcaagtgagacccaagcaaggaaac

SEQ ID NO: 3702 - DNA, 543 bp, Homo sapiens
  CDS 131..307
gagatggggctcaaataggaaaaagtctaggggtgaaggagtggggcaaagtgtaatttggggaacaagcaggggcctggagctatctccatcttcagctccagagcccttggtttctgtctgagaacaaatggcacagcatccctgccaggatcaggaacaaaaggtagaaatgacctccaagcagcagagaagcacatccatagaagagacaatgagaccacaggaaaaacaggtaaccatcactgaaaccctgtgggaccaggtgctgacagtttttaaggatatacaaaaggaggctagagtgtagtagcacgatcttggctcaccacaacctccgcctcccgagttccagtgattctcctgcctcagtctcctgggtaactgggattacagctgcaggaagatgctcggattcgagggatgagcaactgctccatgacacccatgacatcagcacccaggactggaagcataaggccttcagattccttgatgaccccaaagttgagaagattgcagttcagctctggagasagcatc

SEQ ID NO: 3703 - DNA, 503 bp, Homo sapiens
  CDS 92..331
taatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtagaggccatgacaagcgctttgtaatggaggtagaagtagatggacagaaattcagaggcgcaggtccaaataagaaagtggcaaaggcgagtgcagctttagctgcttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacastgctcctggctacatagctccaggctatggaacaccatatggttacagcacagctgcccctgcctatggtttaccaagagaatgg

SEQ ID NO: 3704 - DNA, 485 bp, Homo sapiens
  CDS 92..433
taatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtagaggccatgacaagcgctttgtaatggaggtagaagtagatggacagaaattcagaggcgcaggtccaaataagaaagtggcaaaggcgagtgcagctttascksttttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacastgctcctggctacatagctccaggctatggaacaccatatggttacagcacagctgccccctgcct

SEQ ID NO: 3705 - DNA, 475 bp, Homo sapiens
  CDS 31..204
acattctctcatcatctcctcactgctcagatgcctttcctgcctccaagagcgctgggaacaacagacgcgcagacctgcggacagacaggagacagggtaaacaccgatgactcccagatctacagctccaggctgttcccttctccgtgtctcatatcagctttgccaactgtttattggacatcaccgcctgagtatccctgagggacacgattatcctgtttggagtgtattgaacttcttggatacatcgattagtgtctttcctcaagtttgagtaatttgcagtcatttttcctttgaaaattctttcttctctattctgtttctctccttgttgaacccccatcatgcataggtgtgctctgttcatttttcacattacttttatttttctgctcctcggactgaataatctcaattgacctattttaagttcactgattcttttgcctgcccaaaccctactgtt

SEQ ID NO: 3706 - DNA, 499 bp, Homo sapiens
  CDS 142..492
agccagcggaccagcggcaggagccgttccccgacggcagcagggcgctcggcctccgcgtgtgggctgagcgcggcgacgctgctgccccgaaatccccgtggattttgagtcgtatggaacctcaaagtctttgtgacaatggaaaccaaaaaattaattggtaaaccgcttcaaccagcaagacctgttcgtcatctgacttctcccccaggagcagtgttccctttcaactttcaaaacgaatatccatgcaacactcagtgcatacaaagtggagttagcagatgtaagacgaatggaatgcaagccttttctcaaggtcttaatgagcaacagcaacagcagtctccagttaagaaagagagaattaaatacagcagagatttcctgttgaagctctcaagtgtttccatctgcagaaaaaaaccagactttctgcctgatcatcccattgtactgcaaaaaccagaaaacaaccaaagttttaagtagcatt

SEQ ID NO: 3707 - DNA, 400 bp, Homo sapiens
  CDS 34..207
cttgctctttcgcmcaggctggagtgcagtggcatgatctcagctcactgcagcgtctgccttccgggttcgrgagattctcctgcctcagcctccagagtagctgggtctacaggcgtgtgccaccacgcctggctgattgtttgtatttttagtagagacagggtttcgccgtgttggcaggatggtctcgatctcctgacctcatgatccgcccgcctctgcctcccagggtgctgggattgcaggcgtgacaaccgcgcccggccataaactatttattaacagataaggcctacagacttatttcttcttggatacacccacggtacaggtacggccatggcggctcacgctgtattcccagcactttgggaggmcgagatgggcagatcacgag

SEQ ID NO: 3708 - DNA, 633 bp, Homo sapiens
  CDS 76..396
aaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagcgaagatactatcagtattctccctgatgacccccgacaaatgactctcttattctaaggatccttctacagatctgttataactatattgtgttgtttacaatacagcaagcctgatggtttgtcttatttcattcatactgaaaattctttgcatatttttttctgcttagacttacttattctttgaggaaaaaaggtaatgtaggagctcattgttctctagagctgagctcttctgctaaagttcaaagttcacatcagtgtagccagagtga

SEQ ID NO: 3709 - DNA, 504 bp, Homo sapiens
  CDS 76..396
aaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagcgaagatactatcagtattctccctgatgacccccgacaaatgactctcttattctaaggatccttctacagatctgttataactatattgtgttggtttacaatacagcaagcctgatggtttgtcytatttcaaaaaaaaaaaaaaa

SEQ ID NO: 3710 - DNA, 560 bp, Homo sapiens
  CDS 99..326
aaacattccgcgctaccgagtactttctactcccgaccaggcattgctctctctggagaccctcggcggtggttgctgtattttgacttggagtaaggatgacttttcgggccacagatagtgaatttgacctgacaaatattgaagagtatgccgaaaattctgcactttcaagactgaataatataaaagccaaacaaagagtgagttatgtgacatccacagaaaatgaatctgatacacaaatcctaacgtttaggcacattacaaaagctcaggagaagacaagaaaacgacagcagcctataaaactagagcctttgtgctaaaagtctaccaagatcataagcagccagaatacatacatgaacagaaccgatttcagttaatgactgcaggaatcattaaacgtccagtaagcatagcaaaaaaaagttttgccacatcatctactcagtttcttgagcatcaagatgctgtgaaaaaaaatgcagattcatcggccctatgttgagatgttctctccctctcctcctaaactgccacatactggtattgga

SEQ ID NO: 3711 - DNA, 461 bp, Homo sapiens
  CDS 161..313
  misc_feature 327: n=a, g, c or t
ctctgtggtccttttccacccttgatggcaactctttcccccctttcaaagggtcaggtgccctaaaactcagtgaactgatggcccttggcagaaactgtttactgaaaaacaatttgagaatgcagcagaaagaataggagagaagcctgacggaaaaatgggaaagaacaccaccaaatcttcaggcagactccaggccattctcagaaccaggatgctccctgtacctccagaactggatgaaaaaagacgaacggagcctcatcctgtaccatgtagggagtttccctctgcccttctccagccaaaatgactccgcagaanagcatatctgaatggtctcttgtactcatccaatgcctggcacagrgctgggattcagtttctcaataacacctctctgggaaagcctcacttaacataaaaaggacctcaaaactgagggcagcccttgagct

SEQ ID NO: 3712 - DNA, 479 bp, Homo sapiens
  CDS 141..317
atcctttggagccaaagactcgaacagacatgcgagacctctaccaactgaaggtttcgtgagcgcactcctttgccaagatcttggtgaatagtctttcactgtgcaattttatcttagaaattgttttacgtttgatcatgattgtgcttggctggatgttttttgttggacttgtgtgttacatgggcacgtttccagagttgatgcctccaactctgaagtggcaggagaggtggcctgttcaggagagcaaaacacaactgaggaggcgggctttaggtgaagatctgctgcagaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaaaaaaaaaaaaaaaaaaaaaaaaaaaaaaa

SEQ ID NO: 3713 - DNA, 499 bp, Homo sapiens
  CDS 176..352
aactagatttcagcttctccactagggagttgtggatcctttggagccaaagactcgaacagacatgcgagacctctaccaactgaaggtttcgtgagcgcactcctttgccaagatcttggtgaatagtctttcactgtgcaattttatcttagaaattgttttacgtttgatcatgattgtgcttggctggatgttttttgttggacttgtgtgttacatgggcacgtttccagagttgatgcctccaactctgaagtggcaggagaggtggcctgttcaggagagcaaaacacaactgaggaggcgggctttaggtgaagatctgctgcagaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaaaaaaaaaaaaaatg

SEQ ID NO: 3714 - DNA, 480 bp, Homo sapiens
  CDS 139..366
  misc_feature 473: n=a, g, c or t
atcctttggagccaagactcgaacagacatgcgagacctctaccaactgaaggtttcgtgagccactcctttgccaagatcttggtgaatagtctttcactgtgcaattttatcttagaaattgttttacgtttgatcatgattgtgcttggctggatgttttttgttggacttgtgtgttacatgggcacgtttccagagttgatgcctccaactctgaagtggcaggagaggtggcctgttcaggagagcaaaacacaactgaggaggcgggctttaggaaccatgtggaagggatataaatatcccccaggagggactccagtggaagtaagcaaggatgatcctggtgaagtaatgcagctgtgaastcacctgaccagctgtacagttcctgttgttggtttcacataaagtaattgcacattaaaaaaaaaaaaaaaaaaaaaaaaaaaaaaaawttwttksccccnyttttta

SEQ ID NO: 3715 - DNA, 507 bp, Homo sapiens
  CDS 148..435
aggcgcaattactctcttccatattggttaacagtagaaggctcagtttctctgctcatcacacggccttcggcactgtagctttgggtggtgggctgcagattaattttgtaaccaccttaagaaaaatacgaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcattttattgtcttt

SEQ ID NO: 3716 - DNA, 771 bp, Homo sapiens
  CDS 386..703
  misc_feature 10: n=a, g, c or t
aaggctgtsngtgactttgggggtctgcagcaaggggcgatggctgcgaagtctacgggggtctccaaccttgtagagtcgccaggaatagggcgaatccacttcattagtgaccagctcgggcggttcacgtgcatcacacaaataacttggcctttttctgcctcagttrggggrtttcttaaacgtagaatacccgcgtttccgctgccgtaatttcctctsaggcgcaattactctcttccatattggttaacagtagaaggctcagtttctctgctcatcacacggccttcggcactgtagctttgggtggtgggctgcagattaattttgtaaccaccttaagaaaaatacggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaarggagaaaccaaagaaaggagaagggaaaagagcagcaaaaaggaaatagtgttggtccctcaagagggagactttcttcctcagtggcggagagaagaaagtgcatttattgtc

SEQ ID NO: 3717 - DNA, 599 bp, Homo sapiens
  CDS 113..430
gtaatagttgcctgcgcgasttggagccgggtagagggcgggccttccgggacgagggcgcgtgggtgaggaaggtcaggtctaggaactctaactccttgccactcaagaaatgtcctccctttcagaatatgccttccgcatgtctcgtctcagtgcccggctatttggtgaagtcamcaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacatattggaggaatgtcatcttcctaaatgaagtttatttggaggaacacagtcatctccttggtgaaatctaatccggttacattgtggctggt

SEQ ID NO: 3718 - DNA, 475 bp, Homo sapiens
  CDS 86..403
cgggtagagggcgggccttccgggacgagggcgcgtgggtgaggaaggtcaggtctaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttc

SEQ ID NO: 3719 - DNA, 511 bp, Homo sapiens
  CDS 48..503
gaaaaggattactcgmgcctygttagaatcagacatggcttcaggggatgcaggacgctcccctgagctgcctgtcaccgactaagtggagcagtgtttcttccgcagactcaactgagaagtcagcctctgsggcaggcaccaggaatctgccttttcagttctgtctccggcaggctttgaggatgaaggctgcgggcattctgaccctcattggctgcctggtcacaggccgagtccaaaatctacactcgttgcaaactggcaaaaatattctcgagggctggcctggacaattactggggcttcagcttggaaactggatctgcatggcrtattatgagagcggctacaacaccacagcccagacggtcctggatgacggcagcatcgactayggcatcttccagatcaacagcttcgcgtggtgcagacgcggaaagctgaaggagaacaaccactgccacgtcgcctgctcaggacctgcagacacttcgacaagataactaca

SEQ ID NO: 3720 - DNA, 816 bp, Homo sapiens
  CDS 331..627
gaaaaggattactcgmgcctygttagaatcagacatggcttcaggggatgcaggacgctcccctgagctgcctgtcaccgactaagtggagcagtgtttcttccgcagactcaactgagaagtcagcctctgsggcaggcaccaggaatctgccttttcagttctgtctccggcaggctttgaggatgaaggctgcgggcattctgaccctcattggctgcctggtcacagggccgagtccaaaatctacactcgttgcaaactggcaaaaatattctcgagggctggcctggacaattactggggcttcagcttggaaactggatctgcatggcrtattatgagagcggctacaacaccacagcccagacggtcctggatgacggcagcatcgactayggcatcttccagatcaacagcttcgcgtggtgcagacgcggaaagctgaaggagaacaaccactgccaygtcgcctgctcagccttgrtcactgatgacctcacagatgcrattatctgtgccargaaaattgttaaagagacacaaggaatgaactattggcaaggctggaagaaacactgtgaggggagagacctgtccgactggaaaaaagactgtgaggtttcctaaactggaactggacccaggatgctttgcagcaacgccctagggtttgcagtgaatgtccaaatgcctgtgtcatcttgtcccgtttcctcccaatattccttctcaaacttggagagggaaaattaagctatactttaagaaaataaatatttccatttaaatgwcaaaaaaaaaaaaaaatgcgaa

SEQ ID NO: 3721 - DNA, 469 bp, Homo sapiens
  CDS 194..400
ttttttttcctctggctaatcacccagcatgttcaggaggaagccgctggacctggggcaaggcagccttagaccttgctgatgccaggccttattagcacaaccctcacatacaccaaatccactaagctaccccgttgctgaaatcgacatgcacctccaccaagcctggctcagtgaaggtctctaatacatgcctaacaggcctccagcagtctctaagccaaggggcttcacccactcacccgcacttctcatcttgaatctggaaaccacattcttctaccctgggtggcacagcttcccctggccctggttgaacctgatgccatttaaatatcctgccaagcttgctgccttgagaaaaccttggacactgatttacctcctatctaatgactagaagaggaagctggatttccagatgcccacagctggcgtcaagsaccaggctggctccagtgatctc

SEQ ID NO: 3722 - DNA, 496 bp, Homo sapiens
  CDS 122..451
attctttgtgggctcttagtccatagctgcctttgaggtggtgtagaccttgctaaccaggacggcccagtaggcagagctcatttttattcctgtctgcaatcgtgcaaaaacgcctcttatggaaaagccagagcgccaggagtcagcaaaacacactaaagattgggcagtcactggggagaacactcagcccgcctgcacccaggtgaaatatacagccttgttgctcacacaaagcctgtttggtggtttcttcacacggatgcatgtgacatttggtgctgaagacccaggacaggaggactcctttgggagaccagtgccctgttgtcgccctcactccgtgagagatccacctatgatctcaggtcctcagaccaaccagcccaaggaacatcttgccaatttcaaatcggaagataggagtgtcaggcctctgagtccaagctaagccatcaaatcycctgtgacctgcacgtgtacatccagatga

SEQ ID NO: 3723 - DNA, 477 bp, Homo sapiens
  CDS 90..305
ttgggcagaaaaattcaagcaggagattgtatttcttttggagttgtacgatttcctttattatttgaactgcagtaaagaaagctgggatgggctcctctagggatacttccagatccctgggcggttgtagccctggctcctctttaaatggatttggtttcaaagacgatcatctccgtcttctcggatgtcatagtgccactgatcatctccagctcctggccaccctgggctttctccactttggcctctatgttttgcttctccaccgtcttagccacgatatctacctctctgtcatgtgatgtgacccttgtttttgaaccaggagtggccctgaggctccttaaaaaagagctgatcttactggctttcttttgtaaagctcctgtgctagatgcagattggttcttccccagttcctgagttgttctcgactcctttttggtggagctgtgggtggagctcttgcga

SEQ ID NO: 3724 - DNA, 469 bp, Homo sapiens
  CDS 187..429
aacatccaactagaaatgggttggccatctattaggcgtaccatagactattcctgctctagccaagaatttgggccagatgactactaagatcctttgcagtatccagattctaagattctgttttcctgggaaggtgtaaactgctttatcttcaggttagctcttaactcatgagctgggacaatgctctttcccctaagaaaggcgactttccaccaagaacaccattgtgtagaggcacctactgtgcaggcactgttggaggcactggggatgaatccagaaggtccctgcactcacataacttactgctcaggaatcgccactggactcagcctgcacagcacagcaagaccctggctcttaagaaaaaaaaagaatgatggggatgcatccaggacaaacagcagttttggagggggtcactgattgtaccaagggtccccaaggccacctgcatacaatc

SEQ ID NO: 3725 - DNA, 425 bp, Homo sapiens
  CDS 95..310
  misc_feature 366,369..372: n=a, g, c or t
actcggtttggacactgcagataacctatatcctgttctttccttcaccgtgggagacgagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcckccctgcctcggcctcccaacgtgctgggaytataggcgtgacascgctcctggccagggtctgytcctagttgcaacaghdywwrvhnvknnnncgagagggccacgcctccattcaccaggccacgcatcacaagaggcaacacca

SEQ ID NO: 3726 - DNA, 523 bp, Homo sapiens
  CDS 31..483
  misc_feature 351: n=a, g, c or t
cacgacatattctgattttgaacatgtgaaatgcaaccttgctatagcaaaaacggattccttcccaacgcatctcccaggagactcctggccgggctaacactgggccgcggagaagggctgcggtcagaggggcaggcaaaccacagcaggggcttcttgccagggggatcttgtgctcatggcatggagaaggggatcgggttcttttttcccatttttaactttcagaaccatcctctgtacccagtggaatgcactcatttgcactctgatgtcagccgcagtcgtgcctatagagactgtcacaactttgattacccaactgtaagcactcagcccgctgcctcnstctgctattcacactcatggcccagccacagcctcagctccgtgcccctggggccagggggctgctcggagtcaaagccccaggggaagagagaggctgggacgaccgaggctccaagacagcctcctttttgacactgcctagtttttcgcttcagcaaagttggaaatc

SEQ ID NO: 3727 - DNA, 579 bp, Homo sapiens
  CDS 360..557
agaaatctggccaccaggcaaggaatgcccgcagcccgggattcctcctaagctgcatcccatctgtgcaggaccccactggaaatcggactgtccaactcacctggcagccacgccactcccagagcccctggaactctggcccaaggctctcagactccttcccagatcttcttggcttagcggctgaagattgacgctgctcaagcgcctcggaagccccctagaccatcacggatgccgagcttcaggtaactctcacagtggaagaccatggaaatgatgttagacgaatggcagattcaagcaattttcttatttgagtccatgacaatgcctgactgcatgttgcacaacctatgcttgaaaagttgaatgaattggtctacaaagttttgcctcatctgccatattcacctgacttctcaccaaccaccacttcttcaagcatctcgacaactttttgcagggaaaacgcttctacaaccagcaggatgcagaaaatgctttccaagagtttgtcgaatcctgaagcaaggatttttgtgctacaggaataaaaaaacttacttatcgttg

SEQ ID NO: 3728 - DNA, 455 bp, Homo sapiens
  CDS 141..353
actttttaacacttctgtcaagcatagtaaaatttcaacttaaaatatcacaagtctaaatcaatcaatgattcatttgtgcattttactttatttttgagacggagyytgctctgtcgcccagactggagtgcagtggcatgatctcgtctcattgcaacctccacctcccagattcaagcgattctcctttgtcagcctcccaagtagctgggattacaggcatccactaccacgcctkgctaatttttgtatttttagtagagacaggatttcaccatgttggccaggctggtctccaactcctgacttcaggcgatacgccacctcggcctcccaaagtgctgggattataggcgtgasactgtgcccggcctcatttgtgtatttaaattaaaaccttaagactgactttttattcacacagactaggggtgtgcaatctttttggcttc

SEQ ID NO: 3729 - DNA, 450 bp, Homo sapiens
  CDS 88..318
tgtgagggctatgcgatgggacagtgctggggtaagcctgggagtgtgtggccacggtaggagtgtgtgactggtgggacacagtctatgaaactgccggtgtatgcttggggagtgactgtgattgtggggaaccgagagtgcctgggcgtgggtgttagcggcaggagggggtgtgacaaggtgtgtggtgacagtgctgggagggaaggtgagagcccagtgtgggggtgtgtgtgtgagtgtgtgggagaccatgaggatgtgggtgtgcacatggagagggctagagggcaagtcttggggtttgtagtgttgtgaccaagacctcgggctctgtacccaagaattatttgggctccaatacttgcttgtgcctgttaagagcaagagacccaagctaggcctctcaaggctgagtgtccttatctgcagaatggagagagtgag

SEQ ID NO: 3730 - DNA, 394 bp, Homo sapiens
  CDS 6..185
  misc_feature 79: n=a, g, c or t
gcgagatgacaggattttcccgcgaaggagaagcgcgcttttttccctggcgggggatttggctagaaggctgggccgncagcggttgtgaggagttagctcgcggcattgcaggctctgagaggaggggaccccgttcccgggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaaaaa

SEQ ID NO: 3731 - DNA, 494 bp, Homo sapiens
  CDS 56..388
attctttccgccatcttgattctttgtcactgaccgagactcagccgtgggaaatatgagtgagcatgtgagaacaagatcccaatcctcagaaagaggaaatgaccaagagtcttcccagccagttggatctgtgattgtccaggagcccactgaggaaaaacgtcaagaagaggaaccaccaactgataatcagggtattgcacctagtggggagatcgaaaatgaaggagcacctgccgttcaagggcctgacatggaagcttttcaacaggaactggctctgcttaagatagaggatgagcctggagatggtcctgatgtcagggaggggattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaag

SEQ ID NO: 3732 - DNA, 524 bp, Homo sapiens
  CDS 111..440
gtctaggcagagctctgcaaggagaggttgtgtcttcgttctttccgccatcttcgttctttccrmcatcttsrttctttstcactgaccgagactcagccgtgrgaratatgagtgagcatgtaacaagatcccaatcctcagaaagaggaaatgaccaagagtcttcccagccagttggayctgtgattgtccagsagcccactgaggaaaaacgtcaagaagaggaaccaccaactgataatcagggtattgcacctagtggggagatcraaaatgaaggagcacctgcygttcaagggmctgayrtggaagcttttcaacaggaactggctctgcttaagatagaggatgmrcctggagatggtcctgatgtcagggaggggaytmtgcccacttttgatcycactaaagtgctggaagcaggtgaagggcaactataggtttaaaccaagacaaatgaagactgaaaccaagaatattgttcttatgctggaaatttgactgctaacattctcttaata

SEQ ID NO: 3733 - DNA, 479 bp, Homo sapiens
  CDS 128..394
actttgagaggccaaggtgggcggatcatgaggtcaggatatcgagaccatcctggctaacaagttttcagctagtaacagaaaagatgcacaaatcaatgaactatatcaaagactgtatcaggagatgaccttttatgcagaagcatcactgccagctcagaatgacttacggacttcatttccttcactgagaatctccacccggcgcacaagctgctcaaacagattccgcacattcagcatcatagtatccatctttctgccaagaaatcaaatatacattaggggtcctgccttctcgcccacaacaaaagattctatagcaatccagccattagtgaccaacatctggactcttccatttataactaccattataagaatctcaagctaacaacagatgttttgtgtgattcttattataaaacaaacttggaatgtttaagactcatctgaaaattagaaaccatttcaga

SEQ ID NO: 3734 - DNA, 451 bp, Homo sapiens
  CDS 105..332
tttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaataga

SEQ ID NO: 3735 - DNA, 377 bp, Homo sapiens
  CDS 94..366
tttaagtgttcgtaccagaagaaatgataagtatgtaaggtaatgtatatgttaaatagcttgatttagccattctacaggtatcaaagcatcatgttttatattataaatatatataatcagttaaaaaaaagtactgagactctgagaaaggcattagttaatttgcccatagttttatatttagtgaatccagtggtcttacttcagatgtgtattcttagccaaaagatgcacttgctttcacctccacttctgtccctaaaaactgaaaagcaaaataaagaggtggaaagaggctgggtgcggtggctcatgcctgcaatcccagcactttgggagattgtaaaggttgtgtgtattggctaaaatgaagc

SEQ ID NO: 3736 - DNA, 496 bp, Homo sapiens
  CDS 141..353
actttttaacacttctgtcaagcatagtaaaatttcaacttaaaatatcacaagtctaaatcaatcaatgattcatttgtgcattttactttatttttgagacggagyttgctctgtcgcccagactggagtgcagtggcatgatctcgtctcattgcaacctccacctcccagattcaagcgattctcctttgtcagcctcccaagtagctgggattacaggcatccactaccacgcctggctaatttttgtatttttagtagagacaggatttcaccatgttggccaggctggtctccaactcctgacttcaggcgatacgccacctcggcctcccaaagtgctgggattataggcgtgasactgtgcccggcctcatttgtgtatttaaattaaaaccttaagactgactttttattcacacagactaggggtgtgcaatcttttggcttccctgggccacgctggaaggagaagaattgtcttgggccacac

SEQ ID NO: 3737 - DNA, 500 bp, Homo sapiens
  CDS 333..497
  misc_feature 176..177: n=a, g, c or t
atgaaaataaggctattttgcatttaaaactgaaatacctcttaaaacaatttgatccccagtgtttgctctttttgaagtaaccgacttactcttaaaaaggatggctgccaagatggaaagtcttattgggttttcatgttaacctattctttggacataactatgaatttwvnntacaatgcatttcatgaaaagttatggctcccccagatttcccacaagtgtgatcttgaagtcctaaacatttgtccatgtaagcttcaaaacagagccttaactgagttattcaagtagcagtacttaaagatataatttttgaagcagtttcaatggtttgtgatccaaataatcagtttctgaacattactacttcacgtaatagagtccatcttcagtttcttctcactttctctttcccttttgggtttcctttttctggcctgaggctaccagtttctttgggtactatcaagatacttccatcatgggtacactga

SEQ ID NO: 3738 - DNA, 564 bp, Homo sapiens
  CDS 9..173
aatgtttaatgcccgcacctcgtccccggccaccccgtgaggcagccagacactctccaaaaagcagagacagcaggaagaggggagtggaggcagcccattcacctggggaaatgactgggttgtcgatggacggtggcggcacccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggttgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgcaackcctgcctcgtgccacctcatgcttataataaagccggcgtcagagaccgctgcttccckcaaaaaaaaaaaaaaaa

SEQ ID NO: 3739 - DNA, 433 bp, Homo sapiens
  CDS 67..354
agacactctccaaaaagcagagacagcaggaagaggggagtggaggcagcccattcacctggggaaatgactgggttgtcgatggacggtggcggcascccaagggggacgtggacccgttctactatggtaagcctgggcccctgcgcacccttcctgagccctcaggaccccttccaccaagcagcggcctctcccagccccaggtccatgctctgtgccccttatctcccctggttaccacgggctgctgcgggcaggctgcggagagagacagctgctgggagagaccacccatcccgctcctcttgccctctctttcsggagactatgagaccgttcgcaatgggggcctgatcttcgctggactggccttcatcgtggggctcctcatcctcctcagcagaagattccgctgtgggggcaataagaa

SEQ ID NO: 3740 - DNA, 476 bp, Homo sapiens
  CDS 225..389
agttggtggatgaattgcgtttgtgcatgtgtgaaagtggggtgtgaatccgccagtataggcctgagtgctaacaccagttaggaggcatacctcagtgccctgaagacctaggtccagcttcctaacctgctggccataagaccctcgtagcggcacacattggccatctctcccaaacaactgcatacccgttactcttccaaagtcccctcttctgccatatgttacatattaaaccgatagaatatcttttttcccactccaaacgacaaggcatgcatgccgttttaatgtatcgaaaactcctcaccccattgtcacctttgaatttctcccacatttgcccaaaaacgtttataaggcacacacaaccttctcttctccgttaaaatgagaaaatatgtcacaaacccagagcattgtgtatttattctgctgctgctatagaatgattccttatgttatgagcgaat

SEQ ID NO: 3741 - DNA, 387 bp, Homo sapiens
  CDS 191..376
ataaatagaatcatacgttgggcaagacctgaagctcacagcatgcacatgaggaaagcagcgtcgtacccatagctgggcttcgcatgattccagtcgagcagccagcagggctaccagctcactgtcactaaggaagaagaggcgggggaagtgagcacacaccccatagagcacgctctccagactcatgatgatgccctccagctccaccgatcctgcttgcagcagttgttgcagctgctggccttggaagaaactggatcttcatctcatgcagaactttattcagaaaaatccacttctgctggaaagtcagccacacctccagcagggcacctgtgtaagcagccagaggaatgctggtgggaaacactagggttctac

SEQ ID NO: 3742 - DNA, 603 bp, Homo sapiens
  CDS 345..530
actaaggaccgagcaccaaataaccaaggaaaaggaagtgagttaaggacgtactcgtcttggtgagagcgtgastgctgagatttgggagtctgcgctaggcccgcttggagttctgagccgatgggaagagttcactcatgtttgcacccgcggtgattgcgtgcttttcgcaagaacaagactctcggctatggagtccccatgttgttgctgattgttaggaggttcttttggtcttcgtgagttttctcaaatccgataatgatgctgtgaacgagtaaaatggatcctgagcttgaaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaaataaaaatactattaactgggacttcctaatatatacttctatcaagtggaaaggaaattccaggcccatggaaacttggatataagtaatttgatgaca

SEQ ID NO: 3743 - DNA, 613 bp, Homo sapiens
  CDS 13..579
  misc_feature 601: n=a, g, c or t
ttaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggaagcttaatcgaaccctgaagaagatnggacagagacct

SEQ ID NO: 3744 - DNA, 491 bp, Homo sapiens
  CDS 263..484
actctttctcgactccatcttcgcggtastgggaccgccgttcagtcgccaatatgcagctctttgtccgcgcccaggagctacacaccttcgaggtgaccggccaggaaacggtcgcccagatcaaggctcatgtagcctcactggagggcattgcccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtgagtgagagtattagtggtcatggtgttagcactttttttcctttcacagctaaaccaagtccctgggctcttactcggtttgccttctccctccctggagatgagcctgagggaagggatgctaggtgtggaagacaggaaccagggcctgattaacctt

SEQ ID NO: 3745 - DNA, 427 bp, Homo sapiens
  CDS 51..233
ttttctcgactccatcttcgcggtastgggaccgccgttcagtcgccaatatgcagctctttgtccgcgcccaggagctacacaccttcgaggtgaccggccaggaaacggtcgcccagatcaaggctcatgtagcctcactggagggcattgcccggaagatcaagtcgtgctcctggcaggcacgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccgggcgctttgtcaacgttgtgcccacctttggcaagaa

SEQ ID NO: 3746 - DNA, 418 bp, Homo sapiens
  CDS 84..371
cttttctcggaaacgcggcgcggccggctgccggaaaacagggcagacctgtatgattggtttattcctggggttgtcatatyatggctgataatgacacagacagaaaccagactgagaagctcctaaaaagagtacgagaactggagcaagaggtgcaaagacttaaaaaggaacaggccaaaaataaggaggactcaaacattagagaaaattcatcaggagctggaaaaactaagcgtgcatttgatttcagtgctcatggccgaagacacgtagccctaagaatagcctatatgggctggggataccagggctttgctagtcaggaaaacacaaataataccattgaagagaactgtttgaagctctaaccaagactcgactagtagaaagcagacagacatccaactatcac

SEQ ID NO: 3747 - DNA, 487 bp, Homo sapiens
  CDS 54..350
agagcagccaacatggcggcggaacgggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaaggtaccaggcccagctcccttggggacatctgctggttgggggatgtgggctgtgctgcacgtggtctggccctgggtgtgggtgctgtgtcggtctggagaaggactgccgtgctccttaggggtcctcagtggcccagggcaggtggatatgctctttgaggtgctccttcagcaggctgactcattgatggcgtttgcaaaaaggatgtggttttttccaattccactgaaggcaaatcctagcacaaatatgggtactagtatgccgtctgagacagaaccatgacattgtt

SEQ ID NO: 3748 - DNA, 534 bp, Homo sapiens
  CDS 110..397
atatttgctgcgacccgcrgcgctatccgctgccgggttctggcgcgccctttcagttctgcttgctgtccgcaccgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaa

SEQ ID NO: 3749 - DNA, 506 bp, Homo sapiens
  CDS 96..341
aaggacgtactcgtcttggtgagagcgtgastgctgagatttgggagtctgcgctaggcccgcttggagttctgagccgatggaagagttcactcatgtttgcacccgcggtgatgcgtgcttttcgcaagaacaagactctcggctatggagtccccatgttgatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaataytattaactggacttcctaatatatacttctatcaagtggaaaggaaattccaggcccatggaaacttggatatgggtaatttgatgacaaataatcttcactaaaggtcatgtaca

SEQ ID NO: 3750 - DNA, 424 bp, Homo sapiens
  CDS 25..348
cttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaagccagccccagtgcctgctgagccgtttgacaacactacctacaagaacctgcagcatcatgactacagcacgtacactttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaaaaaaaaaaaaaagg

SEQ ID NO: 3751 - DNA, 444 bp, Homo sapiens
  CDS 25..348
cttggtgcgcccgctgtcaccgccatggctgccccgtgtttgctgcggcaaggacgagccggggcgctgaagactatgctccaggaagcccaggtgtttcgaggacttgcttctackgtttctttgtctgcggaatcagggaagagtgaaaagggtcagccacagaattccaagaagcaaagtccaccaaaaaagccagccccagtgcctgctgagccgtttgacaacactacctacaagaacctgcagcatcatgactacagcacgtacacyttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcaaaaaaaaaaaaaaa

SEQ ID NO: 3752 - DNA, 468 bp, Homo sapiens
  CDS 141..353
  misc_feature 180,458: n=a, g, c or t
actttttaacacttctgtcaagcatagtaaaatttcaacttaaaatatcacaagtctaaatcaatcaatgattcatttgtgcattttactttatttttgagacggagyttgctctgtcgcccagactggagtgcagtggcatgatctcgtctcattgcaacctccacctcccagattcangcgattctcctttgtcagcctcccaagtagctgggattacaggcatccactaccacgcctggctaatttttgtatttttagtagagacaggatttcaccatgttggccaggctggtctccaactcctgacttcaggcgatacgccacctcggcctcccaaagtgctgggattataggcgtgasacttgtgcccggcctcatttgtgtatttaaattaaaaccttaagactgactttttattcacacagactaggggtgtgcaatcttttggsttcctnggccacgctg

SEQ ID NO: 3753 - DNA, 557 bp, Homo sapiens
  CDS 173..382
aaaaaagcctgccgggagcttggtgcgctatggcgacacccagcctgcggggtcgtctggcgcggtttgggaaccgcggaagcctgtgctgaagcccaataaacctctcattctagctaaccgcgtcggggagcggcgccgggagaagggcgaggcgacttgcatcacggagatgtcggtgatgatggcttgctggaagcagaatgaattccgcgacgatgcgtgcagaaaagagatccagggcttcctcgattgtgccgcgagggctcaggaagcccgaaagatgagatcaatacaggaaaccctgggagagtctgggagtttacttccaaataaattgaataagttgttacagaggtttcctaacaaaccttacctcagctgaaaatggacaagtattttcaatgactgaaatatagcttctgacaactatgcagaggcattttagagacattggcattgcatgccctctttggagggtagaagaggcaaaacacttttttcaccctttggaatcatagtatgggtagaagttatgatttatcttgaaataaaat

SEQ ID NO: 3754 - DNA, 495 bp, Homo sapiens
  CDS 211..414
atctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagcactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactccagaacacagtcgtgaggataatgggaatttactgaaacccgtggaaggaagcctttaaggaatggaaagagtggataataaaatgcctgactgttctccaaaaataaggacct

SEQ ID NO: 3755 - DNA, 499 bp, Homo sapiens
  CDS 126..392
caattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgstttcatttgggtggaatacttcattggaataaactactgatcttgtgctgtgtc

SEQ ID NO: 3756 - DNA, 525 bp, Homo sapiens
  CDS 136..366
aagaaaaggaggggcgtacgcgggcaagatggaggcgactacggctggtgtgggccggctagaggaagaggcgttgcggcgaaaggaacggctgaaggccctacgggagaaaaccgggcgctaaggacaaggaagatggggagccaaagaccaagcatctcagagaagaggaggaagaaggcgagaagcacagggaacttagagctgcggaactatgtcccggaggatgaggacctgaagaagaggagggtgccccaggccaaaccggttgcactggaggagaaggtgaaggagcagctgsgaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaaggccaggaagacagcctagcctctgcagtggatgctgccaccgaacaaaagacctgtgact

SEQ ID NO: 3757 - DNA, 473 bp, Homo sapiens
  CDS 31..279
  misc_feature 313: n=a, g, c or t
acggccgtcgtgccgctcgtgtcagtcaacatggaggcagaggaatcggagaaggccgcaacggagcaagagccgctggaagggacagaacagacactagatgcggaggaggagcaggaggaatccgaagaagcggcctgtggcagcaagaaacgggtagtgccaggtattgtgtacctgggccatatcccgccgcgcttccggcccctgcacgtccgcaaccttctcagcgcctatggsaggtcggacgcgtcttctttcaggctgaggaccggttcgtgagacgcaagaagaaggcagcagcagctgcggnaggaaaaaagcggtcctacaccaaggactacaccgagggatgggtggagttccgtgacaagcgcatagccaagcgcgtggcggccagtctacacaacacgcctatgggtgcccgcagcgcasccttccgttatgatctttggaacctcaagtacttgcaa

SEQ ID NO: 3758 - DNA, 483 bp, Homo sapiens
  CDS 152..457
atttgccgcaagttattggcaagttcccctgcagttgtttgggctgtccctgtggctggttctggggtgtgcggccagccatggagcgctctgggcccagcgaagtgacaggctcagacgcgtcgggaccggacccgcagcttgcgtcaccatgggcttcacggggttcggtaaaaaagctcgcacatttgacttggaagcaatgtttgaacaaactcgaaggacagctgtggaaagaagtcgcaaaacactggaagcaagagaaaaagaggaagaaatgaacagagagaaagaattaagaagacaaaatgaagatattgagccaacatcctcaagatcaaatgtggtcagagattgctccaaatcatcttccagggatacgagcagcagtgaaagtsaacagagttctgactcttctgatgatgagttaattggcctcctttaccccctaaaatggtaggaaaaccagttaattttatggag

SEQ ID NO: 3759 - DNA, 518 bp, Homo sapiens
  CDS 165..485
ctatcttgttgccggaagtgggaagagagaaaggttgtgatggcggctatagctgcatccgaggtgctggtggacagcgcggaggaggggtccctcgctgcggcggcggastggccgctcagaagcgcgaacagagactgcgcaaattccgggagctgcacctgatgcggaatgaagctcgtaaattaaatcaccaggaagttgtggaagaagataaaagactaaaattacctgcaaattgggaagccaaaaaagctcgtttggagtgggaactaaaggaagaggaaaagaaaaaggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaaacatatgagagactgagagaaaaacatggagaagagtt

SEQ ID NO: 3760 - DNA, 490 bp, Homo sapiens
  CDS 105..281
tgggagatgtcggcggcgtgttgggaggaaccgtggggtcttcccggcggctttgcgamgggtcctggtgaccggcggtgctggtttcatgtagtgcatcacatatgattgtctctttagtggaagattatccaaactatatgatcataaatctagacaagctggattactgtgcaagcttgaagaatcttgaaaccatttctaacaaacagaactacaaatttatacagggtgacatatgtgattctcactttgtgaactgctttttgaaacagagaaaatagatatagtactacattttgccgcacaaacacatgtagatctttcattcgtacgtgcctttgagtttacctatgttaatgtttatggcactcacgttttggtaagtgctgctcatgaagccagagtggagaagtttatttatgtcagcacagatgaagtatatggtggcagtcttgataaggaatttgatgaatcttcacccaaacaa

SEQ ID NO: 3761 - DNA, 454 bp, Homo sapiens
  CDS 225..401
aaaaaagctgcaagggcggatggcagaagagttggcacggtgccatccattcaggggcaacgcacagtttcgtgtgatagcagcagcgggtatatgatacggggccctgtatgcgggccagacagtgcggtaaagccaagggagattatccagacccccaggagcgaacagcaagcagcaaccgaagcgcaagtgccaggattacagcctaggctgctccaactatgagcccttcctcggaccctgggactcggctacttggggtttgggggtcttccacaccacagaggcacaaagctgactttaatcactttttttcctttaaacttgattctgccgcagtggagccagcacagcggatgttttcacacccagcaagacaaaggccgtcgtctccgccatgacactgttccgttccaagcagaggccgggattctggactcctcgaaaaatc

SEQ ID NO: 3762 - DNA, 345 bp, Homo sapiens
  CDS 144..329
atatcaatcaagtgaagcagctatcacagggtctggaacatattaggttctgtcaatagaagatactaaagaaagaaagccaggagaagaaaagggacttctttcttcaaggtctaagctgttctaatascattattctgggaatggcatcttccactcctcctagtacaaagaacctgcttcctcataccccgtcaaggaactgcagcatccaggtactttctctgcctcaaaggtctgcatcccattctccatttggcccctcctttgaactaccagatctccggctggattgcctttttgttctggaattttcaaaatttctttattaaatttcccagttga

SEQ ID NO: 3763 - DNA, 477 bp, Homo sapiens
  CDS 116..445
aacacgccgcggtcctcgtcgtggtgagcgcmgcactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgc

SEQ ID NO: 3764 - DNA, 480 bp, Homo sapiens
  CDS 124..453
gaggtaagaggccaggggtcgagggccctcgggagcttggtgaaaagggagttaacccccaggatcctacctgcagggactagaaaaatggagaagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgtttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctgg

SEQ ID NO: 3765 - DNA, 504 bp, Homo sapiens
  CDS 7..411
aggttcatgttcgaggccatcttcccctccacaccccaagccaggctgaaaagagatccacgggaaaagccgggcctgtcctcattcaggtccacattcaggcaacaaagctcacttggtctttgcatcccacgcctmatgttacctaaggaggccagcccatctcagaggcacaghycgatgtccagctcgatggccagggccctggtgctcctccagagcatggccagccgggacgcccggtgcccakaatggaaaccgsaccaaaagccacgcacgctcagcaagtsggtccagaccatcagccgctactacaggaagacgagtgaacccaasgatgccgycagcctcaccggcttsatgtmcaaaatggaacttckaagggtcttccccacgcatcctgactgcccctagktcagcaccagggccacatccatgtcccactgkggktcacccactgaggccgakttgkccggakagattgacaacagctcggagacctgg

SEQ ID NO: 3766 - DNA, 728 bp, Homo sapiens
  CDS 249..434
  misc_feature 711: n=a, g, c or t
ctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacmtttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaranaatacaacactaacaat

SEQ ID NO: 3767 - DNA, 478 bp, Homo sapiens
  CDS 165..395
agtagctggtgccttcccggaagggctcagaggcgggctcgggcaagcactttaaccttttaagcccaaccagatgagttgcctgcagttttggaggccttcagagcatttcaytagacctctgtctgtgtcggtccagtgtctttagcaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatataggcagcagaaaagtcactacagaccaggattcacccacttccacggcctgaggtggtttctcttgaggtgagcatcttaaggaacaaatgtaaaaagagagaccctatctatctatcagtagtgcactaca

SEQ ID NO: 3768 - DNA, 480 bp, Homo sapiens
  CDS 141..353
  misc_feature 253: n=a, g, c or t
actttttaacacttctgtcaagcatagtaaaatttcaacttaaaatatcacaagtctaaatcaatcaatgattcatttgtgcattttactttatttttgagacggagyytgctctgtcgcccagactggagtgcagtggcatgatctcgtctcattgcaacctccacctcccagattcaagcgattctcctttgtcagcctcccaagtagctgggattacaggcatccactaccacgcctggctaattttwgnatttttagtagagacaggatttcaccatgttggccaggctggtctccaactcctgacttcaggcgatacgccacctcggcctcacaaagtgctgggattataggcgtgasactgtgcccggcctcatttgtvyatttaaattaaaaccttaagactgactttttattcacacagactaggggtgtgcatcttttggcttccctggggccaacgcytggaaaggagaa

SEQ ID NO: 3769 - DNA, 461 bp, Homo sapiens
  CDS 169..348
agtaacaccagttgtaaacccgaggccaagagaccatggccacgttagcccggctgcaactaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaag

SEQ ID NO: 3770 - DNA, 460 bp, Homo sapiens
  CDS 215..397
  misc_feature 348: n=a, g, c or t
gaaaaacaaaaggagacgaaggacgcatgcgtttggtgagtcccggattccggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcagacagcagcatcaggcctggctccaaagcatcgcgnagaaagacaacaacctggttcctattggcaagccagcctcagagcactatgatgacgaggaagaagaggatgatgaagatgatgaggatagtgaagaggactcagaggatgg

SEQ ID NO: 3771 - DNA, 618 bp, Homo sapiens
  CDS 364..519
ccagactgckagcgsmgaagcgtagtttgcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaagtaagtgcaaaacgacaaattgtcacagaatacagagaaaaggggaaaagaaattaagaggagaaaaagagagatctagagggccggtccaggagatacaatctatgcataataggatacctgaaactgaggacagagcaagtggagctgaaa

SEQ ID NO: 3772 - DNA, 492 bp, Homo sapiens
  CDS 88..237
tgttggacgtgggcccaaatctggaccggctgggtttgctgggggtgtcttgaggtcccctccaccgtcgtctccgaatccccctccatgatccttccttgctccatctcaccctggcagaaaaaatctaagatctccgcctcgagaaaattgcagctgaagactctgctgctgcagattgcaaagcaagagctggagcgagaggcggaggagcggcgcgagagaaggggcgcgctctgagcacccgctgccagccgctggagttggccgggctgggcttcgcggastgcaggacttgtgccgacagctccacgcccgtgtggacaaggtggatgaagagagatacgacatagaggcaaaagtcaccaagaacatcacggaggtgggacgcatgggcagctcgggtaccttcggggtagggtgagatggctgggacttggtctctgcctgaccccttgcagctgcttttggctgcacatcccaggagaccca

SEQ ID NO: 3773 - DNA, 505 bp, Homo sapiens
  CDS 2..166
aatgtttgcacgtttgctaggcaggcaaggcggaaatggtggcgtaatgggttttgttttaaatcccgcccacggggtttgggtttctggctgtgagtcaggtttctggaaggctttatggaaaattaatggtataagagataaaactggatctgtactgttttcttagtccttagcgatccaaatgcagtctgggtgcagtctcagtgctaagatggacccagccttcccctctaaatcttagtgaaccggcttgatcccccggtctgttcatctttcagtgtttattctgagaaggtaggggtgtcacaaggaataaaaaaggcacgcaaacaaatagactactcgtgtggaaccaaaaacattttcaaattatttaagaaagcatgtcttcgtgttttttaaactttttagcaagcgattctcttaaggagtttagtttttaatttttgtcgatacacagttttatattctgtgttttctggtgtggccttggwcttttatc

SEQ ID NO: 3774 - DNA, 1158 bp, Homo sapiens
  CDS 828..1022
ccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagckctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttwtttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacytacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccwmaaaaaaaaaaaaag

SEQ ID NO: 3775 - DNA, 473 bp, Homo sapiens
  CDS 134..313
gttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttgccaagacttccgccctcgatcaagatggtggttggacggccttcctaacctttacggggcctggcggtgctgacgcctgagctggtaggggtggagcaggtaggaaacagcaaatgcagaagctgctgcgcggaagtcggccatggactggaaagaagttcttcgtcggcgcctagcgacgcccaacacctgtccaaacaaaaaa

SEQ ID NO: 3776 - DNA, 1100 bp, Homo sapiens
  CDS 28..642
agttagatttggaggttcaacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcraatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgcaaaaaaaaaaaaaaaa

SEQ ID NO: 3777 - DNA, 516 bp, Homo sapiens
  CDS 159..362
attcctaaggagaccacagaacccctaaaaactcatggaacctgcctgagttttcaattaggtacatgacagatctactcccactgcacaaattgaaaggcatggcaaaagatacaaaataaaagtgtttgttttgaattatagcccatgtggcccctatgttgaacatactgtttttatattatcaagtaggatctagagaatatatcttccaagaatatgttctgcagtttttgagggggaaaatggtcattgatcaattcatttgttttttgagatcccatactttgtgggtagggtataaaaacacaagggaggccgggcacgtggctcacgcctgtaatcacagcactttgggaggctgaggtgggaggatcacttgaggccaggagttcaagagaggcctgggcaacatagggaaacccatctctaaaaaaattttaaaattagccaggcatggtggcatgtccctgtagtcccagctactcaggagactagggtaggaatgctgctgga

SEQ ID NO: 3778 - DNA, 687 bp, Homo sapiens
  CDS 249..428
gcttagcggccccaggccgcccctgacactgaacgccgcttgtyccctccggcttgccgtcctcgcagccatggcggccgccgcgctcccagcatggctgtctctgcagtcgagggcaaggactctgcgtgcattctccactgccgtctactcggccactccggtcccgacacctagcctgcccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaactctttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagcttscagtttgatttasatgatcacgcaaagaagaaattaattaaacttgtasgagagcgatmctgcaagaccacagatgtgcttac

SEQ ID NO: 3779 - DNA, 527 bp, Homo sapiens
  CDS 137..361
taagaaagttctagtggcttgaggtatccgcagagcggccgggtggcgggaggaaccgttacgggaactgaagttgcggattaagcctgatcaagatgacaacctcccaaaagcaccgagacttcgtggcagagccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccattttcaactt

SEQ ID NO: 3780 - DNA, 555 bp, Homo sapiens
  CDS 137..361
taagaaagttctagtggcttgaggtatccgcagagcggccgggtggcgggaggaaccgttacgggaactgaagttgcggattaagcctgatcaagatgacaacctcccaaaagcaccgagacttcgtggcagagccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctc

SEQ ID NO: 3781 - DNA, 534 bp, Homo sapiens
  CDS 110..466
aaaaacctctaggtgcagaaggctgttaacggttgctgatgataaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgt

SEQ ID NO: 3782 - DNA, 467 bp, Homo sapiens
  CDS 12..329
cattttgtctcatgcaagtagcccatcctgcactgtcccgggaagccccacagcccggatggccctcagggggsctcgcgsccttcaccgtcgcgggaaaagccaagttggtggcaggaggagcccaccaccaaggcgatctcactgcggaaaaactcgaccctccgccttcaygtctagggcggcaggtggtagagctgggcctctcaggcattgcccgagggcaggcgagacaaggagcgcccccaagtggccatgcggtgtcctcacggaaggcagggagggcgtcacgggccttggggaccttgacacaacctggascacgaggctgagaaacccaccacgcaggccagctggaggctgccgcccagccgsgagtcagaagctgggagccactgggtgctcccgaagccatctggagcacctgaggaaccttgtgactacagtagtccccatagtccccactg

SEQ ID NO: 3783 - DNA, 467 bp, Homo sapiens
  CDS 133..300
gacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcasgggagagtgaaggcctgcakkagggcaggcgagacaaggagggtgtccagggctagggagtgccggatgaaaccagctctgtccstgtgcargctccargctcccgcctgacaaacaggcagggagccacagtcakggacaataaaaactwggtgcactctgaaagcagcactt

SEQ ID NO: 3784 - DNA, 484 bp, Homo sapiens
  CDS 123..323
cttttaggaagaagagtcaggcgcctctggaagggatggtttggcctacagagagaaaacaggtactattattatccctgttttgcaagtgacaaaaccgaagtacagagactttagagagaatgggcaaggggtcatcgatggaccggagatgggatggtagggacagaaactgcagggtccgcagaaggaactgctcaccgaaagccaacaagcttgccctgtggaatcccagaaaggcccaggaacttcgggacatcactgaaggcagagtgaagagaggaagagaagacagagaaatggaggggagaaaactattaaaataagtaataagaaaactttccccagaagtgcagaatctgaatttccagtataaaagggtccattgagcgccaagaacaatgaaggaaaaaaggtcccactcaggcctacgtatcattgtgaaatttcagaactagagggataaagaaaagatcctaaaagc

SEQ ID NO: 3785 - DNA, 442 bp, Homo sapiens
  CDS 200..382
gagtgaacttgggcactgcgaacacatcttctttatttctgcatccccaatccctggcatacctcctggcatatactaggtgtttaacaaaccttgttaaggcaagtaagtgtccagcagatcaactgccgcccaaaggagagaaaaaaggttaacgtttattgaggggcactgagactggagtacatccggaggtaagatgtccaggaaagcgaggagatcgcagccatggcgtcctagagattcggaacccagcccgggcagcttgaaaccattaccttccccctcgcaggggagcctggctagccccaaggaggacagttcgctttacctttccctgtcgtggtcggagcggcgcccggggctgcccaagtcttgcgggtaatcgggcaggcctcaaactaggggcaaccacacccascgagcgccagacaccgcgggc

SEQ ID NO: 3786 - DNA, 420 bp, Homo sapiens
  CDS 175..396
aaagcctaaccaacaggcaatggattatagtgattcagaggaaagataagaaggttcctttgtcttggacctccactagacatcaaggaaacatgccaaaaaagtaaacaacaaaggcccccacacctttccaaactacaacccaaaataagttgatctgagaaacaaattgcaatgccgcatgcaaagcagatgtgtccaaattcatgtaggaccagacacatcctgaacctttcagtgcaacagctgttcaagactttcttcaaaatcatccaagcacaagggttgataaaatacacacaaaatgggtatgtgacaccctggattccatgcaggtttggcagtaaccagggagaattagaacccgaagctagatttcgaaatagagctctggactgaagcattcttgcacaaccatcc

SEQ ID NO: 3787 - DNA, 505 bp, Homo sapiens
  CDS 71..502
attcaggggtgtaccaggcctcagaggcagcggaaagggagactgtggggaactaggagcaacagcaggcatggaccaaagcagtgaaggatgtatgaaaaagattagcagtgtgaatcttgacaaacttataaatgacttctcacagatagaaaagaaaatggtagaaaccaatggaaagaacaatatactggatattcagttggaaaaaagtaattgcctattaaaagtaatgcaagcaaaggaggtctccattaaagaagaatgtgctactcttcataatataataaaagggctacaacagaccattgaatatcaacagaatttgaaaggtgaaaatgaacaactaaaaataagtgctgatcttataaaagagaagttaaagtctcatgaacaggaatataagaataatattgccaaacttgtaagtgaaatgaaaatcaaagaggagggatataagaaaggaataagcaaactttatcaggacatgcagagaaaaggttga

SEQ ID NO: 3788 - DNA, 491 bp, Homo sapiens
  CDS 8..175
aaagtaaatgctgcaccaacttggtgttggaattgcagagaccactgcagtgggagctccaatttccagcctttggcaagggcatattcttcccgaggatcaccctgttgtgctggggcagccttccatgagcacttgcaccccggtgaccctgattgcccagtctcaagggatctgagaaaattaggaaaaccaggaacggttgttgtaatcttttgtatggctggaacgagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgstctctttttggccagctccac

SEQ ID NO: 3789 - DNA, 488 bp, Homo sapiens
  CDS 18..266
gaaagcaacgcccctgaatgcttatgccggtggttggtagaggaaatggaattccccagactgctaggagagaagacttgaaatgttcccagcacttagaaatgagaaatattcgaggtgatggataccccagtcaagtacctcttgacttgctactggtacctggaagagatgtaacacctgaccatgggacatcaagtgactgtgtgaatcaaactgcccatcatgaattgttgttatttgactcatcaaactgtacaactggatgaacacaggagcagtgcactacatatgggactggaaccatgaatgagcaggtgactcagactcctatagtacctgcctctactccttcagcacttctccctcaacccacataaactgtcatcataatgagttccctctgaccagttaatggaagagaaaaaagtatggatgttatggatatcctaacatatttctggccattggaccchtagaaaacctgt

SEQ ID NO: 3790 - DNA, 495 bp, Homo sapiens
  CDS 99..281
agctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggassataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcgtgtggacctggtggtgatggtagatggctttgaaggcgaaarggggccgtggtggctgggaktcgagggtacttcttgaagggggtcctgg

SEQ ID NO: 3791 - DNA, 398 bp, Homo sapiens
  CDS 155..316
cttttcccacgagttggagcctgaggtgcggagtttcgtgagtttttactgactcgagctgtcatttcccctgggcttggatgtgaggctacaatggcacaaattcatcattgtttacccaataccttctgtagtgtctgaagcatagatcatcatgcctagggttcataacataaaaaagtctcttacacctcacatttcttgtgtgacaaatgaatctgataatctgctggattttttgcctgacagactaagagcaaagctacttccattccagaaagatggcatcatttttgccctcaaaagaaatggcaggtaaagttctttgaagacatgctaaaaatgttaaattcctggaaagtgtattaaaaacaaagttctgttcaaaaaaaaaaaaa

SEQ ID NO: 3792 - DNA, 495 bp, Homo sapiens
  CDS 163..369
atttaccagagggagccagggctgcagctcatctgtttgcggatcagaacccgagctgtgcttgtggctgcggctgctaactggctgcgcacagaagctgagagaagagggtggcaataagtacttttgcctcattctgaagccttggaaggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagg

SEQ ID NO: 3793 - DNA, 498 bp, Homo sapiens
  CDS 122..328
attatccgcagcctcatttaccagagggagccagggctgcagctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaa

SEQ ID NO: 3794 - DNA, 652 bp, Homo sapiens
  CDS 258..452
agctctgsgaccatccgcagcctcatttaccagagggagccagggctgcarkcctcatctgtttgcggatacagaacccgagctgtgcttgtgagstgcggctgctaactggctgcgcacagcggagctgtcaccatgcctcactcgtacccagcccttttctgctgagcagaagaaggaagttgtctgacattgccctgcragattgtaagccccgggcaaaggcattctrgctgcgagatgagtctgtaggcagcatggccaagcggctgagccaaattggggtggaaaaacacagaggagaacccgccggctgtacgcgccaggtcctgttcagtgctgatgaccgtgtgaaaaaagtgcattggagggcgtcatttttcttccatgagaccctcttaaccagaaaagatgataatgggtgttccccttcgtccgaaaccatccagggataaggggcatcggtcgtgggcattcaaggtttgacaagggtgtggttgcctctcagctggggactgatgggagaaaccaccaactcaagggcctggatggggctctcagaaacgctgtgcccaattacaagaaggatggtgctgactttgccaagtggcgctgtgtgctgaaaatcagtgagcgtacaccctctgcactt

SEQ ID NO: 3795 - DNA, 501 bp, Homo sapiens
  CDS 108..314
  misc_feature 141..142: n=a, g, c or t
atttaccagagggagccagggctgcagcctcatctgtttgcggatcagaacccgagctgtgcttgtggctgcggctgctaactggctgcgcacagggagctgtcaccatgcctcactcgtacccagccctttstgctgagnncaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaccaccactcaagggctggatgggctctca

SEQ ID NO: 3796 - DNA, 433 bp, Homo sapiens
  CDS 102..254
aagtggaagaaagttctagtggcttgaggtatccgcagagrcgrmcgggtggcgggaggaaccgttacgggaactgaagttgcggattaagcctgatcaagatgacaacctcccaaaagcaccgagacttcgtggcagagccatgggggagaagccagtggggagcctggctgggattggtgaagtcctgggcaagaagctggaggaaaggggttttgacaaggcckatgttgtccttggccagtttctggtgctaaagaaagatgaagacctcttccgggaatggctgaaagacacttgtggcgccaacgccaagcagtcccgrgactsmttcggatgccttcragagtggkgcgamgccttcttrkgatrctctctggggaagctctcaatccccagccctcatccagagtttgcagccgagtagggactc

SEQ ID NO: 3797 - DNA, 473 bp, Homo sapiens
  CDS 77..283
  misc_feature 111: n=a, g, c or t
atctgtttgsggatcagaacccgagctgtgcttgtggctgcggctgctaactggctgcgcacagggagctgtcaccatgcctsactcgtaccsagcsctttctgctgagynsaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttcsatgagaccctctaccagaaagatgataatggtgttcccttcgtcsgaaccatccaggataagggcatcgtcgtgggcatcaaggttgacaagggttgtggtgcctctagctgggactgatggagaaaccaccactcaaggggctggatgggctctca

SEQ ID NO: 3798 - DNA, 451 bp, Homo sapiens
  CDS 77..283
atctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctggggactgatggagaaccaccactc

SEQ ID NO: 3799 - DNA, 511 bp, Homo sapiens
  CDS 107..313
atttaccagagggagccagggctgcagctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggcctggatgggctctcagaacgctgt

SEQ ID NO: 3800 - DNA, 302 bp, Homo sapiens
  CDS 96..248
  misc_feature 298..299: n=a, g, c or t
tagaaagttctagtggcttgaggtatccgcaggagcggccgggtggcgggaggaaccgttacgggaactgaagttgcggattaagcctgatcaagatgacaacctcccaaaagcaccgagacttcgtggcagagccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtgdnngcc

SEQ ID NO: 3801 - DNA, 462 bp, Homo sapiens
  CDS 92..448
aattggatatgggtattgtagctgaaacgtcttgcgagctgagtcagggtcggggaagctgtgatggcaatgagaagtcaacacactgaggatggagagaaagaagatgagtctgggagagaaagagaatgattcttctggccgagggaaagcaagaatatctgttcctgcaactgcactgattctagaaacactctctattcgaactctcatgagatggaccgaaaatgctgacgccaatgccaaggaaaaaagtgtcttgaaaaagcagccgtggacgtggagttaccaaatcatccgaagtggctcctggaccgggtggaggagccaggctgcagaaatgcagttcatcgcaggagttttcctgaacagagaaaagtctccacagaatagcaaaaatagcagcagccttcataggctatgtcctcccgtgagccaaatatcattctgaggggccacagt

SEQ ID NO: 3802 - DNA, 468 bp, Homo sapiens
  CDS 92..448
aattggatatgggtattgtagctgaaacgtcttgcgagctgagtcagggtcggggaagctgtgatggcaatgagaagtcaacacactgaggatggagagaaagaagatgagtctgggagagaaagagaatgattcttctggccgagggaaagcaagaatatctgttcctgcaactgcactgattctagaaacactctctattcgaactctcatgagatggaccgaaaatgctgacgccaatgccaaggaaaaaagtgtcttgaaaaagcagccgtggacgtggagttaccaaatcatccgaagtggctcctggaccgggtggaggagccaggctgcagaaatgcagttcatcgcaggagttttcctgaacagagaaaagtctccacagaatagcaaaaatagcagcagccttcataggctatgtcctcccgtgagccaaatatcattctgaggggcacagtaattaca

SEQ ID NO: 3803 - DNA, 985 bp, Homo sapiens
  CDS 553..906
actcaaaggaccctcccgcgccccggaggctccggggtctcgggcttccgccttcttgctgccctcgttcttgccrgggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgcagagtcattgttctttcragcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaag

SEQ ID NO: 3804 - DNA, 509 bp, Homo sapiens
  CDS 142..354
  misc_feature 112,181: n=a, g, c or t
actttttaacacttctgtcaagcatagtaaaatttcaacttaaaatatcacaagtctaaatcaatcaatgattcatttgtgcattttactttatttttgagacggagyytgnctctgtcgcccagactggagtgcagtggcatgatctcgtctcattgcaacctccacctcccagattcangcgattctcctttgtcagcctcccaagtagctgggattacaggcatccactaccacgcctggctaatttttgtatttttagtagagacaggatttcaccatgttggccaggctggtctccaactcctgacttcaggcgatacgccacctcggcctcccaaagtgctgggattataggcgtgasactgtgcccggcctcatttgtgtatttaaattaaaaccttaagactgactttttattcacacagactaggggtgtgcaatcttttggcttccctgggccacgctgtgaaggagaagaattgtcttgggcacacataaaatacact

SEQ ID NO: 3805 - DNA, 400 bp, Homo sapiens
  CDS 34..207
cttgctctttcgcmcaggctggagtgcagtggcatgatctcagctcactgcagcgtctgccttccgggttcgagagattctcctgcctcagcctccagagtagctgggtctacaggcgtgtgccaccacgcctggctgattgtttgtatttttagtagagacagggtttcgccgtgttggcaggatggtctcgatctcctgacctcatgatccgcccgcctctgcctcccagggtgctgggattgcaggcgtgacahccgcgcccggccataaactatttattaacagataaggcctacagacttatttcttcttggatacacccacggtacaggtacggccatggcggctcacgctgtattcccagcactttgggaggccgagatgggcagatcacgag

SEQ ID NO: 3806 - DNA, 450 bp, Homo sapiens
  CDS 249..410
ttgagtgtttgaagagacggggtcttcctgtgttgcctaggctggtctcaaacttctggcctcaagtgatcctcctgcttctgcctcccaaagcsccaggattatagggttgagccactgtgcttggcttagaggtaataaaatttaatattctattcagaataagaaaatatagcatataagcatttgtatctttagtaaagttactgccagtttgatttttttttttgcaagttacttagcagaacatgwaattcacagtaaagatgatyctgtgttgtaccatatttwaatatycckgttttgaaagaatagtagagagaaaatgggtggcctgcycagtgattgcttttcgtagtcttggygaatgttacaggagattgaatttawagataaaagcacagtcatcatagtttccacagtacattgcagcacatttrgcaatatcaa

SEQ ID NO: 3807 - DNA, 498 bp, Homo sapiens
  CDS 146..364
gtcagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctccttygggacactgtccagctgggagctggaaagcctggtatgaggacctgcaagaggtcctgtcttcagatgaaaatgggggtactatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagacaagggagaascaggaacggaaacagag

SEQ ID NO: 3808 - DNA, 499 bp, Homo sapiens
  CDS 208..366
attctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggraatctcgaatcatagtgattaaaatagttggggtaaagttgtagcttatatgcaatactacttggaggaattcttctactaatttgtattt

SEQ ID NO: 3809 - DNA, 590 bp, Homo sapiens
  CDS 97..516
agcttagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccacacaatactaacccttcccctcctctgatgtcttacatcacctcccaggakatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattca

SEQ ID NO: 3810 - DNA, 503 bp, Homo sapiens
  CDS 35..490
gtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactcgtatgtaccagataagtttgcctctttagcaatctcagt

SEQ ID NO: 3811 - DNA, 528 bp, Homo sapiens
  CDS 162..512
attgccatagcttttataaatggacaacctaagctgtgttaatctgacaagaaggctagaaagctcaatgcgtcttcctattactctgcatatcttatgtcttccatccaaaaagaatcaacttatcagataaataaccacctcatgaactaagatgaatcatgttccggcttttgtcctcctgctgctcttgcctaaggacaacagaagagacacgaaggaatgtgaccatccctatcattggcttgaacaactctggcaaaactgttcttgtggaggcattccaaaaattacttcccagtaagacagaccattgcatgaaatcggaactgactacacttttgttagatgagtatgaactttccatctatgacctgaatggagacctgaagggccgggaagcatggccaaactactatgcacaggcccatgggcttgttttcgtcctggattccagtgacataagacgcatgcagggaagtgaagatcatcttaacacatctgctgtccgataaaagagtggcaggg

SEQ ID NO: 3812 - DNA, 519 bp, Homo sapiens
  CDS 87..242
atcactcaatctgctcaccaaaattctgaaacagccaagacggccccaagcccaaggaaaggcttcarcaacactgttctgtgaaaatgatgatggcaatgaattatgcattgttctctaaagtctggtaccacggcctcaaatcacatactaaaaacatactcaagatcaacataagctgggcatgcaggacacacctgctaatctgttttcaattaaagttttcccatcaccatgatggataaaggtaatttttagctttcgttaaatgaactttaagatttaaaatctatttttatgtacgtcaaaattacatctcaaattattctaactcaagatacaccgaagataaaaattaggaagaacattttgtttttctattatcatatataattatacagtaattagagatgtattcgcataattgtttcaatatttttataataataagcaacagtccgtggaccatactaaaagtctaaattttacgggttcccagagaggattaactacatagac

SEQ ID NO: 3813 - DNA, 518 bp, Homo sapiens
  CDS 11..361
aattcaagtcatgcaggctgtgagaaacgcggggtcgcggttcctgcggtcctggacttggccccagacagccggggtcgtggccagaacgccggccgggaccatctgcacaggcgctcgacagctccaagacgctgcggccaagcagaaagttgaacagaacgcggctcccagccacaccaagttcagcatttacccacccattccaggagaggagagctctctgaggtgggcaggaaagaaatttgaggagatcccaattgcacacattaaagcatcccacaacaaagggatttcggaatgccaagaagggcacaggcatcgcagcacagacagcaggcatagccgcagcggcgagagctaaacaaaagggcgtgatccacatccgagttgtggtgaaaggcctggggcaggacgcttgtctgccatgcacggactgatcatgggcggcctggaagtgatctcaatcacagacaacaccccaatcccacacaacggctgccgcccaggaaggctcg

SEQ ID NO: 3814 - DNA, 515 bp, Homo sapiens
  CDS 17..445
cgaaaaaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcgkmtcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagcgcagcggcgagagctaaacaaaagggcgtgatccacatccgagttgtggtgaaaggcctggagccaggacgcttgtctgccatgcacggactgatcat

SEQ ID NO: 3815 - DNA, 480 bp, Homo sapiens
  CDS 11..190
aattcaagtcatgcaggctgtgagaaacgcggggtcgcggttcctgcggtcctggacttggccccagacagccggggtcgtggccagaacgccggccgggaycatctgcacaggcgctcgacagctccaagacgctgcggccaagcagaaagttgaacagaacgcggctcccagccacaccaagttcaggtgagccccacttggaccagccctctggagacccgcaacccctgactcttgcccgacaccctccagagtcagaaccagtgaattttcagctatgtcacttgctatccgtgggaccttatgcaaataaatctgagcctcagccttctcatctaaaaatgcggataatgctgagagaggttgtgagaatcagatgagccgtggtacagagtaaatgttcagtgaacattcgttaaatcaatgagtgaatgtgagatatccataacatgtatcagcgttcttttcttctgagat

SEQ ID NO: 3816 - DNA, 458 bp, Homo sapiens
  CDS 138..344
aactttttcgacaacagctagaagtttttgcctggaaaaatgtggacttcttgattgcagagtattttgagcacgttgaagaagctgtgttggctgtggaagtcttaaaagaatcagatagacccgtggcagttaccatgtgcataggcccagagggagacatgcatgatataacccccggagaatgtgctgtgaggctggtgaaggcaggggcttccatcgttggcgtgaactgccgctttgggcccgacaccagcttgaagacgatggagctcatgaaggagggtcttgagtgggcagggctgaaacgcacctcatggtcagcctctggggttccacgcgcctgactgtggcaaagaggggtttgtggatctcccagaatatccctttggactggagtccagagttgccaccagatgggatattcaaaaatacgccagagaggcctacaacctggg

SEQ ID NO: 3817 - DNA, 455 bp, Homo sapiens
  CDS 93..350
  misc_feature 188: n=a, g, c or t
aacggaataacggcgctgtgggctggggtgggcggastgccttcaggcttctggtctccagcggcggggaactcacacctgccgctgtgaaaatgcagacccgcggggcagtaattccgagtccagcctggggcgcgatctggaatcttgactcgcttgaaacacttgaaacaccacggcggattcrnagacaggtgagtagagaaatgagcctcagcccctcccacgggccgcccaaggattccaggatccggaaactcttcctgctgctgcgtcaccccaggaaggcagcgccgcctctgggccgttctgatggaaactggcttcgcgcccagaggaaaacccacaactaaggggccaagaaaaagcctccatggtcccgccctttcagtgaggatcctaatttataccccgagtgtggcccccatcaaagtctgcagtgacagccgagcgcg

SEQ ID NO: 3818 - DNA, 484 bp, Homo sapiens
  CDS 165..395
agtagctggtgccttcccggaaggctcagaggcgggctcgggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatataggcagcagaaaagtcactacagaccaggattcacccacttccacggcctgaggtggtttctcttgagactcgttactgggcatcagtagaagaatatattcccaaatgggaacagtttcttttagggagagcaccat

SEQ ID NO: 3819 - DNA, 527 bp, Homo sapiens
  CDS 181..438
  misc_feature 481: n=a, g, c or t
aagacccctcggtcttgctatgtcgagctcacccgtgaagcgtcagaggatggagtccgcgctggaccagctcaagcagttcaccaccgtggtgccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagabcaggcggctcatcgagctctacaaggaagctgggatcagcaaggaccgaattcttataaagctgtcatcaacctgggaaggaattcaggctggaaaggnbctcgaggagcagcacgggcatccactgcaacatgacgttactctt

SEQ ID NO: 3820 - DNA, 480 bp, Homo sapiens
  CDS 181..438
aagacccctcggtcttgctatgtcgagctcacccgtgaagcgtcagaggatggagtccgcgctggaccagctcaagcagttcaccaccgtggtgccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagcaggcggctcatcgagctctacaaggaagctgggatcagcaaggaccgaattcttataaagcttgtcatcaacctggggaaggaaattcagggctggg

SEQ ID NO: 3821 - DNA, 449 bp, Homo sapiens
  CDS 96..260
taataactttgagagggaagggactgtgattcagatcactttatttcaaaaagatctctctgcttccaagtaatctagtgggtgcgactagaggcatgggagaaagactccactcaactcttcctaggcctgtggagctccaaatgttggcacatataagggagggagtaaagcccctccggtcatctgcagggctgagctcagatcatgggtcgacccagatgcatggtcatgtaagccatcgtctgtttgcctgtaagtgaagggggaaatccttgtcattaagttccacaagtttcttccaagtacattaacttttatttctattcatctcttttaggaaattattattgatataaattgattataagtaaatatttgcagtgagctgagattgcaccacttcactccagcctgggcaatagagcgagactccatcaaaaaaaaaa

SEQ ID NO: 3822 - DNA, 569 bp, Homo sapiens
  CDS 350..508
ctctgggattcgtgcaagtagcgtgcgtgcccttgtgagtttggagggtgccggtcagcggascgtgcgattgtatttgaaaagcaatcagtccgaccttcccccatagattcatcctgcctgaaaatcatatgcgtggtttttcctgtttcctgctctgtagctgacatcaggggagcaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaacaatgctcctgaaggcccctttccctcaaagaatcactgcaattgaaggaaaaatgctccatgtcccctctgccagttggtgtttatcaaaggacaacggaggaagagagacaaagtgcctggatgtgtgtgttaatcaagagttgtcaggaccctgcctctaaaagaaagcgctaaaatgatgcttttgacaagacttttctcaaagtggatgcagtctaa

SEQ ID NO: 3823 - DNA, 453 bp, Homo sapiens
  CDS 140..352
actttttaacacttctgtcaagcatagtaaaatttcaacttaaaatatcacaagtctaaatcaatcaatgattcatttgtgcattttactttatttttgagacggayytgctctgtcgcccagactggagtgcagtggcatgatctcgtctcattgcaacctccacctcccagattcaagcgattctcctttgtcagcctcccaagtagctgggattacaggcatccactaccacgcctggctaatttttgtatttttagtagagacaggatttcaccatgttggccaggctggtctccaactcctgacttcaggcgatacgccacctcggcctcccaaagtgctgggattataggcgtgasacttgtgcccggcctcatttgtgtatttaaattaaaaccttaagactgactttttattcacacagactaggggtgtgcaatctttggcttc

SEQ ID NO: 3824 - DNA, 491 bp, Homo sapiens
  CDS 240..389
actaagcaatgacacatgctaggagtggggctgggccttggggctgctggatgaatgagacccagcctctgccctgggagtgcagagactcaagacagatatgaccacgtgaagagacaactgtaaaacaagtgtggttgccctagagtttgcagtatatgtttacaactaacccaagaccactttcaaattacactacaccttgcaggcagtgaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaaatgcatggtatttcacttaacgagcacaggaagtacttgctagaaacctgaatgtcatgtcattcaccaggggcgctgatgtgagaggagatctccaacctgttatcaggtgcacagtg

SEQ ID NO: 3825 - DNA, 487 bp, Homo sapiens
  CDS 33..338
agtcactatgaaaactcattagctccacagcaatgagtcctccactgctgaagcttggcgctgtgcttagtaccatggcaatgatctcaaactggatgtcccaaactctcccatccttggtgggactgaacaccacgaggctgtcgactccggataccttaactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcaaacatgtcccagtctattgaagtcttaaacttgagaactcagagagatttccaatatgttttaaaaatggaaacccaaatgaaagggctgaaggcaaagtttcggcagattgaagatgatcgaaagacacttatgaccaagcattttcaggagttgaaagagaaaatggacgag

SEQ ID NO: 3826 - DNA, 603 bp, Homo sapiens
  CDS 68..355
gcgcaggcgcagaaaggcacaggactcgctaagtgttcgctacgcggggctaccggatcggtcggaaatggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagc

SEQ ID NO: 3827 - DNA, 465 bp, Homo sapiens
  CDS 141..353
actttttaacacttctgtcaagcatagtaaaatttcaacttaaaatatcacaagtctaaatcaatcaatgattcatttgtgcattttactttatttttgagacggagyttgctctgtcgcccagactggagtgcagtggcatgatctcgtctcattgcaacctccacctcccagattcaagcgattctcctttgtcagcctcccaagtagctgggattacaggcatccactaccacgcctggctaatttttgtatttttagtagagacaggatttcaccatgttggccaggctggtctccaactcctgacttcaggcgatacgccacctcggcctcccaaagtgctgggattataggcgtgacactgtgcccggcctcatttgtgtatttaaattaaaaccttaagactgactttttattcacacagactaggggtgtgcaatcttttggcttccctgggccacg

SEQ ID NO: 3828 - DNA, 544 bp, Homo sapiens
  CDS 189..353
  misc_feature 453: n=a, g, c or t
attttatctttcttttttggtatcactcctagtaccaagtcttgtgtctgtcaatatcctgtccaaaaaagaaaaacacaccaaggaaaattaatataggaaaratttaaraagttattagaggactgaaaatataaaartggaacactgaaagacacagagtttttattttcagcactgcagctctgatggtccagctccaccaggacacagatccccagatccctaaagtggtcccctcatcttgtacgtgcatcaggcccaaaaacttaatttcacctctgactgtgatcaacatattgatgaagactggctatgtggatgctggaagatggggaaaacttgtttcaagctgaacattatccttgccattaacttgcttaaagaggctggattcatctgggcagttttcactgctgcaagttaggcaccttattccacaaggacttacanggaccaaagctcctgaagtaccatcattctaccatggatactgtgaagtggtacaccgtaaatccatgtcctctaatgtcagctgactatc

SEQ ID NO: 3829 - DNA, 589 bp, Homo sapiens
  CDS 98..262
atgtaccagcgccggaagttggtctcgacacctggactagccgggttgtatttggaaacgcggagtgagtttttccgtgctgtgtagggggctaacaatggacamcccagargasgttcaacctccaaagcagcaaccaatgatatatatctgtggagagtgtcacacagaaaatgaaataaaatctagggataccaatcagatgcagagaatgtggatacagaataatgtacaagaaaargrctwaaaagattggtcgttttgawrscycgatgaatgctgggaattcagagggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaaagcatagcaagagattaataataatgtaatagaacaatgataacatactataataaaagttatgtgaatgcgaaaaaaaaaaaaaa

SEQ ID NO: 3830 - DNA, 561 bp, Homo sapiens
  CDS 220..378
aagacaaccaaactccatcaatcaagaggaacttaatccagggttcttctgctcactgggtcagaagcatccgatttcctgtcatcggttgcggttcagccatgttaatactgaaagtataagaatatcataatcccagagtgatataaagacctttccaaggaagatgagatacccggagctgtgaaggagaagtctgaaggatttgaacgcgttcaaatgaaaacctttggttcagcaaaacaccagaaacaaattcaaaagataaaatacactccggagaagcccattctctcaacgcatctgacagttcacaaagagcaactgcagtccaacttaaaaaataaagaaaatggtaggaaaatgggcaacatgcactgaggcaatatataagaagaaggaatgcgcaattaatcaacaaaagcctgctctttcctaacgagtgaagatacaagcttagtaaatattaaaatttattgaagataaaaatggacacttccggccatatataaaagcattgttggtaagagagtggggtattgacatgctcctgggaaataa

SEQ ID NO: 3831 - DNA, 542 bp, Homo sapiens
  CDS 8..268
ttcatttatgttatcacttgaaaaccattataaattgctttatatttgccgtcttgaagttttctttattcctcactcttacctcctcaaattcaagttttattgttcgtttctctgtcgtgtcctttttcctctccctttctactacttctcgatcttccatccaccccagttcacctgtcacccaggaactgttttacaagtagattggacaggtaagatttacttacccaccatctttttcaccagtaaagtcaaggaaatgctctaagacatcttaggaactagctattaaaaattatcattggaggaaaattttagaagtgttatagacaattatcgatacatatgttttaagacctgtagttctcacactgttgaacccgtgcattctgtaaactgtaccaagtattctttcccaaatagagaacaaaaccagtgaataatgatttgatatcagcaaaaacatcccatgatgcttagtttgacagttaattttatttccccaaagacccagtgatttttttattatatacttataa

SEQ ID NO: 3832 - DNA, 456 bp, Homo sapiens
  CDS 219..410
aagaaagatcgcggaaccttccaccatcaagggaccgcaggcgggstctgctttcccagcacgctgcctcaccaagaaagaatccagagaaggactggtggacttggaatgttaagtcatggcccatttgatgatgttcagggatgtggctgtagatttstctcaggaggagtgaggagtgcctggacctggaacagagggatttatatagagatgtgatgttggagaactacagcaacatggtctcactgggtttttgsatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaatagcccaattggaaataatgagaatttgtaaaaaccacagccttga

SEQ ID NO: 3833 - DNA, 463 bp, Homo sapiens
  CDS 195..413
tgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttyccttaacagtttccggatcaggtgaccaccaccacgttcargtttctgaatgcagaccccaccacgagggat

SEQ ID NO: 3834 - DNA, 592 bp, Homo sapiens
  CDS 327..509
tccttttcctataccttcctttggtccttataagtatccaaattgccctaaaataacttctgcacatgcagcattaggaagcagtgtttcccaaccactacatttgaatgattcattcctctgaggaccctcaagtacttcagaagaactaaaaaatgaatatcacgttacaccaaagaagaaatgaaagctgccagtgtcttctgaagttaaacaggctcctgttctttgacccagcaatccaatcctaggtatttaattgttccctgaggtttaaggcagtggactaaggataatacaggctccagctttcattagttcaatggatgatgctgttcaatccatactgtttggggcatttgttgaaaatgtcattcagaagatatcaacactttctgagtcatggtttgattgaatttatagaattatgtgatagaaaccacattcttcacaaaagtcacaaggcaataatgacgacaagggttgaagatgaaagatgccaaatattctgatcaattcaataaggcaaaaagacaagttaattcactcagtgctccaggcatcaacttcatagaaggaatggaaattctac

SEQ ID NO: 3835 - DNA, 452 bp, Homo sapiens
  CDS 42..335
aagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaagatcctgcctaaccacactgctttattttacacttaagaagttctgtaatttcactaagttttggtgtttaactcacaaa

SEQ ID NO: 3836 - DNA, 298 bp, Homo sapiens
  CDS 8..295
agtaacgatggcawdgagagatgacctgtcattttgccgagagatgaaatttaggaataagatggtwgaatacctgacagactgggttatgggaacatcaaaccaagcagcagatgatgatgtaaaatgtcttacaaggcatcaggtacctgaaaaagaagagatcaaggctttgaaaacgttaagtattttctaccaagctggggcttyyaaagctgggaatcctatttttyattatgctgcwcgggccacatcaccatcctggtggaaccctyctgtgakgacagccaaggcctga

SEQ ID NO: 3837 - DNA, 550 bp, Homo sapiens
  CDS 92..484
aaagcacatctacaatcaaggagaggggcaggctttaccttttgaaggaagaagtatgaaagtgtatcactgactgatcaagtagagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaaktatcatttcccatgtggacttcagagagaatgtattttccagtttactggcaattttgcgttcaagcaataaatgcgggagtgtttttctttaggtgtacaatatgcaataatagtgacatctttcagaaagagatgttgagaatgggaattcatat

SEQ ID NO: 3838 - DNA, 470 bp, Homo sapiens
  CDS 169..429
accgtcacaggaatcctaagagcattggcgtgaggctcggcggagggcatgctggaccatgtcttctgcacacaggaatggacaagccccggcccagtcctcaggccctgacacgcctggagaacatggtgccagcacaagaggaagggcctattctgccacagctgaatgagtagaaaggggagacggagacacggacacacccagagggagagcgccgtgtggagacagaggctgaggccgacctgccgtggcagaagccagggaagcccgcagatgggcagcagagcagaagctgggacagaggccccgagcggaggcaccttctcggtccttggcagaagcccgscctgcctgcgccttyctctcggactgctattccccgagccgggagagaggccatctctgctggaaagccactcaagtttgtaacgctttgtgaccgcagccacaggatgctaatgaagccm

SEQ ID NO: 3839 - DNA, 536 bp, Homo sapiens
  CDS 3..224
aaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataagc

SEQ ID NO: 3840 - DNA, 508 bp, Homo sapiens
  CDS 3..224
aaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctggtgggaatgcatt

SEQ ID NO: 3841 - DNA, 421 bp, Homo sapiens
  CDS 165..389
tctactctgtcccttctgctagctcctcccacttcctgggaagactaattctagaactgcttgaccttggccagggaagggctggatgtgaagttccacacctggagtgatgggtccttaaagtcccttctttctgttctcaggctggcccttgtgactagttcatggcctcagacactgtactgtgggcaccatctcttgactcctggccggccttctcttctgggaaggggctgctccaggtcttcattggacccagagcttcctggatcccatcagcagaggcgggacaacggggaagggcgccagaggccagcggggtgggggagcacagatgcttccaattggcttggctccctgcacttggtcctgaaggggttaatgaggcttgaactgaacagaccgggccctcactccctty

SEQ ID NO: 3842 - DNA, 377 bp, Homo sapiens
  CDS 143..370
aatagaacacaagctttaaagtaagtgaatcatgtgtgcctcatttatttttaaaagcaacttctgagaagggctaagaacaaattttttccctgagtgccatttcccaaaggtactcacagaacaatcaggtgtgaccataatggctgcactgagttgtctcttggacagtgtcagaagggacataaagaaggtggacagagaactaaggcaactgagatgcatcgacgaatttagcacacggtgcctgtgcgacttgtatatgcacccctattgctgctgtgacttgcacccatatccgtactgcttgtgctattccaagcgatcacgctcttgcggcctgtgtgatctctacccatgttgcctgtrrtgattat

SEQ ID NO: 3843 - DNA, 339 bp, Homo sapiens
  CDS 100..303
attatttttaaaagcaacttctgagaagggcttagaacaaattttttccctgagtgccatatcccaaaggtactcacagaacaatcaggtgtgaccataatggctgcactgagttgtctcttggacagtgtcagaagggacataaagaaggtggacagagaactaaggcaactgagatgcatcgacgaatttagcacacggtgcctgtgcgacttgtatatgcacccctattgctgctgtgacttgcacccatatccgtactgcttgtgctattccaagcgatcacgctcttgcgggcctgtgtgatctctacccatgttgcctgtgtgatttatwagc

SEQ ID NO: 3844 - DNA, 252 bp, Homo sapiens
  CDS 34..201
ctcagcatctggagtagctgggattacaggcacatgccaccacgtctggataatttttgtatttttagtagagacggggtttcaccatgctggtcaagctggtctccaastcctgacctcaagtcatctgcccgtgtcggtctccggaagtgctgggattacaggcctgagccaccacactccacccctaatcaccccttctaataaagacacagctcatgtaggatgagagctaaaaaaaaaaaaaaaaaa

SEQ ID NO: 3845 - DNA, 352 bp, Homo sapiens
  CDS 5..181
acttatgtgttcatttgtgtaccaccattgcaataaagatacagaactgttctgtcactacagaggtctccctatgtgttccccctttctacttcccactatgtactttgtctccaatcattactgtataattttgacatgtcaagaatggtatgtaaataataatatagtgtgtaacttttaaagcatttttgaaagtgaagattaaagcctaagtaaggtataattactacttttgccaactttataaaaactatggctgggcaccgtggcccatgcctgtaatcccagcatgctgggaggctgargtgggtggatgaccagaggtcaggagtttgagaccagtctgacc

SEQ ID NO: 3846 - DNA, 768 bp, Homo sapiens
  CDS 533..760
  misc_feature 746: n=a, g, c or t
aatccctccaacccctctcaggagggcatgatatggagagttgggcattggctgtgttccctgaatacagagtatctctcttgtggtgcctggaactggcatcccctttgtggagcttagggcaagccccgcctctgcatgagacttggagctgacatggacccaaatcctcgggccgccctggagcgccasagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaaggatggacaaccatttggaggagctgagcctgccggtgcctacatcagacaggaccacatctaggacctcctcstcctcctcctccgactcctccaccaacctgcatagcccaaatccaagtgatgatggagcagatacgcccttggcacagtcggatgaagaggaggaaaggggtgatggaggggcagagctggagcctgcagctagcagtgggnccctgactacagactgaccacg

SEQ ID NO: 3847 - DNA, 453 bp, Homo sapiens
  CDS 81..323
aacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcagagctgacatggacccaaatcctcgggccgccctggagcgccasagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggaccggatgcagcagatgtgttcttgccttgcgaagatcctccaccaaccccccagtcgtct

SEQ ID NO: 3848 - DNA, 674 bp, Homo sapiens
  CDS 317..469
gtgtggaaagagaatggtgacattggagaagagtcctgctgggtgcttgtaaaaggctcctctgtctgcaaggcagctgagctgcttagtaagcagggcatgggcagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgaaarkrtaatgacaaaactcaacagaaaaatgaatgacagcaattcagcaggagcaggtggaccaggtgaaaataacaggaaaaccgatcaaaagaagaccagtttctttcgttgctcgctactttgatgaaactctttctgagaagactgcagccacacctararggccccttttcctgcttctctgaaagcacaggtcacccagcctcagaaatttycccacacctcccgggctgctgctgagagcaccactgaacttagacctctcaacacagtatgccaagtggattccagcctcatggcctagcaaaagaacagactccctttttcaaacatggaagcaatgaagtggagacacatgcaggacctaaaaaaaaaaaaaaatgcgaa

SEQ ID NO: 3849 - DNA, 515 bp, Homo sapiens
  CDS 130..402
gtgtggaaagagaatggtgacattggagaagagtcctgctgggtgcttgtaaaaggctcctctgtctgcaaggcagctgagctgcttagaagcagggcatgggcagcatgctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcac

SEQ ID NO: 3850 - DNA, 514 bp, Homo sapiens
  CDS 129..401
gtgtggaaagagaatggtgacattggagaagagtcctgctgggtgcttgtaaaaggctcctctgtctgcaaggcagctgagctgttagaagcagggcatgggcagcatgctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcac

SEQ ID NO: 3851 - DNA, 514 bp, Homo sapiens
  CDS 129..401
gtgtggaaagagaatggtgacattggagaagagtcctgctgggtgcttgtaaaaggctcctctgtctgcaaggcagctgagctgttagaagcagggcatgggcagcatgctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtggasataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcac

SEQ ID NO: 3852 - DNA, 515 bp, Homo sapiens
  CDS 130..402
gtgtggaaagagaatggtgacattggagaagagtcctgctgggtgcttgtaaaaggctcctctgtctgcaaggcagctgagctgttagaagcagggcatgggcagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcac

SEQ ID NO: 3853 - DNA, 516 bp, Homo sapiens
  CDS 130..417
  misc_feature 350..352: n=a, g, c or t
gtgtggaaagagaatggtgacattggagaagagtcctgctgggtgcttgtaaaaggctcctctgtctgcaaggcagctgagctgcttagaagcagggcatgggcagcatgctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgaratataatgacaaaactcaacagaaaaatgaatgacagcaattcagcaggagcaggtggaccagksannnataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcac

SEQ ID NO: 3854 - DNA, 519 bp, Homo sapiens
  CDS 129..401
  misc_feature 486..489: n=a, g, c or t
gtgtggaaagagaatggtgacattggagaagagtcctgctgggtgcttgtaaaaggctcctctgtctgcaaggcagctgagctgttagaagcagggcatgggcagcatgctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagadnnnnactcccggctgctgctgagagcaccactga

SEQ ID NO: 3855 - DNA, 516 bp, Homo sapiens
  CDS 130..417
  misc_feature 111,386: n=a, g, c or t
gtgtggaaagagaatggtgacattggagaagagtcctgctgggtgcttgtaaaaggctcctctgtctgcaaggcagctgagctgttagaagcagggcatgggcagcatgcntcttccgatgtcgaaagaatgatcctgggtaacaaatgtgatatgaatgacaaaagacaagtgtcaaaagaaagaggggagaagctagcaattgactatgggattaavttcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttcwnatcgttgctcgctactttgatgaactctttctgagagactgcagcacacctagagggccctttcctgcttctctgaaagcacaggtcacccagcctcagaatcacacctcccggctgctgctgagagcac

SEQ ID NO: 3856 - DNA, 428 bp, Homo sapiens
  CDS 131..403
  misc_feature 345..346: n=a, g, c or t
gtgtggaaagagaatggtgacattggagaagagtcctgctgggtgcttgtaaaaggctcctctgtctgcaaggcagctgagctgcttagaagcagggcatgggcagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaanngtgaaaataacagaaaaccgatcaaagaagaccagtttctttcgttgctcgctactttgatgaactctttctgagagactgc

SEQ ID NO: 3857 - DNA, 428 bp, Homo sapiens
  CDS 131..403
  misc_feature 345: n=a, g, c or t
gtgtggaaagagaatggtgacattggagaagagtcctgctgggtgcttgtaaaaggctcctctgtctgcaaggcagctgagctgcttagaagcagggcatgggcagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaanagtgaaaataacagaaaaccgatcaaagaagaccagtttctttcgttgctcgctactttgatgaactctttctgagagactgc

SEQ ID NO: 3858 - DNA, 516 bp, Homo sapiens
  CDS 131..403
gtgtggaaagagaatggtgacattggagaagagtcctgctgggtgcttgtaaaaggctcctctgtctgcaaggcagctgagctgcttagaagcagggcatgggcagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcac

SEQ ID NO: 3859 - DNA, 515 bp, Homo sapiens
  CDS 129..416
  misc_feature 345..348,350: n=a, g, c or t
gtgtggaaagagaatggtgacattggagaagagtcctgctgggtgcttgtaaaaggctcctctgtctgcaaggcagctgagctgttagaagcagggcatgggcagcatgctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggwggacccnnnnrnrataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcac

SEQ ID NO: 3860 - DNA, 468 bp, Homo sapiens
  CDS 134..379
aaaaattgaaaggtattttaggcagaaagtacagcatgtgatttgtttatttggaaactgcaaatggtttggaacattaacagtagagtttgagagagtttgttaatgatctttgagaaaacatttgtacgaaatggcaaggacccctgacttaagtcatttctgggaattgctagtagaactgcagaagaaaaggaggttaacaaaattagtaaaaagagaccgggcgcggtggctcacgcctgtaatcctagcactttggaggccgaggcaggccgatcacctgaggtcaagagttcgagaccagcctggccaacttggtgaaacctcgtctctactawyagtacaaaaattagctgggcgtggtggcatgcacctgtagtcccagctactcaggaggctgaggcaggagaatcgcttgaacctgggaggtggaggtcacagtgagctgagactctgcctcaaaaa

SEQ ID NO: 3861 - DNA, 425 bp, Homo sapiens
  CDS 99..356
tttttttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaagggctagacaggattgaggagagactgcctattctgaatcagccatcaactcagattgttgccaatgccaaaa

SEQ ID NO: 3862 - DNA, 508 bp, Homo sapiens
  CDS 140..421
agtccgcgagtgtgaagaacggaccagatgggtccagcagtgctgggtcaaggcgaggagggggcagccggaagcgcgcgcatgctctggactcctgcagccgccgaaacggscaatcgtgtttaaggagaaactaacaatgaaaacggactcgttgatggaggaaaagttggaatgcagcctctggtgctgtttgarcgatccctctaccccgggtcgctgctgtgttctggaaaggcgcattgtaccctggatgcagcaggaatcctattcatcttcttcaccgatatggtctgtggactctgatgagccaaatctgacatcagttctggaacgtctagaagatactaaggacaacagttcggtaaggaaagaaaccaagctattttctcttttcctcatgaacattatatttagaaattaaatgttaaatgataatattatataaaaacatgattaataactataatcttagaggaattaaagtctgggtattttaagtcctcca

SEQ ID NO: 3863 - DNA, 251 bp, Homo sapiens
  CDS 17..166
ttgctgttttaaaaagatggaaggttgtggaggaattgtgtcttgtaaatttgaaagctcttacttacctttcaattctcttcattcctctctacctttaaacaaacaaaataacacaaaaacacaaaaaacaaaaactgtatttgccttgggaagaagaacaacttaagtactcaggtcaaaacgtgatctaaagaagaggagaaaccctgtctctactaaaaatacagaattagatgggcatagtggck

SEQ ID NO: 3864 - DNA, 513 bp, Homo sapiens
  CDS 11..220
gaaaaatgcaatgggcatgtgggatgaagaggtggggaagggtactggggcagagagatgccgatcgatagaaacagcgaggagagacggagagagaccagagactcaagggcaaagagagacgaaggaccggcgggaggaagagagagagagacagagagacagactcacagactgggaggaccggagactcgacgcgaggagagacagtgaaaataagtgaacaaacatagagacacgggtccaagttataagagggctgagtggatcagagggtcagggccgggcaaacaggtgtcagaacagttagcaagagagaggcagatcagaaagggatgcagatgaaagagacacaaagaaggaaacgcagaatgggttcacagagacaagaaatgcagatatccagactcaagaggtagacaagaagggagagggacagaaacaagaagggagaaaagggacagaaattagagatacagtaagatggattgacagttttcgaagacctagaga

SEQ ID NO: 3865 - DNA, 495 bp, Homo sapiens
  CDS 100..264
aaaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccaggtgacatgactctcccgaacgttattttgatgtattttcagtgtagatttctcatattgattttcttttttccgctcttcagtcacccggagaaggcatgtgatcaaaacctcttggtgacattttttctaggccacaaagtaaggcaaaataacaaaatgattttgtaacttacctgacaagagaaaacatattggcgtttttttctcaatactgaattaaatagctgtag

SEQ ID NO: 3866 - DNA, 470 bp, Homo sapiens
  CDS 273..428
caagaaatgttagtctctatcatctttcataagcactaatagcaattttaaatggtatttcataataggaatttaagatttctccttgctgacattgataagaaaaaaaaaactttaccacagaattacattgtgcctttactttcctagcatgtctatgtgcctgacagaaggtcagtgccagctggcctgactttacagtctgttagtccccagagcctccaagggaaaacggtgagtaatatctttatttaccataccatgttttatttatgtgctgcacaggaaggtacatatctaacataatttttaagtttgaattttcagaggttctcccaaagaaaaaacattactgcttttgtgcaagagatgctcatcagaatttgaaatcatgtagccatttcagtgttttagtggataccttttcctaagtgtctgactggccaaataaaagattatattttgaaact

SEQ ID NO: 3867 - DNA, 482 bp, Homo sapiens
  CDS 115..348
attcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcmstcccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccggtccattcttcagtgtctctgttttttaaaacctgcgacasttgattcctaaaaaawaaaaagaa

SEQ ID NO: 3868 - DNA, 500 bp, Homo sapiens
  CDS 281..445
cacttttcagatcagtgtttgaaatggcaattatcagtgttggatttagttccaactacttgatttacaaaaatgtacatttagagaaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctcctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaakgtgggcggatcacctgatgtcaggggttc

SEQ ID NO: 3869 - DNA, 489 bp, Homo sapiens
  CDS 240..440
ctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaatgaactcattggtgttatttcttggacatcttggccttttaatcaaagactgtgtgctgctatttgctatgagcaaggtttctcaaaagcaaaaggtgcttggaccatttggatcacctgagttagaatctctaggtatagggcccaagtatctgcattttcacaggtttcttgtaggtgactttctgcaagctaaagtatgagaaccattggcttggatgtagttctaaacttttaggtctgtaaatc

SEQ ID NO: 3870 - DNA, 503 bp, Homo sapiens
  CDS 274..492
aatggattaataagcacagccaggtacccgcacaaggcacttgctggcaatggcaggaggcggacgtggggtgtcgtgaatagatttggagtccagccttccacacctgatcttatacaccagcctcgctttacatcatgctgcaaaatcctcagactgggaaagaataagtgtccccgcaaaactgcagcacaaaagaatttcagatccacccactcagaagtctgaagccagtgtggctcgccctcactgatctcagggtctgcatttgcaatgtaccaagacagacctgatcataaaaccaataacaaagaatgtcagaagtcttttacatggaagaagaaaaaaatgcgagcaagaaggcctaagaaaggagaggtttcaatagatggtacactcggttgttcccttagaccacctttgttagtcttcgcctcaaagaaaaacatttccactgaaaaccacataatctggtttaacagattaaatatataaactatgaa

SEQ ID NO: 3871 - DNA, 298 bp, Homo sapiens
  CDS 12..170
acttgctggcaatggcaggaggcggacgtggggggtcgtgcaataggtactggagggagagacgtgggcacaaaggtcgcgggaggaacaggtgcccacaatggctgcagatctgcccgtggatcactgaagattcctgctctcctgctgaggtggagactgcagtgagctgagawcgcaccattgcactccagcctgggcaacgagtgcaaaactcagtctccagataaaaaaaaagaaasdaaaaaaaaaaaaaaaaaaaaaaaaaaaaaaaaaaaaaaaaaaaaaaaaaaaaaar

SEQ ID NO: 3872 - DNA, 480 bp, Homo sapiens
  CDS 240..440
ctataacattaccgcagaaattttggttctatgtagcatggacctcctaaggaattctgtttcttttagcattgagatccctggtgctctttttttacctcagaattggtacaatmattattaaacgttaatttatttcaaactttttaattgaaaaaaggaaagggaaacttaattggggataaattcaggcatcatattattatgawagagtctcctgagtggttcgtctataggtaatgaactcattggtgttatttcttggacatcttggccttttaatcaaagactgtgtgctgctatttgctatgagcarggtttctcaaaagcaaaaggtgcttggaccatttggatcacctgagttagaatctctaggtatagggcccaagtatctgcattttcacaggtttcttgtaggtgactttctgcaagctaaagtatgagaaccattggctyggatgtagtctaacttttaggctg

SEQ ID NO: 3873 - DNA, 523 bp, Homo sapiens
  CDS 62..364
agaaaagtaaacttccctttccaagaagcaagatacatattccttttgatggaagttttttatggccaagtctcaacctctttgtgattctacctgttccttctggagctctgcatggctggcttctggaaggccatcagctgtgatctcacctggacccaaaactacagctcccactcactgcccatcatatgagccactgaaagtcctggcgtggtgttggaggagctgtttcctgattgcagagtatctagaatggaaggcctgtcgtgatgggattttgttggcaggttgtcttccagatggctatgaagacaattttgctttatgctgcccaattctggttgcttcctctcctaggaaatgagagccttcatggtggacatggccttaaagaccaacactttgttttatggctaaaaagatggacatacagatcggtgaaatgcctacaaaactagaatgctacccaggcccagaggcagctgtctgaacataaccatggagaggagagtttcccctt

SEQ ID NO: 3874 - DNA, 613 bp, Homo sapiens
  CDS 276..440
  misc_feature 18: n=a, g, c or t
attgataggcgggatwknggagggggattccagcccccctggaccggccggagtttattctagagttactggcgggtagctgtgcttttctttcccgtttgtaggtgaaacccattggcttcattggctccttgatttaaaccacgcccggctttctgccctctttgctgctctgggccaggttgcccagccatatcccagccccgtctgcagggagccggakgctgctgctgctattgtgtggatgccgcgcgtstcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcaggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgckgagacctatggtgtcagaaccaccgacatcttttcagac

SEQ ID NO: 3875 - DNA, 501 bp, Homo sapiens
  CDS 4..255
tacatgcatctgtttgagtccttgctttcaattctttggggtatatacccaggagtggaattgctggatcatatggtaactccatatttaatctttgaggaactgccagattgttttccacagtggccacatcattttacattttcctcaacaatgcacaaggttccagtttctctacatcctcaccaacacttgctattttcatatcctaatggctgcaaattggtagcttatgggtttttatttgcatttacctaaataaagcctaattaaaacatcagacaagtggccgggtgcggtggctcacgccggtaatcccagcactttgggaggctgaggcgggcagatcacgaggtcaggagaccgagaccatcctggctaacgcggtgaaaccccgtctctactaaaaatacaaaaattagctgggcctgcttgtggtgggcacctgtagtccccggctactcggaaggctgaggcaggagaatgatgtgaacccaggar

SEQ ID NO: 3876 - DNA, 497 bp, Homo sapiens
  CDS 23..232
cacatagaaaactcgagatgacatggggattatttttctcaggtttcacagactgcggtctgggttggctttcaggattggtttggagaagggtccatctgctgggtgggcaggtgtattccttcccatgtgctccgtgcctctccacacccctccactgtggtcaagatgcattgtagaaatcctacctcaaggctgggtgcagtggctcacgcctgtaatcccagtactttaggaggccgaggcgggcagatcacctgaggtcaggagttcaagaccatcctggccaacatggtgaaaccacgtctctactaaaaatataaaaattagctgggcgtggtggtgggtgcctataatctcagctacttgggaggctgaggtgggagaatcgcttgaacctgagaggcggaggttgcagtgagctgagatcgtgccactgcactcctgcctgagcaacagagcgagactycgtcccaaaaaaaaamamamaaaaagct

SEQ ID NO: 3877 - DNA, 453 bp, Homo sapiens
  CDS 147..359
tgctgccaccgccatctaacgctgcgccctggaggcccggcgcgcggatggtgccggtgcggctcgggtgttgaaacgggtgtcccctccccctmmtsccctcccccacgcggtggtctcccctcccacccggctcaggcagagccatgtctmggggtggctcctacccacacctgttgwrggacgtgaggaaaaggtccctcgggctggaggacccgtcccggctgcggagtcgmtacctgggaagaagagaatttatccarrgattaaaacttgaagcaacccttaatgtgcatgatggttgwgttaatacaatctgktggaatgacactggagaatatatttctatmtggctcagatgacaccaaattagtaattagtaatccttacagcagaaaggtaaagtagctkaaaaaatctgtaattyaatgaaaaawamhaawwrraaaagct

SEQ ID NO: 3878 - DNA, 505 bp, Homo sapiens
  CDS 111..335
taaatttctttagagtaaatacctcggaataagattgttgggtcatatgattatgtttaaccatctgagaaactgccagactgttttccaaagtggctgcacaattttacatgcccaccagcagtgaattaaaggttctgacttttctccttcctcatcaatacttgttattttctgactttttgatgatagtcatactagtgggtgtgaaatggtatctcattgtggttttgatttgcatttctttgatggctaatgatgttgaaccatcttttcatgtgtctcctggccacctgtgtatctttggcgaagtattcagatcatttgcccattattaaattgagttatctgattattattgagttgtaagagttctgkatatattctagatacaattctctgtctgatacctggtctacaaatattttcatctattttgcgtgttgtccttttactttttttgggggagacggagttgcgctcttttttgagatcacgctactgs

SEQ ID NO: 3879 - DNA, 489 bp, Homo sapiens
  CDS 281..463
  misc_feature 159..160: n=a, g, c or t
attcgcaggacggcagcagctaccggcgcccctggagcagcagcagcctcaccacatcccgaccagtgccccggtttaccagcagccccagcagcagccggtggcccagtcctatggtggctacaaggagcctgcagccccagtctccatacagcgcanncccaggtggtggcgggaagcggtaccgscggtgtatgactacagcgccgccgasgaggacgaggtctccttccaggacggggacaccatcgtcaacgtgcagcagatcgacgacggctggatgtacggkacggtggagcgcaccggcgacacggggatgctgccggccaactacgtgaggccatctgaacccgcagcgcccccatctgtcttcagcacattccacggcatcgcatccgtcctgggcgtgacccggtccattcttcagtgtctctgttttttaaaacctgcgacasttgattcctaaaaaawaaaaagaargtrgaccra

SEQ ID NO: 3880 - DNA, 707 bp, Homo sapiens
  CDS 364..624
aatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgtgaaaccccattggcttcattggctccttgatttaaaccacgcccggctttctgccctctttgctgctgctgggccaggttgcccagccatatcccagccccgtctgcagggagccggagbgctggctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtgggactggatcatcctgcagtgcgccgaggacatagagcacccgccccccggcaggcccattttcagaaatggttaatggacgggasggtcctgtgcaagctgataaatagtttatacccaccaggacaagagcccatacccaagatctcagagtcaaaagatggcttttaagcagatgggaggcaaatctcccagttcctaaaaagctgctgagacctatggtgktcagaaccaccgacatcttttcagac

SEQ ID NO: 3881 - DNA, 459 bp, Homo sapiens
  CDS 82..249
gcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcwkaaagattatttttgctgattaaaaagcagttwmcacttattattkkcttctgtaagtaaaggakgtaggaaaagtaattggaattgctattatgaaacactttggatggaaagcagacttgaggaatccacaattagagatctttatacatctaaatgacatttactctgyggtggggattcctgtgttcavggtttccctarccagcakagcttacatcaagacagctggactgcgatctacaatagcgtgggcaatggcatctc

SEQ ID NO: 3882 - DNA, 485 bp, Homo sapiens
  CDS 25..480
  misc_feature 252: n=a, g, c or t
aagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccagytggggtgtcccagaagagccaggaatcgaaatgcttcatggaacaaccaccctggccttcaaggctctactacgtggacagtgaagggaaccgnatttcagtggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctggatctacatgaga

SEQ ID NO: 3883 - DNA, 231 bp, Homo sapiens
  CDS 24..197
tactactagtctccttgaagtatatgttgtcgcccacattttgctgcagttcacttttaattcctaagaaggttgttttcacttggtgtttttttaatctcttaagaatgaatagtaggaatattagtaccaacaccttaaactcatgtcacattttaatattcacagaacatctacacacacattatgttattaggtaaacaggtggtgacagcctgcattagttttaag

SEQ ID NO: 3884 - protein, 78 aa, Homo sapiens
  SIGNAL -26..-1
  UNSURE 6: Xaa = Ala,Asp,Val
MRGPSWSRPRPLLLLLLLLSPWPVWAHVSATXSPSGSLGAPDCPRGVHVRAGRPGQLLGTLAARRAPGPEPAPARRCC

SEQ ID NO: 3885 - protein, 101 aa, Homo sapiens
  SIGNAL -23..-1
  UNSURE 17: Xaa = Pro,Arg
  UNSURE 16: Xaa = Ser,Trp
MGVPRPQPWALGLLLFLLPGSLGAESHLSLLYHLTAVSXXAPGTPAFWVSGWLGPQQYLSYNSLRGEADLWSLGLGKPGVLVLGERDHRSEDQGEALSGSF

SEQ ID NO: 3886 - protein, 161 aa, Homo sapiens
  SIGNAL -25..-1
MSDLLLLGLIGGLTLLLLLTLLAFAGYSGLLAGVEVSAGSPPIRNVTVAYKFHMGLYGETGRLFTESCISPKLRSIAVYYDNPHMVPPDKCRCAVGSILSEGEESPSPELIDLYQKFGFKVFSFPAPSHVVTATFPYTTILSIWLATRRVHPALDTYIKER

SEQ ID NO: 3887 - protein, 50 aa, Homo sapiens
  SIGNAL -20..-1
  UNSURE -10: Xaa = Leu,Gln
MEMFQGLLLLXLLSMGGTWASKEPLRPRCRPINATLAVEKEGCPVCITVN

SEQ ID NO: 3888 - protein, 155 aa, Homo sapiens
  SIGNAL -23..-1
MAAALWGFFPVLLLLLLSGDVQSSEVPGAAAEGSGGSGVGIGDRFKIEGRAVVPGVKPQDWISAARVLVDGEEHVGFLKTDGSFVVHDIPSGSYVVEVVSPAYRFDPVRVDITSKGKMRARYVNYIKTSEVVRLPYPLQMKSSGPPSYFIKRESW

SEQ ID NO: 3889 - protein, 76 aa, Homo sapiens
  SIGNAL -19..-1
MAPLRPLLILALLAWVALADQESCKGRCTEGFNVDKKCQCDELCSYYQSCCTDYTAECKPQVTRGDVFTMPEDEYT

SEQ ID NO: 3890 - protein, 67 aa, Homo sapiens
  SIGNAL -26..-1
  UNSURE 13: Xaa = Gly,Ser
  UNSURE 7: Xaa = Leu,Val
  UNSURE -24: Xaa = Pro,Arg
MLXPMALPSVSWMLLSCLILLCQVQGEETQKEXPSPRIXCPKGSKVRSISNSYSYIWIGLHDPTQCS

SEQ ID NO: 3891 - protein, 151 aa, Homo sapiens
  SIGNAL -22..-1
  UNSURE 13: Xaa = Cys,Gly,Arg
MAVKLGTLLLALALGLAQPASARRKLLVFLLDGFXSDYISDEALESLPGFKEIVSRGVKVDYLTPDFPSLSYPNYYTLMTGRHCEVHQMIGNYMWDPTTNKSFDIGVNKDSLMPLWWNGSEPLWVTLTKAKRKVYMYYWPGECVNIHSKSQ

SEQ ID NO: 3892 - protein, 137 aa, Homo sapiens
  SIGNAL -28..-1
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVN

SEQ ID NO: 3893 - protein, 107 aa, Homo sapiens
  SIGNAL -21..-1
  UNSURE 9: Xaa = Leu,Trp
MGTQEGWCLLLCLALSGAAETKPHPAEGQXRAVDVVLDCFLAKDGAHRGALASSEDRARASLVLKQVPVLDDGSLEDFTDFQGGTLAQDDPPIIFEASVDLVQIPQA

SEQ ID NO: 3894 - protein, 55 aa, Homo sapiens
  SIGNAL -20..-1
  UNSURE 18: Xaa = Arg,Thr
  UNSURE 19: Xaa = Asn,Ser
  UNSURE 12: Xaa = Asp,Glu
  UNSURE 9: Xaa = Gly,Ser
  UNSURE -5: Xaa = His,Asn
  UNSURE 11: Xaa = His,Pro
  UNSURE 26: Xaa = Lys,Asn
MLQGPGSLLLLFLASXCCLGSARGLFLFXQXXFSYKRXXCKPIPAXLQLCHGIEY

SEQ ID NO: 3895 - protein, 141 aa, Homo sapiens
  SIGNAL -20..-1
  UNSURE -5: Xaa = Cys,Ser
METLGALLVLEFLLLXPVEAQQATEHRLKPWLVGLAAVVGFLFIVYLVLLANRLWCSKARAEDEEETTFRMESNLYQDQSEDKREKKEAKEKEEKRKKEKKDSKGRREQTWDWIWRKKSPETMREQRAQSCEDSWLPLPGS

SEQ ID NO: 3896 - protein, 57 aa, Homo sapiens
  SIGNAL -18..-1
  UNSURE 2: Xaa = Ile,Ser
MAVVPLLLLGGLWSAVGASXLGVVTCGSVVKLLNTRHNVRLHSHDVRYGSGNAGDGL

SEQ ID NO: 3897 - protein, 149 aa, Homo sapiens
  SIGNAL -17..-1
MSSSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLN

SEQ ID NO: 3898 - protein, 138 aa, Homo sapiens
  SIGNAL -19..-1
  UNSURE 47: Xaa = Ala,Val
  UNSURE 19: Xaa = Cys,Tyr
  UNSURE 55: Xaa = Lys,Gln
  UNSURE 45: Xaa = Phe,Leu
  UNSURE 18: Xaa = Pro,Gln
MWTLKSSLVLLLCLTCSYAFMFSSLRQKTSEPQGKVXXGEHFRIRQNLPEHTQGWLGSKWLWLXFXVVPFVILXCQRDSEKNKEQSPPGLRGFPFRTPLKKNQNASLYKDCVFNTLNELEVELLKFVSEVQNLKGAMA

SEQ ID NO: 3899 - protein, 190 aa, Homo sapiens
  SIGNAL -16..-1
  UNSURE 30: Xaa = Lys,Asn
METFPLLLLSLGLVLAEASESTMKIIKEEFTDEEMQYDMAKSGQEXQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLE

SEQ ID NO: 3900 - protein, 73 aa, Homo sapiens
  SIGNAL -20..-1
MSRSVALAVLALLSLSGLEAIQRTPKIQVYSRHPAENGKSNFLNCYVSGFHPSDIEVDLLKNGERIEKVEHSD

SEQ ID NO: 3901 - protein, 120 aa, Homo sapiens
  SIGNAL -21..-1
  UNSURE 7: Xaa = Asp,Glu
  UNSURE -15: Xaa = Gly,Arg
MGCCTGXCSLICLCALQLVSALERQIFXFLGFQWAPILGNFLHIIVVILGLFGTIQYRPRYIMVYTVWTALWVTWNVFIICFYLEVGGLSKDTDLMTFNISVHRSWWREHGPGCVRRVLP

SEQ ID NO: 3902 - protein, 134 aa, Homo sapiens
  SIGNAL -22..-1
  UNSURE 96: Xaa = Ala,Gly
  UNSURE 54: Xaa = Arg,Trp
  UNSURE 52: Xaa = Cys,Trp
  UNSURE 105: Xaa = Gly,Arg
  UNSURE 101: Xaa = Gly,Ser
  UNSURE 28: Xaa = Pro,Thr
MHGSCSFLMLLLPLLLLLVATTGPVGALTDEEKRLMVELHNLYRAQVSPXASDMLHMRWDEELAAFAKAYARQXVXGHNKERGRRGENLFAITDEGMDVPLAMEEWHHEREHYNLSAXTCSPXQMCXHYTQVVW

SEQ ID NO: 3903 - protein, 153 aa, Homo sapiens
  SIGNAL -17..-1
MALEVLMLLAVLIWTGAENLHVKISCSLDWLMVSVIPVAESRNLYIFADELHLGMGCPANRIHTYVYEFIYLVRDCGIRTRVVSEETLLFQTELYFTPRNIDHDPQEIHLECSTSRKSVWLTPVSTENEIKLDPSPFIADFQTTAEELGLLIF

SEQ ID NO: 3904 - protein, 74 aa, Homo sapiens
  SIGNAL -24..-1
MLPPLPSRLGLLLLLLLCPAHVGGLWWAVGSPLVMDPTSICRKARRLAGRQAELCQAEPEVVAELARGARLGVR

SEQ ID NO: 3905 - protein, 120 aa, Homo sapiens
  SIGNAL -15..-1
MKLLLWACIVCVAFARKRRFPFIGEDDNDDGHPLHPSLNIPYGIRNLPPPLYYRPVNTVPSYPGNTYTDTGLPSYPWILTSPGFPYVYHIRGFPLATQLNVPPLPPRGFRLSLLQGFFSA

SEQ ID NO: 3906 - protein, 158 aa, Homo sapiens
  SIGNAL -35..-1
  UNSURE 119: Xaa = Ala,Gly
MMRCCRRRCCCRQPPHALRPLLLLPLVLLPPLAAAAAGPNRCDTIYQGFAECLIRLGDSMGRGGELETICRSWNYFHACASQVLSGCPEEAAAVWESLQQEARQAPRPNNLHTLCGAPVHVRERGTGSETNQETLRATAPALPMAPAPPLLAAXLALA

SEQ ID NO: 3907 - protein, 142 aa, Homo sapiens
  SIGNAL -26..-1
MLSMLRTMTRLCFLLFFSVATSGCSAAASSLEMLSREFETCAFSFSSLPRSCKEIKERCHSAGDGLYFLRTKNGVVYQTFCDMTSGGGGWTLVASVHENDMRGKCTVGDRWSSQQGNKADYPEGDGNWANYNTFGSAEAATS

SEQ ID NO: 3908 - protein, 73 aa, Homo sapiens
  SIGNAL -21..-1
  UNSURE -18: Xaa = Ile,Leu
MGFXGTGTWILVLVLPIQAFPKPGGSQDKSLHNRELSAERPLNEQIAEAEEDKIKKTYPPENKPGQSNYSFVD

SEQ ID NO: 3909 - protein, 135 aa, Homo sapiens
  SIGNAL -30..-1
MAGGVRPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVR

SEQ ID NO: 3910 - protein, 119 aa, Homo sapiens
  SIGNAL -77..-1
  UNSURE -25: Xaa = Ala,Gly,Val
  UNSURE 16: Xaa = Ala,Pro
  UNSURE -17: Xaa = Arg,Ser
  UNSURE -30: Xaa = Asp,Glu,Lys,Asn
  UNSURE -16: Xaa = Asp,His,Asn,Tyr
  UNSURE 5: Xaa = Gly,Arg
  UNSURE -28: Xaa = Gly,Ser
  UNSURE -20: Xaa = Gly,Val
  UNSURE 9: Xaa = Lys,Arg
  UNSURE -32: Xaa = Phe,Ser
MERAEEPVVYQKLLPWEPSLESEEEVEEEETSEALVLNPRRHQDSXRXKXWPXARNLXPCXXSPAAAGCWLLPGCEAAPESXQVDXETLASVXLHPADTPTALAYTTTVPSSALQTAVS

SEQ ID NO: 3911 - protein, 100 aa, Homo sapiens [sequence omitted]

SEQ ID NO: 3912 - protein, 151 aa, Homo sapiens
  SIGNAL -23..-1
  UNSURE 78: Xaa = Cys,Tyr
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFXFSNEFSTFSHKTVYFDFQVGDEPPILPDMGNRVTALTQMESACVTIHEAL

SEQ ID NO: 3913 - protein, 136 aa, Homo sapiens
  SIGNAL -22..-1
MTSKFILVSFILAALSLSTTFSLQPDQQKVLLVSFDGFRWDYLYKVPTPHFHYIMKYGVHVKQVTNVFITKTYPNHYTLVTGLFAENHGIVANDMFDPIRNKSFSLDHMNIYDSKFWEEATPIWITNQRAGHTSGA

SEQ ID NO: 3914 - protein, 159 aa, Homo sapiens
  SIGNAL -18..-1
  UNSURE 83: Xaa = Arg,Trp
MGLPGLFCLAVLAASSFSKAREEEITPVVSIAYKVLEVFPKGRWVLITCCAPQPPPPITYSLCGTKNIKVAKKVVKTHEPASFNLNVTLKSSPDLLTYFCXASSTSGAHVDSARLQMHWELWSKPVSELRANFTLQDRGAGPRVEMICQASSGSPPITN

SEQ ID NO: 3915 - protein, 95 aa, Homo sapiens
  SIGNAL -18..-1
  UNSURE 59: Xaa = Ala,Thr
  UNSURE 56: Xaa = Arg,Ser
  UNSURE 54: Xaa = His,Pro
MKAPGRLVLIILCSVVFSAVYILLCCWAGLPLCLATCLDHHFPTGSRPTVPGPLHFSGYSSVPDGKPLVREXCXSCXVVSSSGQMLGSGLGAEID

SEQ ID NO: 3916 - protein, 70 aa, Homo sapiens
  SIGNAL -40..-1
MRHSSDSFFSICAVFLCDVNPSLSIMSCLHLLLLLQIALSHKRKPLWWPEQPCSWNVLVLFTAATVATGQ

SEQ ID NO: 3917 - protein, 151 aa, Homo sapiens
  SIGNAL -19..-1
MEGESTSAVLSGFVLGALAFQHLNTDSDTEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEH

SEQ ID NO: 3918 - protein, 76 aa, Homo sapiens
  SIGNAL -19..-1
  UNSURE 9: Xaa = Ala,Pro
  UNSURE -14: Xaa = Ala,Ser
  UNSURE 36: Xaa = Phe,Ser
  UNSURE 24: Xaa = Phe,Val
MPHSLXSALLLATCSPSNSFTHTQSRPXPSQPALELSLVWICXVASSPHLTGTFXKNLRTKVFRLQLGMVIWLCPH

SEQ ID NO: 3919 - protein, 63 aa, Homo sapiens
  SIGNAL -31..-1
MVGGREKNLLRELFFSFLFFTLLGFLFCCCCCCFLLAGHTQRSKFVLKRNEKKQKKNKKKKKK

SEQ ID NO: 3920 - protein, 63 aa, Homo sapiens
  SIGNAL -31..-1
  UNSURE -20: Xaa = Asp,Glu
MVGGREKNLLRXLFFSFLFFTLLGFLFCCCCCCFLLAGHTQRSKFVLKRNEKKQKKNKKKKKK

SEQ ID NO: 3921 - protein, 81 aa, Homo sapiens
  SIGNAL -19..-1
  UNSURE 48: Xaa = Ala,Pro
  UNSURE 28: Xaa = Cys,Trp
MRALLLLGFLLVSLESTLSIPPWEAPKEHKYKAEEHTVVLTVTGEPXHFPFQYHRQLYHKCTHKGRXGPQPWCATTPNFDQ

SEQ ID NO: 3922 - protein, 70 aa, Homo sapiens
  SIGNAL -28..-1
  UNSURE -25: Xaa = Leu,Pro
MSAXGVTVALLVWAAFLLLVSMWRQVHSSWNLPPGPFPLPIIGNLFQLELKNIPKSFTRLAQRFGPVFTL

SEQ ID NO: 3923 - protein, 63 aa, Homo sapiens
  SIGNAL -26..-1
  UNSURE 8: Xaa = Ala,Asp
  UNSURE 7: Xaa = Ala,Val
  UNSURE -15: Xaa = His,Asn
  UNSURE 27: Xaa = Leu,Arg
MATPLPPPSPRXLRLLRLLLSGLVLGAALRGAXXGHPDVAACPGSLDCALKRXARCPPGAHAC

SEQ ID NO: 3924 - protein, 81 aa, Homo sapiens
  SIGNAL -28..-1
MSALGVTVALLVWAAFLLLVSMWRQVHSSWNLPPGPFPLPIIGNLFQLELKNIPKSFTRLAQRFGPVFTLYVGSQRMVVMH

SEQ ID NO: 3925 - protein, 56 aa, Homo sapiens
  SIGNAL -41..-1
MGNCQPSERPSPSAGGSMAVSQGDGTLCFVLLLCCWQETELRPRTVIPGSPTEIPF

SEQ ID NO: 3926 - protein, 112 aa, Homo sapiens
  SIGNAL -22..-1
MKVLISSLLLLLPLMLMSMVSSSLNPGVARGHRDRGQASRRWLQEGGQECECKDWFLRAPRRKFMTVSGLPKKQCPCDHFKGNVKKTRHQRHHRKPNKHSRACQQFLKQCQL

SEQ ID NO: 3927 - protein, 82 aa, Homo sapiens
  SIGNAL -32..-1
  UNSURE 35: Xaa = His,Gln
MAKMFDLRTKIMIGIGSSLLVAAMVLLSVVFCLYFKVAKALKAAKDPDAVAVKNHNPDKVCWATNSXAKATTMESCPSLQCC

SEQ ID NO: 3928 - protein, 69 aa, Homo sapiens
  SIGNAL -32..-1
MAKMFDLRTKIMIGIESSLLVAAMVLLSVVFCLYFKVAKALKAAKDPDAVAVKNHNPDKVCWATNSQAK

SEQ ID NO: 3929 - protein, 124 aa, Homo sapiens
  SIGNAL -16..-1
  UNSURE 50: Xaa = Ala,Thr
  UNSURE 101: Xaa = Pro,Thr
MRPAFALCLLWQALWPGPGGGEHPTADRAGCSASGACYSLHHATMKRQAAEEACILRGGALSTVRXGAELRAVLALLRAGPGPGGAPKTCCSGSHWSAGVPTAPWRTSLCGVSPGCXPTPAVSK

SEQ ID NO: 3930 - protein, 52 aa, Homo sapiens
  SIGNAL -49..-1
MDSPISWVASAKAPETSPTAHARGRVLESGPLRPGASLRFCLLVSLITAATR

SEQ ID NO: 3931 - protein, 62 aa, Homo sapiens
  SIGNAL -25..-1
  UNSURE 35: Xaa = Asp,Glu
MVPMHLLGRLEKPLLLLCCASFLLGLALLGIKTDITPVAYFFLTLGGFFLFAYLLVRFLXWG

SEQ ID NO: 3932 - protein, 141 aa, Homo sapiens
  SIGNAL -19..-1
MRLQGAIFVLLPHLGPSWSGCSLVITCLVGVRARGCCPGAHSTKSYCLYRQPSTLSWAMLLPGVEGPGRGLGVAPGLPLGLYAVQLTISWTVLVLFFTVHNPGLALLHLLLLYGLVVSTALIWHPINKLAALLLLPYLAWL

SEQ ID NO: 3933 - protein, 77 aa, Homo sapiens
  SIGNAL -25..-1
  UNSURE 41,42: Xaa =  * ,Ile,Lys,Leu
  UNSURE 28: Xaa = Glu,Lys
MRLLQLLFRASPATLLLVLCLQLGANKAQDNTRKIIIKNFDIPKNYQKKKKKXKKKKKKKKKKKKXXKKKKKKKKKK

SEQ ID NO: 3934 - protein, 111 aa, Homo sapiens
  SIGNAL -50..-1
  UNSURE 26: Xaa = Lys,Asn
MCWVINHAILPRMRMHSKRQTITRHSASLSFHALPRSAFLQLCLLRQIHQIPCLSIFSSTLRAQTHDSGIGCTTAXQAGDGRSSSGNQGKLACPRRCSRGAVRKDGLASKK

SEQ ID NO: 3935 - protein, 112 aa, Homo sapiens
  SIGNAL -50..-1
  UNSURE 26: Xaa = Lys,Asn
MCWVINHAILPRMRMHSKRQTITRHSASLSFHALPRSAFLQLCLLRQIHQIPCLSIFSSTLRAQTHDSGIGCTTAXQAGDGRSSSGNQGKLACPRRCSRGAVRKDGLASKKK

SEQ ID NO: 3936 - protein, 79 aa, Homo sapiens
  SIGNAL -18..-1
MALRHLALLAGLLVGVASKSMENTAQLPECCVDVVGVNASCPGASLCGPGCYRRWNADGSASCVRCGNGTLPAYNGSEC

SEQ ID NO: 3937 - protein, 88 aa, Homo sapiens
  SIGNAL -41..-1
  UNSURE 24: Xaa = Asp,Glu,Gly
METVQELIPLAKEMMAQKRKGKMVKLYVLGSVLALFGVVLGLMETVCSPFTAARRLRDQEAAVAXCRPPWSDRLSRSKPCRRKASSRT

SEQ ID NO: 3938 - protein, 177 aa, Homo sapiens
  SIGNAL -32..-1
MAAPRLGALPLCLLLPPRPLLGAVSLSPLARPFPPQPPLPCLSRCRANCWSLLRCCTLSLTISSCPPPPPLPRNAKSRRPKEKREKERRRHGLGGAREAGGASREENGEVKPLPRDKIKDKIKERDKEKEREKKKHKVMNEIKKENGEVKILLKSGKEKPKTNIEDLQIKKAKKKKK

SEQ ID NO: 3939 - protein, 92 aa, Homo sapiens
  SIGNAL -41..-1
  UNSURE 24: Xaa =  * ,Asp,Glu,His,Lys,Asn,Gln,Tyr
METVQELIPLAKEMMAQKRKGKMVKLYVLGSVLALFGVVLGLMETVCSPFTAARRLRDQEAAVAXCRPPWSDRLSRSKPCRRKASSRTRSSA

SEQ ID NO: 3940 - protein, 65 aa, Homo sapiens
  SIGNAL -40..-1
  UNSURE 1: Xaa = Lys,Met,Arg,Thr
MGFLVPLQGRVSGRCSLSCLGGAGAGTLAALLYLLDPAVSXPTSSHWASFPAEIHALRRVKKKKK

SEQ ID NO: 3941 - protein, 59 aa, Homo sapiens
  SIGNAL -18..-1
  UNSURE 41: Xaa = Arg,Ser
MRHLGAFLFLLGVLGALTEMCEIPEMDSHLVEKLGQHLLPWMDRLSLEHLNPSIYVGLX

SEQ ID NO: 3942 - protein, 183 aa, Homo sapiens
  SIGNAL -32..-1
  UNSURE 46: Xaa = Phe,Leu
MASPKGFFNYLTYFLAAGAVTLGIGFFALASALWFLICKRREIFQNSKFKAIDERCRQRPSMAKIKSHSQCVFISRNXHTGRFQLQEEQRKKEAAHIKAIKDHSKDEPQLATKNIICDPSETSSTTNRSSVTLSLSTLPSDSYYSQSIEAADDWFSDDSLVKRNSPMPSLGEPLMEKVFSYLS

SEQ ID NO: 3943 - protein, 60 aa, Homo sapiens
  SIGNAL -19..-1
MKILVALAVFFLVSTQLFAEEIGANDDLNYWSDWYDSDQIKEELPEPFEHLLQRIARRPK

SEQ ID NO: 3944 - protein, 55 aa, Homo sapiens
  SIGNAL -25..-1
  UNSURE 22: Xaa = Pro,Thr
MLRMGIHIPDRRWCLILCATCGSHGTHRDCSSLRSNSKKWECEECSXAAATDYIP

SEQ ID NO: 3945 - protein, 60 aa, Homo sapiens
  SIGNAL -43..-1
MRIGAAIIWLGFSSMASPLPPLQDAFSLKSIWMLVLAAMEILAFEPLHTFRGKKREVCEL

SEQ ID NO: 3946 - protein, 72 aa, Homo sapiens [sequence omitted]

SEQ ID NO: 3947 - protein, 151 aa, Homo sapiens
  SIGNAL -16..-1
MPPFLLLTCLFITGTSVSPVALDPCSAYISLNEPWRNTDHQLDESQGPPLCDNHVNGEWYHFTGMAGDAMPTFCIPENHCGTHAPVWLNGSHPLEGDGIVQRQACASFNGNCCLWNTTVEVKACPGGYYVYRLTKPSVCFHVYCGHFYGIL

SEQ ID NO: 3948 - protein, 83 aa, Homo sapiens
  SIGNAL -73..-1
  UNSURE -28: Xaa = Ala,Pro
  UNSURE -72: Xaa = Asn,Ser
  UNSURE -39: Xaa = Cys,Gly,Arg,Ser
  UNSURE -22,-8: Xaa = His,Pro
MXETGRQQQQRRAAQATAEPLRQRRRRQHQQRERXATLARRGDRRXPSRLLXSSAARSSLGIHLLXLLLLIHSFPHSPLLLGF

SEQ ID NO: 3949 - protein, 88 aa, Homo sapiens
  SIGNAL -37..-1
  UNSURE 10: Xaa = Arg,Thr
MCHHAWLIFVFLVETEFRHVDQAGLELLGSSSPPTLASQNVGITGVXPHPANIFERHILKDCYQLEWWLVSVIPALWEAKMRGSLSSG

SEQ ID NO: 3950 - protein, 65 aa, Homo sapiens
  SIGNAL -33..-1
  UNSURE 27: Xaa = Ala,Glu,Gly,Pro,Gln,Arg
MPPCLANFCVFSKDHVGQAGLKLLTSGVPPASASQSAGITGMSHCARPRLPLSKNRIFKXFCGYI

SEQ ID NO: 3951 - protein, 72 aa, Homo sapiens [sequence omitted]

SEQ ID NO: 3952 - protein, 141 aa, Homo sapiens
  SIGNAL -27..-1
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDINKQINDKERVAA

SEQ ID NO: 3953 - protein, 86 aa, Homo sapiens
  SIGNAL -20..-1
MGACLGACSLLSCASCLCGSAPCILCSCCPASRNSTVSRLIFTFFLFLGVLVSIIMLSPGVESQLYKLPWVCEEGAGIPTVLQGHI

SEQ ID NO: 3954 - protein, 108 aa, Homo sapiens
  SIGNAL -50..-1
MESSSRNNTRPVRPPLHWKTAPGRFCRSVPLTEFRLSAWSVVLWSPRTQAACMCLRPHGPTRGLRAVPGDPRGLLGVDSEAAAGLGSGAGPAHGDPSTSPGHQPEPLR

SEQ ID NO: 3955 - protein, 95 aa, Homo sapiens
  SIGNAL -87..-1
  UNSURE -28: Xaa = Leu,Pro
MAGYLKLVCVSFQRQGFHTVGSRCKNRTGAEHLWLTRHLRDPFVKAAKVKSYRCRSAFKXLEVNERHQILRPGLRVLDCGAAPGAWSQVAVQKVN

SEQ ID NO: 3956 - protein, 127 aa, Homo sapiens
  SIGNAL -56..-1
  UNSURE 21: Xaa = Ala,Asp,Gly,Val
  UNSURE 44: Xaa = Asp,His,Asn,Tyr
  UNSURE -39: Xaa = Ser,Thr
MRRRLSARCSPRGGKRRXALGGRQVRVALRRPPSEVFRLPPVRGLPLAGLLLPTLAAAQLSGDVARAVRGQGQETSXPPRACPPEPPPEHWEEDASWGPXRLAVLVPFRERFEELLVFVPHMRRFLS

SEQ ID NO: 3957 - protein, 148 aa, Homo sapiens
  SIGNAL -27..-1
  UNSURE 93: Xaa =  * ,Cys,Asp,Glu,Phe,Gly,Leu,Val,Trp,Tyr
  UNSURE 99: Xaa = Ala,Cys,Asp,Phe,Gly,His,Ile,Leu,Asn,Pro,Arg,Ser,Thr,Val,Tyr
  UNSURE 102: Xaa = Cys,Ser
  UNSURE 98: Xaa = Lys,Asn,Arg,Ser,Thr
MDPKLGRMAASLLAVLLLLLLERGMFSSPSPPPALLEKVFQYIDLHQDEFVQTLKEWVAIESDSVQPVPRFRQELFRMMAVAADTLQRLGARVASVDMGPQQLPDGQSLPIPPVILAELXSDPTXXTVXSTATWTCSLLTGAMGGSRT

SEQ ID NO: 3958 - protein, 125 aa, Homo sapiens
  SIGNAL -92..-1
MLFKQAELWMPHQGKGNKGEPPSALGLSTRKALSVLKEQLEAVLEGHLRERKKCLTWKEVWRSSFLHHSNRCSCFHWPGASLMLLAVLLLLGCCGGQPAGRCAPRGCSPTSQLCCPSCRGTWDRP

SEQ ID NO: 3959 - protein, 122 aa, Homo sapiens
  SIGNAL -23..-1
METRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSG

SEQ ID NO: 3960 - protein, 155 aa, Homo sapiens
  SIGNAL -50..-1
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFV

SEQ ID NO: 3961 - protein, 143 aa, Homo sapiens
  SIGNAL -39..-1
  UNSURE -5: Xaa = Ile,Thr
MGTADSDEMAPEAPQHTHIDVHIHQESALAKLLLXCCSALRPRATQARGSSRLLVASWVMQIVLGILSAVLGGFFYIRDYTLLVTSGAAIWTGAVAVLAGAAAFIYEKRGGTYWALLRTLLALAAFSTAIAALKLWNEDFPKW

SEQ ID NO: 3962 - protein, 59 aa, Homo sapiens
  SIGNAL -19..-1
  UNSURE 24: Xaa = Ile,Asn
MGRAWWLTPVILALREARADGSVELRNVRPAWAMWQNPASTKXTKTRWAWWHAPVVPAT

SEQ ID NO: 3963 - protein, 79 aa, Homo sapiens [sequence omitted]

SEQ ID NO: 3964 - protein, 95 aa, Homo sapiens [sequence omitted]

SEQ ID NO: 3965 - protein, 68 aa, Homo sapiens
  SIGNAL -19..-1
MGRAWWLTPVILALREARADGSVELRNVRPAWAMWQNPASTKNTKTRWAWWHAPVVPATGEAEVGGWL

SEQ ID NO: 3966 - protein, 107 aa, Homo sapiens
  SIGNAL -32..-1
MDSASNPTNLVSTSQRHRPLLSSCGLPPSTASAVRRLCSRGVLKGSNERRDMESFWKLNRSPGSDRYLESRDASRLSGRDPSSWTVEDVMQFVREADPQLGPHADLF

SEQ ID NO: 3967 - protein, 78 aa, Homo sapiens
  SIGNAL -23..-1
MCAMAPLWSPLCPSICMCSVSLACVRVRVSAYASTHWALGCSQGKFDLERLSSPWNQDFLSPPHPGPVPPWLSGYWGN

SEQ ID NO: 3968 - protein, 60 aa, Homo sapiens
  SIGNAL -24..-1
MEEGGNLGGLIKMVHLLVLSGAWGMQMWVTFVSGFLLFRSLPRHTFGLVQSKLFPFYFHI

SEQ ID NO: 3969 - protein, 119 aa, Homo sapiens
  SIGNAL -48..-1
MLFPGASIVPECWLLVLIQNLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLA

SEQ ID NO: 3970 - protein, 125 aa, Homo sapiens
  SIGNAL -20..-1
  UNSURE 16: Xaa = His,Tyr
MTVLEITLAVILTLLGLAILAILLTRWARRKQSEMXISRYSSEQSARLLDYEDGRGSRHAYSTQSERSKRDYTPSTNSLALSRSSIALPQGSMSSIKCLQTTEELPSRTAGAMSKFFFCPLILMC

SEQ ID NO: 3971 - protein, 156 aa, Homo sapiens
  SIGNAL -154..-1
MRLSVAAAISHGRVFRRMGLGPESRIHLLRNLLTGLVRHERIEAPWARVDEMRGYAEKLIDYGKLGDTNERAMRMADFWLTEKDLIPKLFQVLAPRYKDQTGGYTRMLQIPNRSLDRAKMAVIEYKGNCLPPLPLPRRDSHLTLLNQLLQGLRQDL

SEQ ID NO: 3972 - protein, 88 aa, Homo sapiens
  SIGNAL -36..-1
  UNSURE 7: Xaa = Arg,Thr
  UNSURE 24: Xaa = Asn,Thr
  UNSURE 30: Xaa = Ser,Thr
MELSDVTLIEGVGNEVMVVAGVVVLILALVLAWLSTYVADSGXTSSWALLCQQATHPSSXWGMWTXWWQAKATPSQLNSPIHQRVMMR

SEQ ID NO: 3973 - protein, 129 aa, Homo sapiens
  SIGNAL -114..-1
  UNSURE -103: Xaa = Ala,Gly
  UNSURE -18: Xaa = Cys,Ser
  UNSURE -74: Xaa = Gly,Arg
  UNSURE -70: Xaa = Phe,Leu
  UNSURE -33: Xaa = Pro,Arg
  UNSURE -104: Xaa = Ser,Trp
MAWRGWAQRGXXCGQAWGASVGGRSCEELTAVLTPPQLLGXRFNXFIQQKCGFRKAPRKVEPRRSDPGTSGEAYKRSALIPXVEETVFYPSPYPIRXLIKPLFFTVGFTGCAFGSAAIWQYESLKSRVQ

SEQ ID NO: 3974 - protein, 172 aa, Homo sapiens
  SIGNAL -16..-1
MAPLGTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRGAFY

SEQ ID NO: 3975 - protein, 74 aa, Homo sapiens
  SIGNAL -44..-1
  UNSURE 29: Xaa =  * ,Leu
MSLCWPIFVFLVEMGFRHVGQAGPELLASGDLLVLASQSSGITSVSHHTRPGGIKVFSIKNTVVWKDPVSKKXN

SEQ ID NO: 3976 - protein, 91 aa, Homo sapiens
  SIGNAL -45..-1
MLFTSSSNSPVQPTAAALSLYESSPWLNPMSPLLALGLFFSLLTLVPSLLESIGVQQDSMIIAHRTMGSSSHPASASYVAGTIDSYHHAQL

SEQ ID NO: 3977 - protein, 139 aa, Homo sapiens
  SIGNAL -49..-1
  UNSURE 80: Xaa = Arg,Ser
  UNSURE 18: Xaa = Ile,Leu
  UNSURE 78: Xaa = Ile,Lys,Asn
  UNSURE 64: Xaa = Phe,Ser
MGAAVFFGCTFVAFGPAFALFLITVAGDPLRVIILVAGAFFWLVSLLLASVVWFILVHVTDRSDARXQYGLLIFGAAVSVLLQEVFRFAYYKLLKKADEGLASLSEDGRSPIXIRQMAYVSGLSFGXIXGVFSVINIWL

SEQ ID NO: 3978 - protein, 51 aa, Homo sapiens
  SIGNAL -30..-1
MVHSWLAVASPPGLGQSSCLSLSSSLDCRCAPPQQANVFKKSCYRDGVSLV

SEQ ID NO: 3979 - protein, 84 aa, Homo sapiens
  SIGNAL -22..-1
MHFLFSEGSILSFSFLFFLGHGVSLLLPRLELNGAISAHCNFCLSGTCDSPASASQLLRRLRQNCLNLGGRGCSELRLHHCTAA

SEQ ID NO: 3980 - protein, 122 aa, Homo sapiens
  SIGNAL -18..-1
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHM

SEQ ID NO: 3981 - protein, 122 aa, Homo sapiens
  SIGNAL -68..-1
  UNSURE -2: Xaa =  * ,Cys,Trp
MRLQDRIATFFFPKGMMLTTAALMLFFLHLGIFIRDVHNFCITYHYDHMSFHYTVVLMFSQVISICXAAMGSLYAEMTENKYVCFSALTILSEWQEWEGARGSGELWNPEMWQGVAREGYWG

SEQ ID NO: 3982 - protein, 67 aa, Homo sapiens
  SIGNAL -15..-1
  UNSURE 46: Xaa = Ala,Ser
  UNSURE 23,27: Xaa = Asp,Gly
MRLILPVGLIATTLAIAPVRFDREKVFRVKPQDEKQAXIIKXLAKTNELDFWYPGATHHVXANMMVD

SEQ ID NO: 3983 - protein, 88 aa, Homo sapiens
  SIGNAL -24..-1
MGPLLLPAPSLLLLMHSPLPAAPGFPAPFQQPWNSSCHHPLVGHWDPLAQSWLLLTPSLDACPGTPSPLPLPCSFNRVNHVYCTGAVV

SEQ ID NO: 3984 - protein, 98 aa, Homo sapiens
  SIGNAL -51..-1
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSFHANN

SEQ ID NO: 3985 - protein, 97 aa, Homo sapiens
  SIGNAL -41..-1
  UNSURE -39: Xaa = Asp,Glu
  UNSURE 6: Xaa = Gln,Arg
MAXDTSPNMNDNILLPVRNNDQALGLTQCMLGCVSWFTCFACSLRTXAQQVLFNTCRCKLLCQKLMEKTGILLLCAFGFWMFSIHLPSKMKVWQDDS

SEQ ID NO: 3986 - protein, 115 aa, Homo sapiens
  SIGNAL -102..-1
MQTRFRRIFPWKDASTKRMPEFIHFSPLKPYKGREWEKAGSEHVLETHLLPVGHGQSEGERMVVSDFHFFVRDVLQHVDSMQKDYPGLPVFLLGHSMGGAIASSRPQRGGATSPA

SEQ ID NO: 3987 - protein, 140 aa, Homo sapiens
  SIGNAL -43..-1
  UNSURE 78: Xaa =  * ,Leu
  UNSURE -33: Xaa =  * ,Lys,Arg,Trp
  UNSURE 40: Xaa = Ala,Asp
  UNSURE 92: Xaa = Arg,Ser
  UNSURE -30,-28: Xaa = Glu,Val
  UNSURE 47: Xaa = Phe,Ser
  UNSURE 83: Xaa = Phe,Ser,Tyr
  UNSURE -18,46: Xaa = Pro,Thr
MTGPGAVRFSXVTXFXGLRPSRCPLXAFHQLLHCLSVSCPADAYTYFRLSAAPRGEKCGPPSRLHTRLRSSSNCAGVAKTRAXLLPALXXPASLTTLNTHKLGRTISGVSSHVSRTGNTKXNEASXLTSKISEFXWRNRQ

SEQ ID NO: 3988 - protein, 141 aa, Homo sapiens
  SIGNAL -104..-1
MASPRTVTIVALSVALGLFFVFMGTIKLTPRLSKDAYSEMKRAYKSYVRALPLLKKMGINSILLRKSIGALEVACGIVMTLVPGRPKDVANFFLLLLVLAVLFFHQLVGDPLKRYAHALVFGILLTCRLLIARKPEDRSSE

SEQ ID NO: 3989 - protein, 126 aa, Homo sapiens
  SIGNAL -44..-1
MHEEEIYTSLQWDSPAPDTYQKCLSSNKCSGACCLVMVISCVFCMGLLTASIFLGVKLLQVSTIAMQQQEKLIQQERALLNFTEWKRSCALQMKYCQAFMQNSLSSAHNSSPCPNNWIQNRESCYY

SEQ ID NO: 3990 - protein, 132 aa, Homo sapiens
  SIGNAL -52..-1
  UNSURE -35: Xaa = Asp,Tyr
MARTETKGRKKQRLLSAXKINTPNFFVSLRNINRGRARWLTPVILTLWGATAGGSSEVRSLRPACPTWRKPSLLKIQKLGRARWLTPVIPALWGAEAGGSPEVGGSRPVLPTWGSLVSTKNTKLAGRGGGCL

SEQ ID NO: 3991 - protein, 66 aa, Homo sapiens
  SIGNAL -48..-1
  UNSURE 6: Xaa = His,Pro,Ser,Tyr
  UNSURE 5: Xaa = Lys,Asn
MCFSTYLYEKISGENSTFCYLCVMIVLPGTFGLYYFLYFSVLLGYTHTLTQWXXNIYGELIYNTRL

SEQ ID NO: 3992 - protein, 118 aa, Homo sapiens
  SIGNAL -50..-1
  UNSURE -43: Xaa = Glu,Gln
  UNSURE 41: Xaa = Leu,Met,Val
MKEAGQMXNLESARAGRSVSTQTGSMTGQIPRLSKVNLFTLLSLWMELFPAEAQRQKSQKNEEGKHGPLGDNEERTRVSTDKRQVKRTGLXVVKNMKIVGLHCSSEDLHAGQIALIKH

SEQ ID NO: 3993 - protein, 100 aa, Homo sapiens
  SIGNAL -20..-1
  UNSURE 23: Xaa = Ala,Pro,Ser,Thr
  UNSURE 34: Xaa = Arg,Thr
  UNSURE 56: Xaa = Asp,Asn,Tyr
MSDLLSVFLHLLLLFKLVAPVTFRHHRYDDLVRTLYKVQNECXGITRVYSIGRXWRGDTSTCWSSATTLESTSPWXQRSSMWGNMHGNEALGRELMLQLS

SEQ ID NO: 3994 - protein, 67 aa, Homo sapiens
  SIGNAL -26..-1
MVKLVSTENTKNWLGMVVCACSPSYSGGRGRRIAWTREVEVAVSRDQATALQPGQQRETLSQKKKKK

SEQ ID NO: 3995 - protein, 143 aa, Homo sapiens
  SIGNAL -112..-1
  UNSURE -34: Xaa =  * ,Leu
  UNSURE -50: Xaa = Ala,Glu,Leu,Pro,Gln,Val
  UNSURE -23: Xaa = Asp,Glu,Gly
  UNSURE -63: Xaa = Gly,Arg
  UNSURE -93: Xaa = Gly,Leu,Met,Arg,Val,Trp
  UNSURE -106: Xaa = Leu,Trp
  UNSURE -64: Xaa = Phe,Leu
  UNSURE -96: Xaa = Pro,Gln
MVDNPEXVNSPNKMAGXMAXLLKKNRIECAHGIGYTRAEKECKIEYDDXXRVFASAENDETCXVPSGKQRDKLIKEGKXHPSTSPTLARXEPRALKQSRLLMSGRLIFPVLCSPLERLFYDKTSLVKVCKNKGIAPSLKKKKK

SEQ ID NO: 3996 - protein, 119 aa, Homo sapiens
  SIGNAL -34..-1
MSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRT

SEQ ID NO: 3997 - protein, 154 aa, Homo sapiens
  SIGNAL -15..-1
MNILMLTFIICGLLTRVTKGSFEPQKCWKNNVGHCRRRCLDTERYILLCRNKLSCCISIISHEYTRRPAFPVIHLEDITLDYSDVDSFTGSPVSMLNDLITFDTTKFGETMTPETNTPETTMPPSEATTPETTMPPSETATSETMPPPSQTALT

SEQ ID NO: 3998 - protein, 117 aa, Homo sapiens
  SIGNAL -45..-1
  UNSURE 45: Xaa = Lys,Arg
MVLMWTSGDAFKTAYFLLKGAPLQFSVCGLLQVLVDLAILGQAYAFAPPPEAGAPRRAPHWHQGPLTVGRTRMWDRQPRALVGPDLPAGXVGAVAPAGVAEMGHGHWGLPSASVGCL

SEQ ID NO: 3999 - protein, 129 aa, Homo sapiens
  SIGNAL -39..-1
  UNSURE 87: Xaa = Ala,Gly
  UNSURE 33: Xaa = Ile,Asn
  UNSURE 49,79: Xaa = Leu,Val
MMTITFLPYTFSLMVTFPDVPLGIFLFCVCVIAIGVVQALIVGYAFHFPHLLSPQIQRSAHRALYRRHVLGXVLQGPALCFAAAIFSXFFVPLSYLLMVTVILLPYVSKVTGWCRDRXLGHREPSXHPV

SEQ ID NO: 4000 - protein, 87 aa, Homo sapiens
  SIGNAL -64..-1
MAAAATLRLSAQGTVTFEDVAVNFTWEEWNLLSEAQRCLYRDVTLENLALISSLGMTFLHVCQALDSLRQVIHPPTSASQSAGITGV

SEQ ID NO: 4001 - protein, 55 aa, Homo sapiens
  SIGNAL -35..-1
  UNSURE 20: Xaa = Lys,Asn
MENSACVVSKNRPAISQTLRARLLLGKCGLRQSLCCILNTINIQGNLALLLKKKX

SEQ ID NO: 4002 - protein, 145 aa, Homo sapiens
  SIGNAL -22..-1
  UNSURE 84: Xaa = Ala,Pro,Ser,Thr
  UNSURE -1: Xaa = Ala,Ser
  UNSURE 21: Xaa = Cys,Phe,Ile,Asn,Ser,Thr,Tyr
  UNSURE 46: Xaa = Cys,Phe,Ser,Tyr
MGRWSLTASPVTLTSLLPMVTXGPAAGKSSSSTSWDTVLTAIXCASTVQLISTTLGASASGARMPTTXCSGTTVFLTALQDTMQREELVKNATPPAEPARAEDLSXAPHVTPTSCCPTLAPAAPPASLGTILMTIMFASVGFSNE

SEQ ID NO: 4003 - protein, 52 aa, Homo sapiens
  SIGNAL -16..-1
MGNSLSVFCSWFRSRSWPRHRQPARLVREAFPAGRAHPAAPAPVPARGIWGH

SEQ ID NO: 4004 - protein, 86 aa, Homo sapiens [sequence omitted]

SEQ ID NO: 4005 - protein, 134 aa, Homo sapiens
  SIGNAL -96..-1
  UNSURE 27: Xaa = His,Gln
MASRPILLPHRDRPGSLSLQHVGMYMLLSPHRLREQAGVRGSIRTANRTEDGLKIREAESLPQSNTADFKCLHSASLQQAPGGILMGPASSPWTLAVEGEKRTSAPPLRESLMPTKGLGWWTXDPQSGSLFTEH

SEQ ID NO: 4006 - protein, 124 aa, Homo sapiens
  SIGNAL -22..-1
MLSGRLVLGLVSMAGRVCLCQGSAGSGAIGPVEAAIRTKLEEALSPEVLELRNESGGHAVPPGSETHFRVAVVSSRFEGLSPLQRHRLVHAALAEELGGPVHALAIQARTPAQWRENSQLDTSP

SEQ ID NO: 4007 - protein, 54 aa, Homo sapiens [sequence omitted]

SEQ ID NO: 4008 - protein, 64 aa, Homo sapiens
  SIGNAL -19..-1
  UNSURE -16: Xaa = Ala,Glu
  UNSURE 22: Xaa = Ala,Gly,Arg,Thr
  UNSURE 12: Xaa = Ala,Pro
  UNSURE -6: Xaa = His,Leu
  UNSURE 3: Xaa = Pro,Ser
MGRXWWLTPVILAXREARADGXVELRNVRPXWAMWQNPASXKNTKTRWAWWHAPVVPATGEAEV

SEQ ID NO: 4009 - protein, 93 aa, Homo sapiens
  SIGNAL -58..-1
MAVVATLRLSAQGTVTFEDVAVKFTQEEWNLLSEAQRCLYRDVTLENLALMSSLGCWCGVEDEAAPSKQSIYIQRETQVRTPMTGVSPKKAHP

SEQ ID NO: 4010 - protein, 77 aa, Homo sapiens
  SIGNAL -24..-1
MRLPRRAALGLLPLLLLLPPAPEAAKKPTPCHRCRGLVDKFNQGMVDTKEELWRREHGLGGKDAVPSTSPARFACWR

SEQ ID NO: 4011 - protein, 73 aa, Homo sapiens
  SIGNAL -32..-1
  UNSURE 17: Xaa = Lys,Asn
MATPPFRLIRKMFSFKVSRWMGLACFRSLAASSPSIRQKKLMHKLQEEXAFREEMKIFREKIEDFREEMWTFR

SEQ ID NO: 4012 - protein, 142 aa, Homo sapiens
  SIGNAL -17..-1
MARKALKLASWTSMALAASGIYFYSNKYLDPNDFGAVRVGRAVATTAVISYDYLTSLKSVPYGSEEYLQLRSKVHLRSARRLCELCCANRGTFIKVGQHLGALDYLLPEEYTSTLKVLHSQPPQSSMQEIRQVIREDLGKEI

SEQ ID NO: 4013 - protein, 130 aa, Homo sapiens
  SIGNAL -36..-1
MDVTPRESLSILVVAGSGGHTTEILRLLGSLSNAYSPRHYVIADTDEMSANKINSFELDRADRDPSNMYTKYYIHRIPRSREVQQSWPSTVFTTLHSMWLSFPLIHRVKPDLVLCNGPGTCVPICVSALL

SEQ ID NO: 4014 - protein, 69 aa, Homo sapiens
  SIGNAL -36..-1
MDDESLPPPRAAGSPRWLKSYLTAVFLSFWRMLSEGQVSLSDCFPEHALQRPGVRVLTAVAGPFSALSG

SEQ ID NO: 4015 - protein, 63 aa, Homo sapiens
  SIGNAL -52..-1
MQSKGLIYRGGNRGKVKWPQYTGSTGKVRLGFGCPDSVAFVLGACCGHPALSAGCRFNGDMGR

SEQ ID NO: 4016 - protein, 63 aa, Homo sapiens
  SIGNAL -15..-1
  UNSURE -2: Xaa =  * ,Cys,Trp
  UNSURE 20: Xaa =  * ,Gly,Arg
  UNSURE -1: Xaa = Ala,Thr
  UNSURE 39: Xaa = Ile,Asn,Ser,Thr
MAVTLSLLLGGRVXXLHSLWVRDPGGGGPRPIGRXAGPRFRLGAGERELQEVEXTLKRQKQAI

SEQ ID NO: 4017 - protein, 57 aa, Homo sapiens
  SIGNAL -23..-1
  UNSURE -6: Xaa = Asp,Val
MGFCHVGQAVLELLSSGXPTVSASQGAGITGVTTVPSLSHHAGLIFKFFVETGSHYV

SEQ ID NO: 4018 - protein, 130 aa, Homo sapiens
  SIGNAL -75..-1
MRSHTITMTTTSVSSWPYSSHRMRFITNHSDQPPQNFSATPNVTTCPMDEKLLSTVLTTSYSVIFIVGLVGNIIALYVFLGIHRKRNSIQIYLLNVAIADLLLIFCLPFRIMYHINQNKWTLGVILCKVV

SEQ ID NO: 4019 - protein, 159 aa, Homo sapiens [sequence omitted]

SEQ ID NO: 4020 - protein, 168 aa, Homo sapiens
  SIGNAL -39..-1
MELSESVQKGFQMLADPRSFDSNAFTLLLRAAFQSLLDAQADEAVLDHPDLKHIDPVVLKHCHAAAATYILEAGKHRADKSTLSTYLEDCKFDRERIELFCTEYQNNKNSLEILLGSIGRSLPHITDVSWRLEYQIKTNQLHRMYRPAYLVTLSVQDTVPHPIQRLVL

SEQ ID NO: 4021 - protein, 100 aa, Homo sapiens
  SIGNAL -68..-1
  UNSURE 28: Xaa = Asp,Glu
  UNSURE -43: Xaa = Cys,Phe,Ser,Tyr
  UNSURE -59: Xaa = Cys,Trp
  UNSURE -66: Xaa = Gly,Val
  UNSURE -42: Xaa = Phe,Leu
MCXFPVLWCXYTGDVESHRPGNCGPXXSTQSKLRRPGWSVMARSRLTATSVFWVQALLLPQLLRRLRQENGMNRGGGACHEQRSCYCTPAWVTERXSIPK

SEQ ID NO: 4022 - protein, 230 aa, Homo sapiens
  SIGNAL -160..-1
  UNSURE -144: Xaa = Asn,Ser
  UNSURE -131: Xaa = Ser,Thr
MESTLGAGIVIAEALQXQLAWLENVWLWIXFLGDPKILFLFYFPAAYYASRRVGIAVLWISLITEWLNLIFKWFLFGDRPFWWVHESGYYSQAPAQVHQFPSSCETGPGSPSGHCMITGAALWPIMTALSSQVATRARSRWVRVMPSLAYCTFLLAVGLSRIFILAHFPHQVLAGLITGAVLGWLMTPRVPMERELSFYGLTALALMLGTSLIYWTLFTLGLDLSWSISL

SEQ ID NO: 4023 - protein, 66 aa, Homo sapiens
  SIGNAL -59..-1
MSCSCSSGSGEASAGLMEEALPSAPERLALDYIVPCMRYYGICVKDSFLGAALGGRVLAEVEALKR

SEQ ID NO: 4024 - protein, 62 aa, Homo sapiens
  SIGNAL -48..-1
MQPTRRPCGPPIAQHCLIEGSGGTSGPQEHQPLDHLGFVITIFSPCCSHHALLPSSGRRKPK

SEQ ID NO: 4025 - protein, 183 aa, Homo sapiens
  SIGNAL -19..-1
MTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSAFMTLVIILLHVFWGIVFFDGCEK

SEQ ID NO: 4026 - protein, 113 aa, Homo sapiens
  SIGNAL -73..-1
MASYSGFSGLLEIRYGPGHRSCLPQFAFFPQPPLPRPRICMWVLAELLELGCPEQSLRDAITLDLFCHALIFCRQQGFSLEQTSAACALLQDLHKACIGERGQLPGLSPREKR

SEQ ID NO: 4027 - protein, 61 aa, Homo sapiens
  SIGNAL -19..-1
MVGILPLCCSGCVPSLCCSSYVPSVAPTAAHSVRVPHSAGHCGQRVLACSSSSKRQVTKKK

SEQ ID NO: 4028 - protein, 110 aa, Homo sapiens
  SIGNAL -102..-1
MCHRHHPMTSCPHVPPCFPVPCPPCAGLMFRPAKSVFHHSHKHKKQDPLQPCDTEYPVFVYQPAIREANGIVECGPCQKVFVVQQIPNSNLLLLVTDPTCDCSIFPPVLQ

SEQ ID NO: 4029 - protein, 109 aa, Homo sapiens
  SIGNAL -84..-1
  UNSURE 7: Xaa = His,Gln
MEDPNPEENMKQQDSPKERSPQPRRQHLPPGGPEVHPLPHHLRRFQVPGASHEAGAPSGLRGPEAAGGPLHLLHLRPLLPLLQSPNHPPAXHGPAAKPTLPVATTTAQP

SEQ ID NO: 4030 - protein, 97 aa, Homo sapiens
  SIGNAL -82..-1
MELAMDNSYAFNQRSTCNGIPSEKKNNFLVSEDHGQKILSVLQNFREQNVFYDFKIIMKDEIIPCHRCVLAACSDFFRGSLALSPRLECSGCDLGSL

SEQ ID NO: 4031 - protein, 134 aa, Homo sapiens
  SIGNAL -24..-1
MLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHF

SEQ ID NO: 4032 - protein, 69 aa, Homo sapiens [sequence omitted]

SEQ ID NO: 4033 - protein, 168 aa, Homo sapiens
  SIGNAL -14..-1
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQRSTPNVPAFWTMLAKAINGTAVVMDDKDQLFHPIPESDVNATQ

SEQ ID NO: 4034 - protein, 92 aa, Homo sapiens
  SIGNAL -70..-1
MSAGGGRAFAWQVFPPMPTCRVYGTVAHQDGHLLVLGGCGRAGLPLDTAETLDMASHTWLALAPLPTARAGAAAVVLGKQVLVVGGVDEVQS

SEQ ID NO: 4035 - protein, 121 aa, Homo sapiens
  SIGNAL -32..-1
MFAPAVMRAFRKNKTLGYGVPMLSLTLSPGWSTMAQSWLTATSTSQIQAILLPQPPEQLGLQLLIVGGSFGLREFSQIRYDAVKSKMDPELEKKLKENKISLESEYEKIKDSKFDDWKNIR

SEQ ID NO: 4036 - protein, 120 aa, Homo sapiens
  SIGNAL -27..-1
  UNSURE 88: Xaa = Glu,Gly
MAFGDPHYRTFDGRLLHFQGSCSYVLAKDCHSGDFSVHVTNDDRGRSGVAWTQEVAVLLGDMAVRLLQDGAVTVDGHPVALPFLQEPLLYVELRGHTVILHAQPGLQVRLQGESXVGLPA

SEQ ID NO: 4037 - protein, 145 aa, Homo sapiens
  SIGNAL -18..-1
MQLCWVILGFLLFRGHNSQPTMTQTSSSQGGLGGLSLTTEPVSSNPGYIPSSEANRPSHLSSTGTPGAGVPSSGRDGGTSRDTFQTVPPNSTTMSLSMREDATILPSPTSETVLTVAAFGVISFIVILVVVVIILVGVVSLRFKC

SEQ ID NO: 4038 - protein, 151 aa, Homo sapiens
  SIGNAL -17..-1
  UNSURE 119: Xaa =  * ,Trp
  UNSURE 20: Xaa = Met,Val
MPSPQLLVLFGSQTGTAQDVSERLGREARGRRLGCRXQALDSYPVVNLINEPLVIFVCATTGQGDPPDNMKNFWRFIFRKNLPSTALCQMDFAVLGLGDSSYAKFNFVAKKLHRRLLQLGGSASCPCAWAMTSMSXGPTLLWTPGCETCGT

SEQ ID NO: 4039 - protein, 64 aa, Homo sapiens
  SIGNAL -54..-1
MAEEQGRERDSVPKPSVLFLHPDLGVGGAERLVLLPFPTERRLLFCTAPRSLNSLPLKKKKIAK

SEQ ID NO: 4040 - protein, 153 aa, Homo sapiens
  SIGNAL -45..-1
MPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYR

SEQ ID NO: 4041 - protein, 78 aa, Homo sapiens
  SIGNAL -49..-1
MTWRAYCLLCECRYEERSTTTIKVIIVIYLSVVGALLLYMAFLMLGGPSDPKARMHTLSNCTMRRRMRMLALWQQLLH

SEQ ID NO: 4042 - protein, 120 aa, Homo sapiens
  SIGNAL -99..-1
MNSLLHFGILLELSLLKQFKSVYVPGNHTHQASYKPLLKQVVEEIFHPERPDSVDIEHMSSGLTDLLKTGFSMFMKVSRPHPSDYPLLILFVVGGVTVSEVKMVKDLVASLKPGTQVIVL

SEQ ID NO: 4043 - protein, 101 aa, Homo sapiens
  SIGNAL -60..-1
MFWKLRLGHLWGNYYSAYHNLQVCFCIGYLSSRLLYLPSSEERGQQHSLVLGIRPSLAWSSTTDFASMAGGVVKLKTCTWFKSRGLVLCLCMVDLKKEGAG

SEQ ID NO: 4044 - protein, 88 aa, Homo sapiens
  SIGNAL -82..-1
MTPIKLLNLTSRYNFRRTFGIELSSNSSYCKRGNGYRSRVPKECECNWLHLESDTLKKLPIISPSWTCRIILFLYFSGQLLQLSLSCL

SEQ ID NO: 4045 - protein, 96 aa, Homo sapiens
  SIGNAL -23..-1
MATPQSIFIFAICILMITELILASKSYYDILGVPKSASERQIKKAFHKLAMKYHPDKNKSPDAEAKFREIAEAYETLSDANRRKSMIHLDTVLLLV

SEQ ID NO: 4046 - protein, 85 aa, Homo sapiens
  SIGNAL -72..-1
MMELGRISSRNLGRDDRVIGDHGKEARFPFLDENVVSFLNSLPIWEKANLTLPRGIGEKLLLRLAAVELGLTASALLPKRAMQFG

SEQ ID NO: 4047 - protein, 106 aa, Homo sapiens
  SIGNAL -35..-1
  UNSURE 66: Xaa =  * ,Glu,Lys,Gln
  UNSURE -14: Xaa = Pro,Ser
MDKPCGCPPGVCDHGTGDRRDXWYSTVGLLPPVRAMSQRNLNAKTEQGPTGVTMTSNPITWGQIKKTTQEAEKLLERQGQAKTPDSMFLAMLAVVILCVYXGSGDH

SEQ ID NO: 4048 - protein, 61 aa, Homo sapiens
  SIGNAL -53..-1
MPQRPANFVILVETGFHHVGQAGLKLLTSGEAPSLLKMQKIGWAWWWVPVVSATREAEAGE

SEQ ID NO: 4049 - protein, 59 aa, Homo sapiens
  SIGNAL -19..-1
  UNSURE 24: Xaa = Phe,Ser,Tyr
MTHKYFLLMCALSSYSLNSALQRAQVLNFSIHSFMDHTFGIIXKNLSKTPCHGGVILWF

SEQ ID NO: 4050 - protein, 147 aa, Homo sapiens
  SIGNAL -41..-1
MSPAPDAAPAPASISLFDLSADAPVFQGLSLVSHAPGEALARAPRTSCSGSGERESPERKLLQGPMDISEKLFCSTCDQTFQNHQEQREHYKLDWHRFNLKQRLKDKPLLSALDFEKQSSTGDLSSISGSEDSDSASEEDLQTLDRE

SEQ ID NO: 4051 - protein, 61 aa, Homo sapiens
  SIGNAL -42..-1
MAGAIIENMSTKKLCIVGGILLVFQIIAFLVGGLIAPGPTTAVSYMSVKCVDARKNHHKTK

SEQ ID NO: 4052 - protein, 71 aa, Homo sapiens
  SIGNAL -59..-1
MIPPGECTYAGRKRRRPLQKQRPAVGAEKSNPSKRHRDRLNAELDHLASLLPFPPDIISKLDKLSVLRLSV

SEQ ID NO: 4053 - protein, 59 aa, Homo sapiens
  SIGNAL -53..-1
MPQRPANFVILVETGFHHVGQAGLKLLTSGEAPSLLKMQKIGWAWWWVPVVSATREAEA

SEQ ID NO: 4054 - protein, 60 aa, Homo sapiens
  SIGNAL -53..-1
  UNSURE -52: Xaa = Pro,Arg
MXQRPANFVILVETGFHHVGQAGLKLLTSGEAPSLLKMQKIGWAWWWVPVVSATREAEAG

SEQ ID NO: 4055 - protein, 63 aa, Homo sapiens [sequence omitted]

SEQ ID NO: 4056 - protein, 103 aa, Homo sapiens
  SIGNAL -101..-1
  UNSURE -93: Xaa = Asp,Glu
  UNSURE 1: Xaa = Lys,Asn
MPSPARRRXHASLIPETGKKKVAEIQGHAGGRRSGQSHELLRDFEATLLQMFGLRAARSLARVPSFRTTCGIFTGFSLGRRRKSRSTALVLSILERPASRAXT

SEQ ID NO: 4057 - protein, 102 aa, Homo sapiens
  SIGNAL -49..-1
MEKPLFPLVPLHWFGFGYTALVVSGGIVGYVKTGSVPSLAAGLLFGSLAGLGAYQLYQDPRNVWGFLAATSVTFVGVMGMRSYYYGKFMPVGLIAGASLLMA

SEQ ID NO: 4058 - protein, 56 aa, Homo sapiens
  SIGNAL -51..-1
MYQFSQYVCQQTGLQIPQLPAPPKIYFPIRDSWNAGIMTVMSALSVAPSKAREYSK

SEQ ID NO: 4059 - protein, 150 aa, Homo sapiens
  SIGNAL -39..-1
  UNSURE -30: Xaa = Gly,Val
MNVGVAHSEXNPNTRVMNSRGIWLAYIILVGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGI

SEQ ID NO: 4060 - protein, 156 aa, Homo sapiens
  SIGNAL -79..-1
  UNSURE 20: Xaa = Ala,Gly
  UNSURE 69: Xaa = Ala,Pro,Ser,Thr
  UNSURE -47: Xaa = Cys,Trp
  UNSURE -46: Xaa = Leu,Pro
MAPKVFRQYSGYPRWHRLPPQSLQHHQYCQRRXXGPPLPTESHSILRAPSLKEWAKVGQYTFTAAAVGAVFGLTTCISAHVREKPDDPLNYFLGGCAGXLTLGARTHNYGIGRRRLRVLWHSGLPGQDGPAGGLGGVCKTQGVSPVPXGTSSLQNA

SEQ ID NO: 4061 - protein, 62 aa, Homo sapiens
  SIGNAL -36..-1
MFAGHVGVGRLVSKKLQIPPSQAWTFLSALNQVTPAEVSCSSVALCSLSPHFHVCRCPAFNE

SEQ ID NO: 4062 - protein, 59 aa, Homo sapiens
  SIGNAL -51..-1
  UNSURE 3: Xaa =  * ,Glu
  UNSURE -20: Xaa =  * ,Leu,Ser
  UNSURE 6: Xaa = Asp,His,Asn,Tyr
  UNSURE -21: Xaa = His,Gln
  UNSURE -15: Xaa = Phe,Leu
MNTPGRSCLSSASTEILKRLKKNSRLLLKRXXPRRNXRVMGLLQLPEFTATQPXVTXWS

SEQ ID NO: 4063 - protein, 60 aa, Homo sapiens [sequence omitted]

SEQ ID NO: 4064 - protein, 166 aa, Homo sapiens
  SIGNAL -58..-1
MTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSL

SEQ ID NO: 4065 - protein, 68 aa, Homo sapiens
  SIGNAL -31..-1
MPLLRGRCPARRHYRRLALLGLQPAPRFAHSGPPRQRPLSAAEMAVGLVVFFTTFLTPAAYVLGNLKQ

SEQ ID NO: 4066 - protein, 134 aa, Homo sapiens
  SIGNAL -126..-1
  UNSURE -53: Xaa = Asn,Thr
MGGFQRGKYGTMAEGRSEDNLSATPPALRIILVGKTGCGKSATGNSILGQPVFESKLRAQSVTRTCQVKTGTWXGRKVLVVDTPSIFESQADTQELYKNIGDCYLLSAPGPHVLLLVIQLGRFTAQDTVAIRKV

SEQ ID NO: 4067 - protein, 95 aa, Homo sapiens
  SIGNAL -18..-1
  UNSURE 43: Xaa = Ile,Met
MTHLSMAMAFSFPPVASGQLHPQLGNTQHQTELGKELATTSTMPYQYPALTPEQKKELSDXLTASWHLARASWLQMSPLGALPSGCSPLAMQPRH

SEQ ID NO: 4068 - protein, 91 aa, Homo sapiens
  SIGNAL -69..-1
MRGTSAAKQVDSTEEAVHLNKIRVLDEGRGGEWLLQSTVHTSMERRWDLIPGCKSSLCHLLSVCPQGLTLSPRLECSGAITTHCSLTYRGS

SEQ ID NO: 4069 - protein, 130 aa, Homo sapiens
  SIGNAL -36..-1
  UNSURE -26: Xaa = Glu,Gln
  UNSURE 77: Xaa = Leu,Trp
MEELQEPLRGXLRLCFTQAARTSLLLLRLNDAALRALQECQRQQVRPVIAFQGHRGYLRLPGPGWSCLFSFIVSQCCQEGAGGSLDLVCQRFLRSGPNSLHCLGSLRERLIIXAAMDSIPAPSSVQGHNL

SEQ ID NO: 4070 - protein, 184 aa, Homo sapiens
  SIGNAL -16..-1
MGPHLHLCLCVPDLRSLRVCVSLWSVHHRPHESLAREEALTALGKLLYLLDGMLDGQVNSGIAATPASAAAATLDVAVRRGLSHAAQRLLCVALGQLDRPPDLAHDGRSLWLNIRGKEAAALSMFHVSTPLPVMTGGFLSCILGLVLPLAYGFQPDLVLVALGPGHGLQGPTLHSWLQCFGGWQ

SEQ ID NO: 4071 - protein, 105 aa, Homo sapiens
  SIGNAL -45..-1
MDNPEYVVNDENWLGPVLGYLIIEEDFNIALGVFALAGLTDLLDGFIARNWANQRSALGSALDPLADKILISILYVSLTYADLIPVPLTYMIISRDVMLIAAVFY

SEQ ID NO: 4072 - protein, 144 aa, Homo sapiens
  SIGNAL -106..-1
MACRSKPPEEEERKKRGRKREDKEDKSEKAVKDYEQEKSWQDSERLKGILERGKEELAEAEIIKDSPDSPEPPNKKPLVEMDETPQVEKSKGPVSLLSLWSNRINTANSRKHQEFAGRLNSVNNRAELYQHLKEENGMETTENG

SEQ ID NO: 4073 - protein, 62 aa, Homo sapiens
  SIGNAL -14..-1
  UNSURE 30: Xaa = Ala,Phe,Ser,Val
MSCCAQLWLSFSTGWWIIQACWNYYGGTMLTRNPTCKTKITDGXRAIAQSGVQRHNPGSLQP

SEQ ID NO: 4074 - protein, 77 aa, Homo sapiens
  SIGNAL -41..-1
  UNSURE 24: Xaa = Ile,Val
MESGSTAASEEARSLRECELYVQKHNIQALLKDSIVQLCTARPERPMAFLREYFERLEKEEAKQXQNLQKAGTRTDF

SEQ ID NO: 4075 - protein, 72 aa, Homo sapiens [sequence omitted]

SEQ ID NO: 4076 - protein, 96 aa, Homo sapiens
  SIGNAL -42..-1
  UNSURE -25: Xaa = Cys,Ser
  UNSURE -26: Xaa = His,Leu,Gln
  UNSURE -11: Xaa = Ser,Tyr
MRGRPGWHRPGWTQGSXXVISTSSLPLRDLLXSALHTPPARLIPVSSLEEKCQAGATWPCLGHTPASGCGGWSAQPQHMDCYVKDDVPQENQDGFT

SEQ ID NO: 4077 - protein, 128 aa, Homo sapiens
  SIGNAL -52..-1
  UNSURE 72: Xaa = Asp,Glu,Gly,Val
MEHYRKAGSVELPAPSPMPQLPPDTLEMRVRDGSKIRNLLGLALGRLEGGSARHVVFSGSGRAAGKAVSCAEIVKRRVPGLHQLTKLRFLQTEDSWVPASPDTGLDPLTVRRHVPAVWVLLSRXPWTQ

SEQ ID NO: 4078 - protein, 94 aa, Homo sapiens
  SIGNAL -23..-1
MGFHHVGQAGLKLLTSSDLPASASQSAGITGVSHCTQRFLLLRQGLALLPRLECSGVISAHCNFCHLGLSHPPTSASQIAGTAGTHQHTQLIFV

SEQ ID NO: 4079 - protein, 94 aa, Homo sapiens
  SIGNAL -23..-1
MGFHHVGQAGLKLLTSSDLPASASQSAGITGVSHCTQRFLLLRQGLALLPRLECSGVISAHCNFCHLGLSHPPTSASQIAGTAGTHHHTQLIFV

SEQ ID NO: 4080 - protein, 50 aa, Homo sapiens
  SIGNAL -28..-1
MAFPGQSDTKMQWPEVPALPLLSSLCMAMVRKSSALGKEVGRRVKENGDA

SEQ ID NO: 4081 - protein, 74 aa, Homo sapiens
  SIGNAL -35..-1
  UNSURE 29: Xaa = Gly,Arg
MSLDIQSLDIQCEELSDARWAELLPLLQQCQVVRLDDCGLTEARCKDISSALRVNPALAELNLXSNELGDVGVH

SEQ ID NO: 4082 - protein, 102 aa, Homo sapiens
  SIGNAL -68..-1
  UNSURE -30: Xaa = Ala,Asp,Gly,Val
  UNSURE 5: Xaa = Arg,Thr
  UNSURE -14: Xaa = Ile,Leu,Met,Val
  UNSURE 4: Xaa = Lys,Asn
MDLIGFGYAALVTFGSIFGYKRRGGVPSLIAGLFVGCLXGYGAYRVSNDKRDVKXSLFTAFFLATIMGVRFXXSKKIMPAGLVAGLSLMMILRLVLLLLWSI

SEQ ID NO: 4083 - protein, 57 aa, Homo sapiens
  SIGNAL -20..-1
  UNSURE 3: Xaa = Ala,Gly
  UNSURE 31: Xaa = Asp,Glu
  UNSURE 26: Xaa = Glu,Val
  UNSURE -10: Xaa = Ile,Val
MAAPSQQRLVXVSVSPQSRASLXARFQLNPTDTARKLTSFFRKIGXHFVFXTAFSGN

SEQ ID NO: 4084 - protein, 132 aa, Homo sapiens
  SIGNAL -13..-1
  UNSURE -1: Xaa = Ala,Thr
  UNSURE 65: Xaa = Gly,Val
MLVLRSALTRALXSRTLAPQMCSSFATGPRQYDGIFYEFRSYYLKPSKMNEFLENFEKNAHLRTAHSELVGYWSVEFXGRMNTVFHIWKYDNFAHRTEVQKALAKDKEWQEQFLIPNLALIDKQESEITYLV

SEQ ID NO: 4085 - protein, 83 aa, Homo sapiens
  SIGNAL -44..-1
MMLIVTTVLLVLENNNNYKCCQSENCSKKYVTLLSIIFSSLGIAFSGYCLVISALGLVQGPYCRTLDGWEYAFEGTAGRFLTD

SEQ ID NO: 4086 - protein, 64 aa, Homo sapiens
  SIGNAL -51..-1
MANLPVPSLQTGGLWWFQDLTVSDPIYILPLAVTATMWAVLELGAETGVQSSDLQWMRNVIRMM

SEQ ID NO: 4087 - protein, 74 aa, Homo sapiens
  SIGNAL -17..-1
MWPNLLPLCQRIHCIIGRFRCNGFEDCPDGSDEENCTANPLLCSTARYHCKNGLCIDKSFICDGQNNCQDNSDE

SEQ ID NO: 4088 - protein, 65 aa, Homo sapiens [sequence omitted]

SEQ ID NO: 4089 - protein, 118 aa, Homo sapiens
  SIGNAL -100..-1
MASDSGNQGTLCTLEFAVQMTCQSCVDAVRKSLQGGRCPGCGGALGVPDGLGTHHSTQPGGAGSPGSTGRQAVLKGMGSGQLQNLGAAVAILGGPGTVQGVVRFLQLTPERCLIEGTI

SEQ ID NO: 4090 - protein, 74 aa, Homo sapiens
  SIGNAL -15..-1
MAVLAGSLLGPTSRSAALLGGRWLQPRAWLGFPDAWGLPTPQQARGKARGNEYQPSNIKRKNKHGWVRRLSTPA

SEQ ID NO: 4091 - protein, 80 aa, Homo sapiens
  SIGNAL -29..-1
  UNSURE 37: Xaa = Asp,His,Ile,Leu,Asn,Val
  UNSURE 44: Xaa = Cys,Gly,Arg,Ser
  UNSURE 32: Xaa = Glu,Lys
MAPQSLPSSRMAPLGMLLGPLMAACFTFCLSHQNLKEFALTNPEKSSTKETERKETKAEEXLDAEXWRCSTRXMSGRPFS

SEQ ID NO: 4092 - protein, 142 aa, Homo sapiens
  SIGNAL -37..-1
MAMHFIFSDTAVLLFDFWSVHSPAGMALSVLVLLLLAVLYEGIKVGKASCSTRYCEPANLHQPADHRRDRRGLCRLRFIPCWQNPPQVYLCHFGQSLIHVIQVVIGYFIMLAVMSYNTWIFLGVVLGSAVGYYLAYPLLSTA

SEQ ID NO: 4093 - protein, 56 aa, Homo sapiens
  SIGNAL -43..-1
  UNSURE -13: Xaa =  * ,Leu
  UNSURE -10: Xaa = Ala,Ser
  UNSURE -35: Xaa = Glu,Lys,Gln
  UNSURE 1: Xaa = Leu,Val
  UNSURE 2: Xaa = Phe,Ile
  UNSURE -21: Xaa = Phe,Leu
  UNSURE -11: Xaa = Ser,Thr
MASSAEGDXGTVVALAGVLQSGXQELSLNKXAXXLGASEQALGXXISIFLGNQLYH

SEQ ID NO: 4094 - protein, 86 aa, Homo sapiens
  SIGNAL -57..-1
  UNSURE 11: Xaa = Cys,Phe,Ser,Tyr
MPVIPALWEAKVGRSRGQEIKTILANTVKPISTKNKKGFSWAWWWALVVPATREAEAGEWCEPGRRTXSEQRSRHCTPAWATERDS

SEQ ID NO: 4095 - protein, 137 aa, Homo sapiens
  SIGNAL -22..-1
MKISMINYKSLLALLFILASWIIFTVFQNSTKVWSALNLSISLHYWNNSTKSLFPKTPLISLKPLTETELRIKEIIEKLDQQIPPRPFTHVNTTTSATHSTATILNPRDTYCRGDQLHILLEVRDTWDAGSNMAGIS

SEQ ID NO: 4096 - protein, 62 aa, Homo sapiens
  SIGNAL -39..-1
MATAQLQRTPMSALVFPNKISTEHQSLVLVKRLLAVSVSCITYLRGIFPECAYGTRYLDVKT

SEQ ID NO: 4097 - protein, 112 aa, Homo sapiens [sequence omitted]

SEQ ID NO: 4098 - protein, 182 aa, Homo sapiens
  SIGNAL -39..-1
MATAQLQRTPMSALVFPNKISTEHQSLVLVKRLLAVSVSCITYLRGIFPECAYGTRYLDDLCVKILREDKNCPGSTQLVKWMLGCYDALQKKYLRMVVLAVYTNPEDPQTISECYQFKFKYTNNGPLMDFISKNQSNESSMLSTDTKKASILLIRKIYILMQNLGPLPNDVCLTMKLFYYDE

SEQ ID NO: 4099 - protein, 142 aa, Homo sapiens
  SIGNAL -99..-1
MAASVEQREGTIQVQGQALFFREALPGSGQARFSVLLLHGIRFSSETWQNLGTLHRLAQAGYRAVAIDLPGLGHSKEAAAPAPIGELAPGSFLAAVVDALELGPPVVISPSLSGMYSLPFLTAPGSQLPGFVQWPPSALTKS

SEQ ID NO: 4100 - protein, 154 aa, Homo sapiens
  SIGNAL -147..-1
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDIASSEDDLEAARNELHSALQHPQLCTLPFLILANHQTSSSSLSTEK

SEQ ID NO: 4101 - protein, 116 aa, Homo sapiens
  SIGNAL -37..-1
MSRASRQLVWKNGGEHSVKERTISENSLIILLQGLQGRVTTVDLRDESVAHGRIDNVDAFMNIRLAKVTYTDRWGHQVKLDDLFVTGRNVRYVHIPDDVNITSTIEQQLQIIHRVR

SEQ ID NO: 4102 - protein, 162 aa, Homo sapiens
  SIGNAL -46..-1
MEENSKKDHRALLNQGEEDELEVFGYRDHNVRKAFCLVASVLTCGGLLLVFYWRPQWRVWANCIPCPLQEADTVLLRTTDEFQRYMRKKVFCLYLSTLKFPVSKKWEESLVADRHSVINQALIKPELKLRCMQVQKIRYVWNDLEKRFQKVGLLEDSNSCSD

SEQ ID NO: 4103 - protein, 130 aa, Homo sapiens
  SIGNAL -79..-1
MRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWAVQVV

SEQ ID NO: 4104 - protein, 73 aa, Homo sapiens
  SIGNAL -30..-1
MQGFGDTEVNRHCWARWLTLIIPAVFRAEGGGSLEVGSSVPAWPVWWDPVSAKSAKIGGVLWCVPLIPAIREA

SEQ ID NO: 4105 - protein, 148 aa, Homo sapiens
  SIGNAL -31..-1
MACTTTAPAQEHMLLTPLTALMVGAASLLEGRPQISAPYSRAACCSPGALGCPAARVGILDLMYSWVARKVLRCSNTGLQGLHCAPAYAAQLGMDPGRGQRAGGPVEQTYFSPMGKLPTLSWLEGCTAVMTLASAWLLGSPRETYNHE

SEQ ID NO: 4106 - protein, 129 aa, Homo sapiens
  SIGNAL -125..-1
  UNSURE -89: Xaa = Gly,Arg,Ser
  UNSURE -13: Xaa = His,Gln
  UNSURE -117: Xaa = Ile,Lys
  UNSURE -122: Xaa = Ile,Met
MGKXALQLXATLENITNLRPVGEDFRWYLKMKCGNCXEISDKWQYIRLMDSVALKGGRGSASMVQKCKLCARENSIEILSSTIKPYNAEDNENFKTIVEFECRGLEPVDFQPXVLLLKVWSQGTAFSDI

SEQ ID NO: 4107 - protein, 121 aa, Homo sapiens
  SIGNAL -39..-1
MATAQLQRTPMSALVFPNKISTEHQSLVLVKRLLAVSVSCITYLRGIFPECAYGTRYLDDLCVKILREDKNCPGSTQLVKWILGCYDALQKKYLRMVVLAVYTNPEDPQTISECYQFKFKY

SEQ ID NO: 4108 - protein, 69 aa, Homo sapiens
  SIGNAL -14..-1
MILVTVPGVCPAQCCWAEQRGRGSGMYFIDKWARPSWVPHWLNDLFIVKSGYLVCIRTTVIRQGIVRIG

SEQ ID NO: 4109 - protein, 103 aa, Homo sapiens
  SIGNAL -83..-1
  UNSURE -75: Xaa = Gly,Arg,Trp
MCSDLGAWXRWENEGGCFVGEKCLSVPGLRGLPVTWSFCLHPSLHVTDWLSPTSIFLAVHPSFSLLSWSYFIFLAAVSFPLSCVLSSILSSLSNLPLQKKKKK

SEQ ID NO: 4110 - protein, 163 aa, Homo sapiens
  SIGNAL -83..-1
  UNSURE 65,71: Xaa = Ala,Gly
MDGTETRQRRLDSCGKPGELGLPHPLSTGGLPVASEDGALRAPESQSVTPKPLETEPSRETAWSIGLQVTVPFMFAGLGLSWAGMLLDYFQHWPVFVEVKDLLTLVPPLVGLKGNLEMTLASKLSTAANTGQIDDPQEQHRVISSNLXLIQVQXTVVGLLAAV

SEQ ID NO: 4111 - protein, 112 aa, Homo sapiens
  SIGNAL -39..-1
MATAQLQRTPMSALVFPNKISTEHQSLVLVKRLLAVSVSCITYLRGIFPECAYGTRYLDDLCVKILREDKNCPGSTQLVKWMLGCYDALQKKYVYTNPEVPQTISECYQFKF

SEQ ID NO: 4112 - protein, 185 aa, Homo sapiens
  SIGNAL -16..-1
  UNSURE 156: Xaa = Lys,Arg
MQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGXRVVFMGDDTGKTF

SEQ ID NO: 4113 - protein, 212 aa, Homo sapiens
  SIGNAL -177..-1
MATGELGDLGGYYFRFLPQKTFQSLSSKEITSRLRQWSMLGRIKAQAFGFDQTFQSYRKDDFVMAFFKDPNVIPNLKLLSDSSGQWIILGTEVKKIEAINVPCTQLSMSFFHRLYDEDIVRDSGHIVKCLDSFCDPFLISDELRRVLLVEDSEKYEIFSQPDREEFLFCLFKHLCLGGALCQYEDVISPYLETTKLIYKDLVSVRKNPQTKK

SEQ ID NO: 4114 - protein, 69 aa, Homo sapiens
  SIGNAL -17..-1
  UNSURE 49: Xaa = Ser,Thr
MAFTFAAFCYMLSLVLCAALIFFAIWHIIAFDELRTDFKSPIDQCNPVHARERLRTSSASASFCEXGCC

SEQ ID NO: 4115 - protein, 95 aa, Homo sapiens [sequence omitted]

SEQ ID NO: 4116 - protein, 126 aa, Homo sapiens
  SIGNAL -60..-1
MWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSFAFAGLAFASFYL

SEQ ID NO: 4117 - protein, 126 aa, Homo sapiens
  SIGNAL -21..-1
MKKFNFRKVLDGLTASSPGSGSSSGSNSGGGAGSGSVHPAGTAGVLREEIQETLTSEYFQICKTVRHGFPHQPTALAFDPVQKILAIETRTGAIRILGRPGVDCYCQHESGAAVLQLQFLINEGAL

SEQ ID NO: 4118 - protein, 137 aa, Homo sapiens
  SIGNAL -31..-1
  UNSURE 49: Xaa = Asp,His,Asn,Tyr
MAMSRFGRSGQPENRESFSILVLNVSFRTTADDLFPLFDRYGKVLDIYIPRDHRTGDPRGFAFVRYNYEDEARDAIDGLXGMRFDGRALMVQFAKYGPNAEKIHRGRITEENPKPRGRCRSRSPRQRYREDYRDRDY

SEQ ID NO: 4119 - protein, 87 aa, Homo sapiens
  SIGNAL -50..-1
  UNSURE 21: Xaa = Asn,Thr
  UNSURE 15: Xaa = Ser,Thr
MRCDNNFQHSKLLLRNGQSEQRGAFLQFRTGLWSVRVLGFRICLFHDSDCRQPLLGSLLLLAAAXPECPSXLAGSTLTVNVMNVATR

SEQ ID NO: 4120 - protein, 126 aa, Homo sapiens
  SIGNAL -42..-1
  UNSURE 4: Xaa = Arg,Trp
MALPGYPLGNVDDSRSKDSPAGEPQGQVPLTADVLAVSSSVASTDXQDIDQASFKTATPRAISTSGDKDKSAVVPEHGQKTPRKITPLLPSQNPSPLQVSMSLQNPAWDRQVQDARTSQSLVVFQV

SEQ ID NO: 4121 - protein, 140 aa, Homo sapiens
  SIGNAL -42..-1
  UNSURE 4: Xaa = Arg,Trp
MALPGYPLGNVDDSRSKDSPAGEPQGQVPLTADVLAVSSSVASTDXQDIDQASFKTATPRAISTSGDKDKSAVVPEHGQKTPRKITPLLPSQNPSPLQVSMSLQNPAWDRQVQDARTSQSLVVFPSHLLGKDKMSQMASV

SEQ ID NO: 4122 - protein, 133 aa, Homo sapiens
  SIGNAL -96..-1
MEVAANCSLRVKRPLLDPRFEGYKLSLEPLPCYQLELDAAVAEVKLRDDQYTLEHMHAFGMYNYLHCDSWYQDSVYYIDTLGRIMNLTVMLDTALGKPREVFRLPTDLTACDNRLCASIHFSSSTWVTCQMEL

SEQ ID NO: 4123 - protein, 133 aa, Homo sapiens
  SIGNAL -37..-1
  UNSURE 4: Xaa = Phe,Val
MSTVGLFHFPTPLTRICPAPWGLRLWEKLTLLSPGIAVTPXQMAGKKDYPALLSLDENELEEQFVKGHGPGGQATNKTSNCVVLKHIPSGIVVKCHQTRSVDQNRKLARKILQEKVDVFYNGENSPVHKENEK

SEQ ID NO: 4124 - protein, 118 aa, Homo sapiens
  SIGNAL -20..-1
  UNSURE -16: Xaa = Ala,Gly
MWSPXAKGCLLEPFVHQVGGHSCVLRFNETTLCKPLVPREHQFYETLPAEMRKFTPQYKGKSQLLEGLPHWRGDVRDRGHGRPGSHPWSLTPSHSVLSLPLLLLLLLASASISHPQFS

SEQ ID NO: 4125 - protein, 88 aa, Homo sapiens
  SIGNAL -68..-1
  UNSURE -65: Xaa = Leu,Val
MPVXPGTQRYPHQREGSRLPAAAQRAGREARRKPRAWAWSGSESGRGCGHTRPGKLAPLRILLPGLIPFPTPYFKVLFGSSVSILERD

SEQ ID NO: 4126 - protein, 65 aa, Homo sapiens
  SIGNAL -47..-1
MITQSLGLSMSSLRFLKRHFNVWLGFIFLFFKKEIVSVFLLSTETISGLCAPRQLTCFAHFSLLH

SEQ ID NO: 4127 - protein, 87 aa, Homo sapiens
  SIGNAL -70..-1
MCTALLLLYLRWCFNLKLVNVKYEPKDSLGPEMTFVADAARGPLLSSLDSPANLMSTASVCISLPEGCSGGRSPCYSQKWPPEVPEK

SEQ ID NO: 4128 - protein, 162 aa, Homo sapiens
  SIGNAL -47..-1
  UNSURE 8: Xaa = Glu,Gly
MLQQDSNDDTEDVSLFDAEEETTNRPRKAKIRHPVASFFHLFFRVSAIIVYLLCXLLSSSFITCMVTIILLLSCDFWAVKNVTGRLMVGLRWWNHIDEDGKSHWVFESRKESSQENKTVSEAESRIFWLGLIACPVLWVIFAFSALFSFRVKWLAVVIMGVV

SEQ ID NO: 4129 - protein, 71 aa, Homo sapiens
  SIGNAL -50..-1
  UNSURE -27: Xaa = Ile,Asn,Ser,Thr
MFISSSVFVVSLHFGSLLNTYAVXLIRKDTEDTGHSDARLLVPVTCGAEAEGWLEPGGVGCSEPSSRHCTP

SEQ ID NO: 4130 - protein, 56 aa, Homo sapiens
  SIGNAL -41..-1
MEGGAYGAGKAGGAFDPYTLVRQPHTILRVVSWLFSIVVFGSIVNEGYLNSASEGE

SEQ ID NO: 4131 - protein, 172 aa, Homo sapiens
  SIGNAL -30..-1
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEKWRPFCLKFNGIVEDFNYGTLLRLDCSQGYTEENTIFAPRIQFFAIEIARNREGYNKAVYISVQDKEGEKGVN

SEQ ID NO: 4132 - protein, 50 aa, Homo sapiens
  SIGNAL -47..-1
MFGLRAARSLARVPSFRTTCGIFTGFSLGRRRKSRSTALVLSILSAGQPG

SEQ ID NO: 4133 - protein, 145 aa, Homo sapiens
  SIGNAL -104..-1
MIHLDTVLLLVVKDKEVVEVLLSSHLTSILMTYLKTLAFLVKTKTLDPRSVLKIISRHARMVVPVDKGIISKNFLLEVDYLMTCLKIWRKCFLLVVLTLPISIQYRLKIDFMDLASTAGLSLNEEEIWLLHTLTVQDSSSYSILT

SEQ ID NO: 4134 - protein, 134 aa, Homo sapiens
  SIGNAL -33..-1
  UNSURE 16: Xaa = Cys,Ser
  UNSURE 3: Xaa = Glu,Gln
  UNSURE 23: Xaa = Ser,Thr
MDSLRKMLISVAMLGAGAGVGYALLVIVTPGRAAEXEMLKEMPLQDPRXREEAARXQQLLLAHSAGGSDHAGERGLEEELDGWRRRRRAREVTVRPDLPPWAPDLGLGAGIRGSLSPSWAQRRVRTEIPCQGLS

SEQ ID NO: 4135 - protein, 166 aa, Homo sapiens [sequence omitted]

SEQ ID NO: 4136 - protein, 98 aa, Homo sapiens [sequence omitted]

SEQ ID NO: 4137 - protein, 93 aa, Homo sapiens
  SIGNAL -64..-1
MVEASLSVRHPEYNRPLLANDLMLIKLDESVSESDTIRSISIASQCPTAGNSCLVSGWGLLANGELTGVCLPSSRRSSAQSRGLTQSSASQAE

SEQ ID NO: 4138 - protein, 146 aa, Homo sapiens
  SIGNAL -19..-1
MAAATGAVAASAASGQAEGKKITDLRVIDLKSELNRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAE

SEQ ID NO: 4139 - protein, 83 aa, Homo sapiens
  SIGNAL -73..-1
  UNSURE -56: Xaa = Cys,Gly
MSLQMVTVSNNIALIQPXFSLMNFDGQVFFFGQKGWPKRSCPTGVFHLDVKHNHVKLKPTIFSKGFLLPPSSSLPSHLHNSKA

SEQ ID NO: 4140 - protein, 71 aa, Homo sapiens
  SIGNAL -68..-1
  UNSURE -46: Xaa = Ala,Thr
  UNSURE -14: Xaa = Asn,Ser
MSVMRPEQIMKSIIPVVMAGIIXIYGLVVAVLIANSLNDDISLYKSFLQLGAGLXVGLSGLAAGFASASWG

SEQ ID NO: 4141 - protein, 98 aa, Homo sapiens
  SIGNAL -96..-1
  UNSURE -82: Xaa =  * ,Glu,Lys,Gln
  UNSURE -83: Xaa = Glu,Gln
MCRSKSTASTSGGXXPAWEEAPPERALELEGAPAKDQTNEELPEITEVPESIKRRLGRRVPAATPAPRGNLLLQAWMRVHSWASRLFALMCCPGQALN

SEQ ID NO: 4142 - protein, 152 aa, Homo sapiens
  SIGNAL -19..-1
MAAATGAVAASAASGQAEGKKITDLRVIDLKSELNRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAH

SEQ ID NO: 4143 - protein, 152 aa, Homo sapiens
  SIGNAL -19..-1
  UNSURE 16: Xaa = Lys,Asn
MAAATGAVAASAASGQAEGKKITDLRVIDLKSELXRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAH

SEQ ID NO: 4144 - protein, 106 aa, Homo sapiens
  SIGNAL -63..-1
MEVSTNPSSNIDPGNYVEMNDSITHLPSKVVIQDITMELHCPLCNDWFRDPLMLSCGHNFCEACIQDFWRLQAKETFCPECKMLCQYNNCTFNPVLDKLVEKIKKL

SEQ ID NO: 4145 - protein, 100 aa, Homo sapiens
  SIGNAL -96..-1
  UNSURE -88: Xaa = Glu,Gly
MVSHKQKTXHHMILCLKLVTSNGFPILLASRMKARTLMGLAILGLLNFQMNLKISLSMSTKKASRIFDRIVINIQNNLENIAFLILSPMQPSPSFCISVC

SEQ ID NO: 4146 - protein, 92 aa, Homo sapiens [sequence omitted]

SEQ ID NO: 4147 - protein, 168 aa, Homo sapiens
  SIGNAL -117..-1
  UNSURE 49: Xaa = Cys,Phe,Ser,Tyr
  UNSURE 33: Xaa = His,Gln
  UNSURE 48: Xaa = Leu,Pro
MYGYFAGLCRRLQKFWRVTVKGFFVKKKEKKIPSAETYFHEEKIVVLGQVLMNESLPIEKRAQAAQKIGLLAFTGGPPAGNFAAEYMEEVAHLLQDEELAPKIKILLLQSVACWCYLNPVSQKRAKSLQFIPILISFFEGRFESTIKSEXNSYLLLKILDLLRSXXHD

SEQ ID NO: 4148 - protein, 91 aa, Homo sapiens
  SIGNAL -26..-1
MSKYQKEQTPDTLLLRTVTLTARSEASFLKSVRPRTHQFWTHWVYRCEPRRLATMPFLGWPISYVYTLLRFEMRRSYTQTDPEIKLQVFSD

SEQ ID NO: 4149 - protein, 121 aa, Homo sapiens
  SIGNAL -83..-1
MSFFLLASLTGPFTMNSSTPSTGVYANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRE

SEQ ID NO: 4150 - protein, 123 aa, Homo sapiens
  SIGNAL -42..-1
  UNSURE -37,77: Xaa =  * ,Lys
  UNSURE -23: Xaa = Asp,Glu
  UNSURE 32: Xaa = Ile,Lys,Arg,Thr
  UNSURE 7: Xaa = Lys,Asn
MNITRXLWSRTFNCSVPCSXTVPVIAVSVFILFLPVVFYLSSFLHSEQXKRKLILPKRLKSSTSFANIQENSNXDLQNGELTYHVNEWWKTQLGFRKKINCDLTSQALKKYKDFRSIFXIKNF

SEQ ID NO: 4151 - protein, 135 aa, Homo sapiens
  SIGNAL -123..-1
  UNSURE 9: Xaa = Leu,Pro
  UNSURE 10: Xaa = Phe,Leu
MLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGAXXPV

SEQ ID NO: 4152 - protein, 51 aa, Homo sapiens
  SIGNAL -36..-1
  UNSURE 4: Xaa = Ile,Leu,Val
MPVIPLLRRLRQENHLNLGGRGCSDLRLCHCTLAWATEQXRLEKKKKMRKA

SEQ ID NO: 4153 - protein, 124 aa, Homo sapiens
  SIGNAL -67..-1
  UNSURE 29: Xaa =  * ,Gly
MKTFEGFCALHLAASQGHWKIVQILLEAGADPNATTLEETTPLFLAVENGQIDVLRLLLQHGANVNGSHSMCGWNSLHQASFQENAEIIKLLLRKXANKECQDDFGITPLFVAAQYGKLESLKQ

SEQ ID NO: 4154 - protein, 53 aa, Homo sapiens
  SIGNAL -48..-1
  UNSURE 2: Xaa = Ile,Met
MPPLERGLYVGFSQESKIAPSPSDGMIPLPSTPLCFLSLSLVAPFSKPLXSLD

SEQ ID NO: 4155 - protein, 72 aa, Homo sapiens
  SIGNAL -30..-1
  UNSURE -13: Xaa = Leu,Met
MCIRSAWCRAEFNSWISXVTFCLDLSNVDSGVLKSPIIIVWESKSLCRSLRTCFMNLGAPVLDAYIFSIVIS

SEQ ID NO: 4156 - protein, 54 aa, Homo sapiens
  SIGNAL -41..-1
MATATEQWVLVEMVQALYEAPAYHLILEGILILWIIRLLFSKTYKLQERSDLTV

SEQ ID NO: 4157 - protein, 83 aa, Homo sapiens [sequence omitted]

SEQ ID NO: 4158 - protein, 91 aa, Homo sapiens [sequence omitted]

SEQ ID NO: 4159 - protein, 70 aa, Homo sapiens
  SIGNAL -60..-1
MREPTQGIVCVCLQWTRDPPAHWKGGVEPLEHLHFAQKGGAWHLQFLCGCLVFKIPSCFAESCFSFSPNK

SEQ ID NO: 4160 - protein, 80 aa, Homo sapiens
  SIGNAL -15..-1
  UNSURE 46: Xaa = Asn,Ser
  UNSURE 58: Xaa = Lys,Thr
MNVLSPHLSLLPTFPQERYEAAIQRSVKKTWAEIRQQRWSWAGALHHSSPGHKTNRSLQLXAWESSIVDRLMXPTLSFLG

SEQ ID NO: 4161 - protein, 89 aa, Homo sapiens
  SIGNAL -31..-1
MAQAHRTPQPRAAPSQPRVFKLVLLGSGSVGKSSLALRYVKNDFKSILPTVGCAFFTKVVDVGATSLKLEIWDTAGQESTTASATSTSG

SEQ ID NO: 4162 - protein, 104 aa, Homo sapiens
  SIGNAL -19..-1
MFLTVKLLLGQRCSLKVSGQESVATLKRLVSRRLKVPEEQQHLLFRGQLLEDDKHLSDYCIGPNASINVIMQPLEKMALKEAHQPQTQPLWHQLGLVLAKHFEP

SEQ ID NO: 4163 - protein, 77 aa, Homo sapiens
  SIGNAL -36..-1
MSQWGHQRDWSQTLNLLWLTVPLGVFWSLFLGWIWLQLLEVPDPNVVPHYATGVVLFGLSAVVELLGEPFWVLAQAH

SEQ ID NO: 4164 - protein, 130 aa, Homo sapiens
  SIGNAL -110..-1
  UNSURE -77: Xaa = Ala,Val
  UNSURE 14: Xaa = Cys,Ser
  UNSURE -100: Xaa = Lys,Arg
MSTEKVDQKEXSWGKRGVRRPDQKDRTKRRNHRXAASHGQGWRPGGRAARNARPETWGPDTLLSRPMVNDPPVPAFTVGPVGWAKSWQAVPAAAAAVWGALLHHPPFALGVCLPLLAPSTIPIXDSQPPQ

SEQ ID NO: 4165 - protein, 149 aa, Homo sapiens
  SIGNAL -137..-1
MGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSD

SEQ ID NO: 4166 - protein, 130 aa, Homo sapiens
  SIGNAL -119..-1
MTQGKLSVANKAPGTEGQQQVHGEKKEAPAVPSAPPSYEEATSGEGMKAGAFPPAPTAVPLHPSWAYVDPSSSSSYDNGFPTGDHELFTTFSWDDQKVRRVFVRKVYTILLIQLLVTLAVVALFTFCDPV

SEQ ID NO: 4167 - protein, 150 aa, Homo sapiens
  SIGNAL -43..-1
MAMSFEWPWQYRFPPFFTLQPNVDTRQKQLAAWCSLVLSFCRLHKQSSMTVMEAQESPLFNNVKLQRKLPVESIQIVLEELRKKGNLEWLDKSKSSFLIMWRRPEEWGKLIYQWVSRSGQNNSVFTLYELTNGEDTEDEEFHGLDEALYC

SEQ ID NO: 4168 - protein, 156 aa, Homo sapiens
  SIGNAL -43..-1
  UNSURE 26: Xaa = Leu,Val
MAMSFEWPWQYRFPPFFTLQPNVDTRQKQLAAWCSLVLSFCRLHKQSSMTVMEAQESPLFNNVKLQRKXPVESIQIVLEELRKKGNLEWLDKSKSSFLIMWRRPEEWGKLIYQWVSRSGQNNSVFTLYELTNEEDTEDEEFHGLDEATLLRALQAY

SEQ ID NO: 4169 - protein, 152 aa, Homo sapiens
  SIGNAL -14..-1
  UNSURE 65: Xaa = Ala,Asp,Gly,Val
  UNSURE 61: Xaa = Ala,Leu,Pro,Val
  UNSURE 67: Xaa = Gly,Arg
MRSLHLMSFILTGAARPRALSSTAKMHQVSTCFGPGRGLALTFMTLHSFREAITLDCNTNDRRPSGQRPPRPSAXQRRXPXGRRCPSCSPCALSLTSPGSCLLKTPVFTPYKASSEQTGRPLVEPAHPFQRMAPGRELSLDRGVLCPSVLRL

SEQ ID NO: 4170 - protein, 108 aa, Homo sapiens
  SIGNAL -30..-1
MTSARWPSSPSNFSQNSRGPFLMSVATVAAAPAPRSLPRPSTPQSPEQARVPADTLPAQWPGGRVPGSPTPFGISDRRRYKREPPLPPLQGSPPAPSGRFLLKEQGTP

SEQ ID NO: 4171 - protein, 78 aa, Homo sapiens
  SIGNAL -68..-1
  UNSURE -11: Xaa =  * ,Leu
  UNSURE -10: Xaa = Ala,Ser
  UNSURE -5: Xaa = His,Gln
  UNSURE -20: Xaa = Ile,Asn
MRPLWAMCGVEALTTLEVAGRMLGGKVHGSLARAGKVRGQTPKVAKQEXEEEEDRSGXXADAVXPALCQRCAHLWQRR

SEQ ID NO: 4172 - protein, 51 aa, Homo sapiens [sequence omitted]

SEQ ID NO: 4173 - protein, 130 aa, Homo sapiens
  SIGNAL -68..-1
  UNSURE 25: Xaa = Gly,Val
MTRLLGYVDPLDPSFVAAVITITFNPLYWNVVARWEHKTRKLSRAFGSPYLACYSLSITILLLNFLRSHCFTQAMLSQPRMESLDTPAAYSLXLALLGLGVVLVLSSFFALGFAGTFLGDYFGILKEARV

SEQ ID NO: 4174 - protein, 96 aa, Homo sapiens
  SIGNAL -91..-1
MSHFLLVTPSWDDQIGTALVWSSQRARHRRRVISAFSQRYLVHLIGTGWTVGAAHRGYSFVVVIQHGCGVVVSVTAGSLWSITQFFTEIAAASDQD

SEQ ID NO: 4175 - protein, 53 aa, Homo sapiens
  SIGNAL -17..-1
MSKKVVSWLQSTLVADAVNTVEMTKDLEYYVNIVDKAAAGFKRIDSYFEMSSA

SEQ ID NO: 4176 - protein, 102 aa, Homo sapiens
  SIGNAL -75..-1
  UNSURE 23: Xaa = Ala,Asp,Gly,Val
  UNSURE -8: Xaa = Cys,Trp
MLGPWGFRALGHLVLNPLPRSVCEGPCRYCVHHAHVYTSTHRCTHRCTHAPAPALHTCTCTPALAPAXVCAQSSSSNPASVPFPTHCLSLLSRPGTLXEPVC

SEQ ID NO: 4177 - protein, 131 aa, Homo sapiens
  SIGNAL -124..-1
MTSLTPGCRYSVRVSPQMANRIVDSARSILNKFIPDIYIYTDHMKGVNSGKSPGFGLSLVAETTSGTFLSAELASNPQGQGAAVLPEDLGRNCARLLLEEIYRGGCVDSTNQSLALLLMTLGQQDVSKVLL

SEQ ID NO: 4178 - protein, 163 aa, Homo sapiens
  SIGNAL -55..-1
  UNSURE -26: Xaa = Leu,Val
MPMISVLGKMFLWQREGPGGRWTCQTSRRXSSDPAWAVEWIELPRGLSLSSLGSARTLRGWSRSSRPSSVDSQDLPEVNVGDTVAMLPKSRRALTIQEIAALARSSLHGISQVVKDHVTKPTAMAQGRVAHLIEWKGWSKPSDSPAALESAFSSYSDLSEGEQ

SEQ ID NO: 4179 - protein, 165 aa, Homo sapiens
  SIGNAL -13..-1
MLYLQGWSMPAVAEVKLRDDQYTLEHMHAFGMYNYLHCDSWYQDSVYYIDTLGRIMNLTVMLDTALGKPREVFRLPTDLTACDNRLCASIHFSSSTWVTLSDGTGRLYVIGTGERGNSASEKWEIMFNEELGDPFIIIHSISLLNAEEHSIATLLLRIEKEELDM

SEQ ID NO: 4180 - protein, 62 aa, Homo sapiens
  SIGNAL -58..-1
MDESNLRDLNRKSNQVKTCKAKIELLGSYDPQKQLIIEDPIMGMTLTLRRCTSSVSGAAERS

SEQ ID NO: 4181 - protein, 57 aa, Homo sapiens
  SIGNAL -23..-1
MGFCHVGQAVLELLSSGDPTVSASQGAGITGVTTVPSLSHHAGLIFKFFVETGSHYV

SEQ ID NO: 4182 - protein, 53 aa, Homo sapiens
  SIGNAL -23..-1
  UNSURE 10: Xaa = Arg,Ser,Thr
  UNSURE 11: Xaa = Asp,Glu,His,Lys,Asn,Gln
MGFCHVGQAVLELLSSGDPTVSASQGAGITGVXXLVPSLSHHAGLIFKFFVET

SEQ ID NO: 4183 - protein, 57 aa, Homo sapiens
  SIGNAL -23..-1
  UNSURE 10: Xaa = Arg,Thr
MGFCHVGQAVLELLSSGDPTVSASQGAGITGVXPVPSLSHHAGLIFKFFVETGVSLC

SEQ ID NO: 4184 - protein, 85 aa, Homo sapiens
  SIGNAL -66..-1
MADRVHRTRCPHLREENSEPRGKDLPAVVWQARGRRCTGTQPNQPKETMGGEALTLSFADVGPAASHSRADGPQAYRSQGSFTSC

SEQ ID NO: 4185 - protein, 55 aa, Homo sapiens
  SIGNAL -18..-1
MILAHCSLHLLGSGDSHASVSRVPGTTGVHRHARLLFVFLVETEFCHVGQAGLGL

SEQ ID NO: 4186 - protein, 59 aa, Homo sapiens
  SIGNAL -23..-1
  UNSURE 13: Xaa = Ala,Pro
  UNSURE 11: Xaa = Pro,Thr
  UNSURE 16: Xaa = Ser,Thr
MGFCHVGQAVLELLSSGDPTVSASQGAGITGVTXVXSLXHHAGLIFKFFVETGLIMLPG

SEQ ID NO: 4187 - protein, 52 aa, Homo sapiens
  SIGNAL -30..-1
  UNSURE 15: Xaa =  * ,Trp
  UNSURE 17: Xaa = Ala,Thr
  UNSURE 16: Xaa = Arg,Ser
  UNSURE -22: Xaa = Cys,Phe
  UNSURE -25: Xaa = His,Arg
  UNSURE 7: Xaa = Lys,Arg
MVALEXGGXGRTPTDWPVLPTAPAPACATASTRSRFXARPCLTIXXXCWASS

SEQ ID NO: 4188 - protein, 65 aa, Homo sapiens
  SIGNAL -62..-1
MATLIGLSIKVKLLRSLPQRFKMDVHITPGTHASEHAGKCGLVVRVLARAPLSSLRLPPCTGVYG

SEQ ID NO: 4189 - protein, 70 aa, Homo sapiens
  SIGNAL -23..-1
  UNSURE 11: Xaa = Pro,Thr
MGFCHVGQAVLELLSSGDPTVSASQGAGITGVTXVPSLSHHAGLIFKFFVETGSHYVAQGGVKLQVSSDP

SEQ ID NO: 4190 - protein, 106 aa, Homo sapiens
  SIGNAL -26..-1
  UNSURE -20: Xaa = Gln,Arg
  UNSURE -21: Xaa = Pro,Ser
MAGPRXXWRDQLLFMSIIVLVIVVICLMLYALLWEAGNLTDLPNLRIGFYNFCLWNEDTSTLQCHQFPELEALGVPRVGLGLARLGVYGSLVLTLFAPQPLLLAQC

SEQ ID NO: 4191 - protein, 57 aa, Homo sapiens; identical to SEQ ID NO: 4181
  SIGNAL -23..-1

SEQ ID NO: 4192 - protein, 64 aa, Homo sapiens
  SIGNAL -23..-1
MGFCHVGQAVLELLSSGDPTVSASQGAGITGVTPVPSLSHHAGLIFKFFVETGSHYVAQGGVKL

SEQ ID NO: 4193 - protein, 75 aa, Homo sapiens
  SIGNAL -50..-1
MKRDVQEGQARCLAHLGRHMEALEIAANLENKATNTDHLTTVLYLQLAICSSLQNLEKTIFCLQKLISLHPFNPW

SEQ ID NO: 4194 - protein, 96 aa, Homo sapiens
  SIGNAL -36..-1
  UNSURE 52: Xaa =  * ,Leu,Ser
MVVQEMKKYFPSERRNKPSTLDALNYALRCVHSVQANSEFFQILSQNGAPQADVSMYSLEELATIASEHTSKNTDTFVAVFSFLSGRXVHISEQAA

SEQ ID NO: 4195 - protein, 57 aa, Homo sapiens
  SIGNAL -23..-1
  UNSURE 13: Xaa =  * ,Cys,Tyr
  UNSURE 10: Xaa = Arg,Thr
MGFCHVGQAVLELLSSGDPTVSASQGAGITGVXTCXPSLSHHAGLIFKFFVETGSHY

SEQ ID NO: 4196 - protein, 51 aa, Homo sapiens
  SIGNAL -22..-1
MRTDHRAVTFAPKLLLHCPVQSECCHNQPGRSTERESRERSPFSLLSSRTT

SEQ ID NO: 4197 - protein, 120 aa, Homo sapiens
  SIGNAL -97..-1
  UNSURE 5: Xaa = Pro,Thr
MSGGEQKPERYYVGVDVGTGSVRAALVDQSGVLLAFADQPIKKWEPQFNHHEQSSEDIWAACCVVTKKVVQGIDLNQIRGLGFDATCSLVVWISSFTHYQSXGRDSIETSSCGWTSSSQS

SEQ ID NO: 4198 - protein, 90 aa, Homo sapiens
  SIGNAL -66..-1
MQVGGNASASSFFHQHGCSTNDTNAKYNSRAAQLYREKIKSLASQATRKHGTDLWLDSCVVPPLSPPPKEEDFFASHVSPEVSDTAWASA

SEQ ID NO: 4199 - protein, 83 aa, Homo sapiens
  SIGNAL -52..-1
  UNSURE -46: Xaa = Ala,Gly
  UNSURE -48: Xaa = Cys,Trp
MPRHXSXAGCCTRDTRETQPAASPSTDFPRRTTRGEACGWPTASGWTPAARACGTRHPSTSTSAPNTLRRTALSWWESVDITG

SEQ ID NO: 4200 - protein, 160 aa, Homo sapiens
  SIGNAL -67..-1
MAAQGSPSSSPSDDSTTSGSLPELPPTSTATSRSPPESKGSSRSSLLQWTCPEDSLPLAVFYGPLDAKNPLLASCEKEIQELLGFMRKKKALATTEEEKHEFRRRCATSLFNIWTKYAPRLPADYYNEKLLKVGDSLCQMKEYKLALLQCYGRYLQQFNT

SEQ ID NO: 4201 - protein, 124 aa, Homo sapiens
  SIGNAL -102..-1
  UNSURE 2: Xaa = Ile,Met
  UNSURE -52: Xaa = Phe,Val
MNRFCIWTPRKTPTTSTFMLRIPGSLPTSPPSSPRPHLLCHQSCPRRPAGXARSVWRPCPPPRSPTTSCEPHRVLPDLHIPTVKENPALLVCLARVVPRIKGLXYRDACAVIREQGLRPNKYHV

SEQ ID NO: 4202 - protein, 131 aa, Homo sapiens
  SIGNAL -79..-1
  UNSURE -38: Xaa = Ala,Ser
  UNSURE 9: Xaa = Ala,Thr
  UNSURE -49: Xaa = Arg,Trp
  UNSURE -35: Xaa = Glu,Lys
  UNSURE -34: Xaa = His,Pro
  UNSURE -20: Xaa = Phe,Leu
MSLWLCFQCPLGVSKSNKKRINLCASTPETXTKFTQDNLCRXQRXXLDSANLWVLVDCIXRDTSEDLGLQCDAVNLAFGRRCEELEDXRHKLQHHLHKMLREITDQKQRGGTEGGHQGQGGTSAHSPDPSV

SEQ ID NO: 4203 - protein, 150 aa, Homo sapiens
  SIGNAL -53..-1
MERQEESLSARPALETEGLRFLHTTVGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGKSYKGNAKKPQEEDSPGPSTSSVLK

SEQ ID NO: 4204 - protein, 131 aa, Homo sapiens
  SIGNAL -17..-1
  UNSURE 24: Xaa = Asn,Ser
MDRPGFVAALVAGGVAGVSVDLILFPLDTIKTRLQSPQGFXKAGGFHGIYAGVPSAAIGSFPNAAAFFITYEYVKWFLHADSSSYLTPMKHMLAASAGEVVACLIRVPSEVVKQRAQVSASTRTFQIFSNI

SEQ ID NO: 4205 - protein, 107 aa, Homo sapiens
  SIGNAL -22..-1
  UNSURE 43: Xaa = Cys,Ser
MSQTVSTGESIILSCSVPDTLPNGPVLWFKGTGPNRKLIYNFKQGNFPRVKEIGDTTKPGNTDFXTRIREISLADAGTYYCVKFIKGRAIKEYQSGRGTQVFVTEQN

SEQ ID NO: 4206 - protein, 113 aa, Homo sapiens
  SIGNAL -36..-1
MMTEKHEDHCLKSCSGHSYIRKNWLGCIVFPFSALLQQSEISGTFQVTIPPVLLGYTWSNTYVFPKEDSNEQNLKECTFLNIFATIEPQISYVTCNPTLDKFLDQTEVLQRAQ

SEQ ID NO: 4207 - protein, 155 aa, Homo sapiens
  SIGNAL -121..-1
MVVFGYEAGTKPRDSGVVPVGTEEAPKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVLWCFL

SEQ ID NO: 4208 - protein, 140 aa, Homo sapiens
  SIGNAL -125..-1
MGRALIHHQRHSLSKMVYQTSLCSCSVNIRVPNRHFAAATKSAKKTKKGAKEKTPDEKKDEIEKIKAYPYMEGEPEDDVYLKRLYPRQIYEVEKAVHLLKKFQILDFTSPKQSVYLDLTLDMALGKRKTWSHLPVFLVCH

SEQ ID NO: 4209 - protein, 183 aa, Homo sapiens
  SIGNAL -86..-1
MALLFARSLRLCRWGAKRLGVASTEAQRGVSFKLEEKTAHSSLALFRDDTGVKYGLVGLEPTKVALNVERFREWAVVLADTAVTSGRHYWEVTVKRSQQFRIGVADVDMSRDSCIGVDDRSWVFTYAQRKWYTMLANEKAPVEGIGQPEKVGLLLEYEAQKLSLVDVSQVSVVHTLQTDFRGP

SEQ ID NO: 4210 - protein, 98 aa, Homo sapiens
  SIGNAL -15..-1
MCLGFFSPVPGSTSSATNVSMVVSADPLSSERAEMNILEINQELRSQLAESNQQFRDLKEKFLISQATAYSLANQLKKYKKQNDLEEVKGQETVAPRL

SEQ ID NO: 4211 - protein, 90 aa, Homo sapiens
  SIGNAL -15..-1
MSLLMFTQLLLCGFLYVRVDGSRLRQEDFPPRIVEHPSDVIVSKGEPTTLNCKAEGRPTPTIEWYKDGERVETDKDDPPVPQDASASGSL

SEQ ID NO: 4212 - protein, 154 aa, Homo sapiens
  SIGNAL -18..-1
MATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPI

SEQ ID NO: 4213 - protein, 109 aa, Homo sapiens
  SIGNAL -67..-1
  UNSURE -65: Xaa = Ala,Gly,Pro,Arg
  UNSURE -55: Xaa = Leu,Val
  UNSURE -64: Xaa = Phe,Ile,Leu,Met,Val
MAXXALPARRDRXASPLRHEALSAAPEEAPSQPPPPAAVGTRWELLGSLLPKACTAALFLLMTVVTSSLHSSLPAYASMQPVAKTGGGGGLFTTEILSSGWAGFLAGCL

SEQ ID NO: 4214 - protein, 96 aa, Homo sapiens
  SIGNAL -71..-1
  UNSURE -57: Xaa = Ala,Gly
  UNSURE -37: Xaa = Ala,Pro
  UNSURE -40: Xaa = Leu,Pro
MAPKFFVSTGISPMXPIATAKPTAPPVLPASXLRXPLPTESHSILRAPSLKEWLRLDNTRSLQLLSGPCLAHHLHQRPCPREARRPPELLPRWLRG

SEQ ID NO: 4215 - protein, 70 aa, Homo sapiens
  SIGNAL -38..-1
  UNSURE 2: Xaa = Cys,Pro,Arg,Ser
  UNSURE 16: Xaa = Glu,Gln
  UNSURE 3: Xaa = Phe,Tyr
MGRRGAFGGPPGAWTYAGRPRPTPPLVSGSLLPFGGVCVXXNFLYGKIDKKKIXREVFNCNKLAPCGPRL

SEQ ID NO: 4216 - protein, 105 aa, Homo sapiens
  SIGNAL -78..-1
MARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLLF

SEQ ID NO: 4217 - protein, 160 aa, Homo sapiens
  SIGNAL -103..-1
  UNSURE 40: Xaa = Ala,Gly
MQRGALSPVLMLSAAPEPPPRPPPALSPPGSGPGSGSRHGSARPGPTPEPSGSLGAALDSSLRAAVAFKAEGQRCYREKKFREAIGKYHRALLQLKAAQGARPSGLPAPAPGPTSSPGPARLSEEQRRLVESTEVECYDSLTXCLLQSELVNYERVREYC

SEQ ID NO: 4218 - protein, 73 aa, Homo sapiens
  SIGNAL -30..-1
  UNSURE 23: Xaa = Cys,Gly
MDVADFEWVMWFTSFRNVIIFALSGHVLFAKLCTMVAPKLRSWMYAVYGALAXDGHNGPLVPAAAAWSLCGLY

SEQ ID NO: 4219 - protein, 97 aa, Homo sapiens
  SIGNAL -20..-1
  UNSURE -8,-5,12,13: Xaa = His,Gln
  UNSURE -2: Xaa = Ile,Asn
  UNSURE -3: Xaa = Ser,Thr
MPRATPKIPLNLXLHXGXXSREPPGAQTPAPXXGKSFKGGIWKRKEEGHQPGGGVLKMTIRNWGEGRGMVDFCGGGVSLSAAQVPPASLTREQAPIC

SEQ ID NO: 4220 - protein, 99 aa, Homo sapiens
  SIGNAL -26..-1
MTAPFPLARSGLAGTRALMVVSLVLGFLAMFVATMGMKCTRCGGDDKVKKARIAMGGGIIFIVAGLAALVACSWYGHQIVTDFYNPLIPTNIKYEFGPA

SEQ ID NO: 4221 - protein, 219 aa, Homo sapiens
  SIGNAL -16..-1
  UNSURE 57: Xaa = Asp,Gly
  UNSURE 58: Xaa = Cys,Ser
MENFSLLSISGPPISSSALSAFPDIMFSRATSLPDIAKTAVPTEASSPAQALPPQYQSIIVRQGIQNTVLSPXXSLGDTQHGEKLRRNCTIYRPWFSPYSYFVCADKESQLEAYDFPEVQQDEGKWDNCLSEDMAENICSSSSSPENTCPREATKKSRHGLDSITSQDILMASRWHPAQQNGYKCVACAACTPPWTSSRATSRGASGRASAARCTTASS

SEQ ID NO: 4222 - protein, 120 aa, Homo sapiens
  SIGNAL -33..-1
  UNSURE 74: Xaa = Ala,Gly
  UNSURE 73: Xaa = Ala,Pro
  UNSURE 69: Xaa = His,Gln
  UNSURE 62: Xaa = Phe,Leu
MAQPAAPSLTRPFLAEAPTALVPHSPLPGALSSAPGPKQPPTASTGPELLLLPLSSFMPCGAAAPAGCHHSGLLLGISPRSPHPWPVSLTPIYSXLGTSQRXPLAXXLPASRPCGRPCAS

SEQ ID NO: 4223 - protein, 60 aa, Homo sapiens
  SIGNAL -56..-1
  UNSURE -10: Xaa =  * ,Ser
  UNSURE -22: Xaa = Ala,Thr
  UNSURE -23: Xaa = Ile,Lys,Arg,Thr
MINLMISLTLISLRNSILNTLVFRQENQVSQKGXXCLRAGCDASCLXSPALWGGRGRWIT

SEQ ID NO: 4224 - protein, 136 aa, Homo sapiens
  SIGNAL -41..-1
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKRLA

SEQ ID NO: 4225 - protein, 55 aa, Homo sapiens [sequence omitted]

SEQ ID NO: 4226 - protein, 68 aa, Homo sapiens
  SIGNAL -30..-1
MDVADFEWVMWFTSFRNVIIFALSGHVLFAKLCTMVAPKLRSWMYAVYGALAVMGTMGPWYLLLLLGH

SEQ ID NO: 4227 - protein, 158 aa, Homo sapiens
  SIGNAL -29..-1
MELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILR

SEQ ID NO: 4228 - protein, 61 aa, Homo sapiens
  SIGNAL -36..-1
MGCALLGCGRECPGCVIATMCGPVKLCLSCLCSLHSPPLPSHTPQLLDPLKDSSQLCPKLL

SEQ ID NO: 4229 - protein, 80 aa, Homo sapiens
  SIGNAL -20..-1
  UNSURE 55: Xaa = Phe,Tyr
MILLNNSHKLLALYKSLARSIPESLKVYGSVYHINHGNPFNMEVLVDSWPEYQMVIIRPQKQEMTDDMDSYTNVXRMFSK

SEQ ID NO: 4230 - protein, 79 aa, Homo sapiens
  SIGNAL -41..-1
MGTPGEGLGRCSHALIRGVPESLASGEGAGAGLPALDLAKAQREHGVLGGKLRQRLGLQLLELPPEESLPLGPLLGDTA

SEQ ID NO: 4231 - protein, 125 aa, Homo sapiens
  SIGNAL -14..-1
  UNSURE 79: Xaa = Lys,Arg
MAVPAAAMGPLALGQSGPGSMAPWCSVSSGPSRYVLGMQELFRGHSKTREFLAHSARVHSVAWSCDGRRLASGVLRQDGQRLLAGEGPGWSKXTIIGDMGIVWTSFVGIQVILTYLLRRPEIKPF

SEQ ID NO: 4232 - protein, 63 aa, Homo sapiens
  SIGNAL -55..-1
  UNSURE -10: Xaa = Ala,Cys,Asp,Phe,Gly,His,Ile,Leu,Asn,Pro,Arg,Ser,Thr,Val,Tyr
  UNSURE -32: Xaa = Ile,Lys,Arg,Thr
  UNSURE -18: Xaa = Pro,Arg
MPERSHLTEPSSSGGCLVTPSRRXPPLPHLPMDSSPQXLLHPHLLXLPSPQLTCPISIRCPGG

SEQ ID NO: 4233 - protein, 66 aa, Homo sapiens
  SIGNAL -20..-1
MYQMTFFFLFEMESCSVAQAGVILAYCNLRLPGSSDSHASASRVAGITGARPHARLMFVFLVETGF

SEQ ID NO: 4234 - protein, 54 aa, Homo sapiens
  SIGNAL -17..-1
MGSGWLTAVASLLPSPGNSELPVQALGRRGGRDWARNEAGRDLEKPPRLHCSGR

SEQ ID NO: 4235 - protein, 55 aa, Homo sapiens
  SIGNAL -41..-1
  UNSURE -35: Xaa =  * ,Ala,Gly,Ser
  UNSURE -22: Xaa = Cys,Trp
  UNSURE 1: Xaa = Gly,Val
  UNSURE -38: Xaa = His,Gln
  UNSURE -1: Xaa = Ile,Leu,Ser,Thr
  UNSURE -37,-36: Xaa = Leu,Val
MTAXXXXQSLLPVALTPTHXSSAVGFSWALALVGLCHIVRXXGCCVVPSSPAGSP

SEQ ID NO: 4236 - protein, 141 aa, Homo sapiens
  SIGNAL -33..-1
MSWTVPVVRASQRMSSVGANFLCLGMALCLRQATRIPLNGTWLFTPVSKMATVKSELIERFTSEKPVHHSKVSIIGTGSVGMACAISILLKGLSDELALVDLDEDKLKGETMDLQHGSPFTKMPNIVCSKDYFVTANSNLV

SEQ ID NO: 4237 - protein, 121 aa, Homo sapiens
  SIGNAL -107..-1
MSGTLEKVLCLRNNTIFKQAFSLLRFRTSGEKPIYSVGGILLSISRPYKTKPTHGIGKYKHLIKAEEPKKKKGKVEVRAINLGTDYEYGVLNIHLTAYDMTLAESYAQYVHNLCNSLSIKV

SEQ ID NO: 4238 - protein, 63 aa, Homo sapiens
  SIGNAL -51..-1
  UNSURE -12: Xaa = Ala,Pro
  UNSURE -42: Xaa = Ala,Pro,Ser,Thr
  UNSURE -38: Xaa = His,Leu,Pro,Arg
  UNSURE -6: Xaa = Leu,Val
  UNSURE -9: Xaa = Lys,Asn
MTSPFLIDFXARSXSPLGKYHSDLACTPGSPPPCRKGFSXFLXLEXPLATGQGYSDHPVHTAG

SEQ ID NO: 4239 - protein, 58 aa, Homo sapiens
  SIGNAL -49..-1
  UNSURE 2: Xaa = Cys,Trp
MSQRGTASGGEHEGSLRMKTELLVQMDGLARSEDLVFVLAASNLPCLKAIXTPAWRQS

SEQ ID NO: 4240 - protein, 128 aa, Homo sapiens
  SIGNAL -14..-1
MLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKGNCQQLTFSIPPPHVVCRVIYKTY

SEQ ID NO: 4241 - protein, 78 aa, Homo sapiens
  SIGNAL -42..-1
  UNSURE 22: Xaa = Ala,Pro
MTMPWGQLGKDGWLGGTHCVACLAPPAGSVLYHLFMCHQGGSAVYARLLALDMCGVCLVNTLGXCHHPLHPGLQPGCA

SEQ ID NO: 4242 - protein, 95 aa, Homo sapiens
  SIGNAL -93..-1
  UNSURE -10: Xaa =  * ,Gly,Leu,Val
  UNSURE -34,-3: Xaa = Ala,Gly,Pro,Arg
  UNSURE -7: Xaa = Ala,Pro
  UNSURE -14: Xaa = Ala,Pro,Ser
  UNSURE -20: Xaa = Asn,Ser
  UNSURE -8: Xaa = Cys,Gly,Trp
  UNSURE -49: Xaa = Cys,Phe,Tyr
  UNSURE -15: Xaa = Ile,Met
  UNSURE -50: Xaa = Lys,Arg
  UNSURE -48: Xaa = Pro,Arg
  UNSURE -47: Xaa = Pro,Arg,Thr
MSWRMFCNVKLSVLATRLQFHCFQAGNGIHGGLNISSGRSQNVXXXXHADLSSTTSWAFXCRKLNKAREMDSRXSYLQXXVPLXLXXFPSXFCRT

SEQ ID NO: 4243 - protein, 185 aa, Homo sapiens
  SIGNAL -105..-1
  UNSURE -62: Xaa = Ala,Pro
  UNSURE -87: Xaa = Arg,Thr
  UNSURE 3: Xaa = Gly,Arg
MLEAPGPSDGCELSNPSAXESAVPGRCWKCSQDCISVGPRPSRXDHLREAGITAVLTVDSEEPSFKAGPGVEDLWRLFVPALDKPETDLLSHLDRCVAFIGQARAEGXAVLVHCHAGVSRSVAIITAFLMKTDQLPFEKAYEKLQILKPEAKMNEGFEWQLKLYQAMGYEVDTSSAIYKQYRLQK

SEQ ID NO: 4244 - protein, 109 aa, Homo sapiens
  UNSURE 101: Xaa =  * ,Glu,Lys,Gln
MEKQNTDKCHVSSHTRLTESSVHDFKTEDQEVITTDFGQVVLRPKEARHANVNPNEDGESSSSSPTEENAATDNIAFMITETTVQVLSSGEVHDIVSQKGXDIQTVNID

SEQ ID NO: 4245 - protein, 63 aa, Homo sapiens
  UNSURE 45: Xaa = Ala,Asp,Gly,Val
  UNSURE 18: Xaa = Ala,Ser
  UNSURE 15: Xaa = Pro,Arg
MNETNKTLVGPSELXRAXAVTPGQALGSGMACAGRICAGGCGPLXPHCTCCQMPPLPPIPCQL

SEQ ID NO: 4246 - protein, 124 aa, Homo sapiens
MPPKNKEKGKKSGAQKKKKNWGADVVAESRHRLVVLEKELLRDHLEMSRQCHALQEDMQTRSKQLEEEVKGLRGQLEACQREAAAAREEAEQALGERDQALAQLRAHMADMEAKYEEILHDSLD

SEQ ID NO: 4247 - protein, 69 aa, Homo sapiens
MGLWDHQSEPFVLQLEWVLGKKFMHLSVSNPTDDFAHEMIRYGDDKRSIDIHLKKDIRRGVVNNQQTDW

SEQ ID NO: 4248 - protein, 139 aa, Homo sapiens
MEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGA

SEQ ID NO: 4249 - protein, 61 aa, Homo sapiens
  UNSURE 44: Xaa = Gly,Arg,Trp
MKLALGSRSQEEGPTRARAASPQPCCDPISVLHPGRGPPQSVQXALGTTSTKRCHGSKPWR

SEQ ID NO: 4250 - protein, 140 aa, Homo sapiens
  UNSURE 140: Xaa = Asp,Glu
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSX

SEQ ID NO: 4251 - protein, 141 aa, Homo sapiens
  UNSURE 43: Xaa = Leu,Val
MENTLDVIEHLANNVKEKLSEKQAYSFQLSKETEEQKPKLERXTKQCAKLTKEIRLLKDTKDETMEEQDIKLREMKQFHKVIDEMLVDIIEENTEIRIILQTYFQQSGLELPTASTKGSRQSSRSPSHTSLSARSSREYKY

SEQ ID NO: 4252 - protein, 90 aa, Homo sapiens
  UNSURE 47: Xaa =  * ,Cys
  UNSURE 44: Xaa = Arg,Thr
  UNSURE 55: Xaa = Asp,Glu,His,Gln
  UNSURE 86: Xaa = Glu,Gln
  UNSURE 57: Xaa = His,Asn
  UNSURE 85: Xaa = Leu,Val
  UNSURE 39,50: Xaa = Lys,Thr
  UNSURE 62,71,75: Xaa = Phe,Leu
  UNSURE 30,45,46,74,78,87: Xaa = Pro,Arg
  UNSURE 84: Xaa = Ser,Tyr
MKRAGEAADQMARGGMQPRTGPTHCPRLRXELGETVCLXSICYXXXXIMXACDPXSXPRKQXSSHQWVKGXSDXXLKXKGTARXXXXQMV

SEQ ID NO: 4253 - protein, 54 aa, Homo sapiens
  UNSURE 49: Xaa = Asp,His
  UNSURE 4: Xaa = His,Pro,Gln
  UNSURE 25: Xaa = Leu,Gln
MGKXLSLLKMQKLARCGVTRLDSQXLGRLRQENTSNQEAEVAVSQDWRXCAPFW

SEQ ID NO: 4254 - protein, 151 aa, Homo sapiens
  UNSURE 6: Xaa = Phe,Ile,Leu,Val
MDAILXSLTRKVKMPDVELFVNLGDWPLEKKKSNSNIHPIFSWCGSTDSKDIVMPTYDLTDSVLETMGRVSLDMMSVQANTGPPWESKNSTAVWRGRDSRKERLELVKLSRKHPELIDAAFTNFFFFKHDENLYGPIVKHISFFDFFKHKY

SEQ ID NO: 4255 - protein, 134 aa, Homo sapiens
  UNSURE 5: Xaa = Ala,Pro,Ser,Thr
MAGAXTQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGN

SEQ ID NO: 4256 - protein, 81 aa, Homo sapiens
MLIESGPQVSLVLSKGCTEAKDQEPRVTEHRMGPGLSLISYTFVCRQEDFCNNLVNSLPLWAPQPPADPGSLRCPVCLSME

SEQ ID NO: 4257 - protein, 112 aa, Homo sapiens
MCVRRSLVGLTFCTCYLTSYLTNKYVLSVLKFTYPTLFQGWQTLIGGLLLHVSWKLGWVEINSSSRSHVLVWLPASVLFVGIIYAGSRALSRLKTSPARSVVPSSSWPQQDA

SEQ ID NO: 4258 - protein, 68 aa, Homo sapiens
MTRTELSPAQIKQLLQNPPAGVDPIIWEQAKVDNPDSEKLIPVPMVGFKELLRRLKVQDQMTKQHQTR

SEQ ID NO: 4259 - protein, 77 aa, Homo sapiens
MDTCGVGYVALGEAGPVGNMTVVDSPGQEVLNQLDVKTSSEMTSAEASVEMSLPTPLPGFEDSPDQRRLPPEQESLS

SEQ ID NO: 4260 - protein, 77 aa, Homo sapiens
MLTLGEQLPLVTRFRRHSVHPPRLDLFFIWIFCFYVFLKNNFLGNLLDYNRSSSPMQRKGSYCWDFEEMVLEQLEIH

SEQ ID NO: 4261 - protein, 99 aa, Homo sapiens
MAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSV

SEQ ID NO: 4262 - protein, 92 aa, Homo sapiens
  UNSURE 23: Xaa = Ala,Cys,Asp,Phe,Gly,His,Ile,Leu,Asn,Pro,Arg,Ser,Thr,Val,Tyr
MSFWLSLCSSSLILNFLSIRASXPPPTPQPLPPWSPFRYAKPILGRVHLTRTKQKAHNNKNVSEKKSFKKIVESKSQTIKKLRFLGKKKKKK

SEQ ID NO: 4263 - protein, 50 aa, Homo sapiens [sequence omitted]

SEQ ID NO: 4264 - protein, 75 aa, Homo sapiens
MVKTQQATGQPDSPPRPALTGRRVPATADADEKAFGGWRKIWVSHIFINRCRGSVAPGAECGLARQVRAEVTKWI

SEQ ID NO: 4265 - protein, 139 aa, Homo sapiens
  UNSURE 36,40: Xaa = Ala,Asp
  UNSURE 20: Xaa = Ala,Glu
  UNSURE 21,22,24: Xaa = Ala,Val
  UNSURE 103: Xaa = Cys,Trp
  UNSURE 91: Xaa = Gly,Arg
  UNSURE 131: Xaa = Gly,Val
  UNSURE 47: Xaa = Ile,Leu
  UNSURE 107: Xaa = Leu,Arg
  UNSURE 80: Xaa = Ser,Thr
MATPAVPVSAPPATPTPVPXXXPXSVPAPTPAPAAXPVPXAGSSLIXRPCGSSGCNCGSWPDPGLSASSSADPSARSAWXCSSRALPRRPXGQAAPSHFGLHXGQLXETQRGPARVIGTLLGTVDKHSVEXTNCFSVPH

SEQ ID NO: 4266 - protein, 115 aa, Homo sapiens
MGNSALRVHVETAQKTGVFQLKDRGLTEFPADLQKLTSNLRTIDLSNNKIESLPPLLIGKFTLLKSLSLNNNKLTVLPDEICNLKKLETLSLNNNHLRELPSTFGQLSALKTLSS

SEQ ID NO: 4267 - protein, 95 aa, Homo sapiens
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGA

SEQ ID NO: 4268 - protein, 69 aa, Homo sapiens
  UNSURE 52: Xaa = Gly,Arg
MNLNSLGYLVLVLQTVFNNPWIQIGRVWWWVPVVPATREAEAGEWRGPGRRXCSELRSCHCTPAWATER

SEQ ID NO: 4269 - protein, 100 aa, Homo sapiens
MSTAIREVGVWRQTRTLLLKNYLIKCRTKKSSVQEILFPLFFLFWLILISMMHPNKKYEEVPNIELNPMDKFTLSNLILGYTPVTNITSSIMQKVSTDHL

SEQ ID NO: 4270 - protein, 67 aa, Homo sapiens
  UNSURE 59: Xaa = Ala,Gly
  UNSURE 63: Xaa = Ala,Pro
  UNSURE 46: Xaa = Phe,Ile
MAAMAVGGAGGSRVSSGRDLNCVPEIADTLGAVAKQGFDFLCMPVXHPRFKREFIQEPXKNRXGTQT

SEQ ID NO: 4271 - protein, 86 aa, Homo sapiens
  UNSURE 47: Xaa =  * ,Glu
MAGYQLWSPWTPLDESFQWLRRTTPTPSSKHPFKASPCFPHTPSDLXVQLCFQEVTLVLDSPFLESGVSPKLPCHTSELRTMNKKG

SEQ ID NO: 4272 - protein, 50 aa, Homo sapiens
MQSWQYYVGSQSPFANIIKHFNIFVKVTNQVCTNLKITAGLGTMYDTLIV

SEQ ID NO: 4273 - protein, 108 aa, Homo sapiens
  UNSURE 108: Xaa =  * ,Cys,Trp
  UNSURE 106: Xaa = Asn,Ser
MAATEPILAATGSPAAVPPEKLEGAGSSSAPERNCVGSSLPEASPPAPEPSSPNAAVPEAIPTPRAAASAALELPLGPAPVSVAPQAEAEARSTPRSRSWRCWCKXSX

SEQ ID NO: 4274 - protein, 92 aa, Homo sapiens
  UNSURE 8: Xaa = Lys,Thr
MALYLTSXSSIHCAQGLLRKTEQSFRMNLPSPHSCSTISPNNKLEAEKMNIIKMMLLNQDLMGALALNFFHKISVQSRPRSQLRQHSGMIIF

SEQ ID NO: 4275 - protein, 61 aa, Homo sapiens
  UNSURE 51: Xaa = Leu,Met,Val
MTDALLPAAPQPLEKENDGYFRKGCNPLAQTGRSKLQNQRAALNQQILKAXRMRTRSGKPS

SEQ ID NO: 4276 - protein, 131 aa, Homo sapiens
  UNSURE 124: Xaa = Leu,Pro
  UNSURE 130: Xaa = Phe,Leu
MQKLKKSGSLLQLTFRDNADLRKCFLYQLSQKTGLQYFKNVVLVASPQDRYVPFHSARIEMCKTALKDRHTGPVYAEMINNLLGPLVEAKDCTLIRHNVFHALPNTANTPDRPTAHIAVLDSEXFLENFXG

SEQ ID NO: 4277 - protein, 59 aa, Homo sapiens
MVKPVSTKNTKISWVCWQVPVISATWEAEARNLLNPGGGGSREPGSRHCSAPRQWSETR

SEQ ID NO: 4278 - protein, 95 aa, Homo sapiens
  UNSURE 66: Xaa = Ile,Leu
MSLESLFQHIIFTEHQAEESRRLMREVRSEITRCREKIKKATEELNEEKIKLESKVQQFFEKSFFXQLLKAHENALEKQYSEITNHRNMLLQTFE

SEQ ID NO: 4279 - protein, 57 aa, Homo sapiens
  UNSURE 15: Xaa = Ala,Cys,Gly,Ser
MGSPTDPYKQADHQXWSQATRLGAMQKWRSAPGKAGECRKEGGLREAGGSLHPPVAW

SEQ ID NO: 4280 - protein, 166 aa, Homo sapiens
MAARSVSGITRRVFMWTVSGTPCREFWSRFRKEKEPVVVETVEEKKEPILVCPPLRSRAYTPPEDLQSRLESYVKEVFGSSLPSNWQDISLEDSRLKFNLLAHLADDLGHVVPNSRLHQMCRVRDVLDFYNVPIQDRSKFDELSASNLPPNFKNHLELLSNSEEKH

SEQ ID NO: 4281 - protein, 60 aa, Homo sapiens
MRWLGRTMVCDWRRFLPSSRPASPGTRGGMWRYREDNILAFDLCVGDHDWMGSGNGCTHR

SEQ ID NO: 4282 - protein, 81 aa, Homo sapiens
  UNSURE 75: Xaa =  * ,Arg
  UNSURE 2: Xaa = Ala,Asp,Glu,Val
  UNSURE 3: Xaa = Ala,Pro,Ser,Thr
  UNSURE 64: Xaa = Glu,Gly
MXXVKKLVVKGGKKKKQVLKFTLDCTHPVEDGIMDAANFEQFLQERIKVNGKAGNLGGGVVTIXRSKSKITVDIXGAFLQK

SEQ ID NO: 4283 - protein, 88 aa, Homo sapiens [sequence omitted]

SEQ ID NO: 4284 - protein, 53 aa, Homo sapiens
  UNSURE 48: Xaa = Cys,Gly
MGVVAATAGSASRSLRPQRTSHRLSVAARGASQPARAPASLPPRVPRXPPRAG

SEQ ID NO: 4285 - protein, 77 aa, Homo sapiens
  UNSURE 54,72,73: Xaa = Leu,Val
MEINIVDKYEKLEKVGEGTYGKVYKAQDKATGQLVALKKTRLEMDEEGIPPTAXREISLLNLLSHSIYIVRXXAVEQ

SEQ ID NO: 4286 - protein, 73 aa, Homo sapiens
MMANHLVKPDNRNCKRPRELESPVPDSPQLSSLGKSDSSFSEISGLFYKDEALEKDLNDVSKEINLMLSTYAK

SEQ ID NO: 4287 - protein, 50 aa, Homo sapiens
MEETEILLVKQNKPLNRKNEEAVSTSGRNEPGRGTGTISEAMPLRLETCP

SEQ ID NO: 4288 - protein, 60 aa, Homo sapiens
MHIPDHISTGAVEMREMGMGLTRTRGIFITDPLTEVSKSQEQGCAPQKHRAQWKISFASI

SEQ ID NO: 4289 - protein, 81 aa, Homo sapiens
  UNSURE 40: Xaa = Cys,Trp
  UNSURE 8: Xaa = Phe,Leu
MTTSIRQXTSSSSIKGSSGLGGGSSRTSCRLSGGLGAGSXRLGSAGGLGSTLGGSSYSSCYNFGSGGGYAAALGVLMGCWL

SEQ ID NO: 4290 - protein, 61 aa, Homo sapiens [sequence omitted]

SEQ ID NO: 4291 - protein, 62 aa, Homo sapiens
MILDNHDISVEMGVKSNYEIRIRRPCEIKKTDCCKENLEKPRSPGEVTGFGEPLSPGEIRFI

SEQ ID NO: 4292 - protein, 109 aa, Homo sapiens
  UNSURE 109: Xaa =  * ,Gly,Arg
MRKKLEKKREEMHESRRRFLEHMQDKHIIKAVEQQQQEEEDEKMRKFIKAKKRLIQMGKEKEAETHMLMEKRRERIHNFLSELLKEKLDNEDMIIARDIAEAEAEWGTX

SEQ ID NO: 4293 - protein, 80 aa, Homo sapiens
  UNSURE 73: Xaa = Pro,Thr
MRRSELGEGFLQKSAKCSSSWISLSGCSNILDDNKKSKAFACGARWLTPVIPALCEAEDHWILLCLRKKKVGXINLNYSQ

SEQ ID NO: 4294 - protein, 73 aa, Homo sapiens
MEVLRPQLIRIDGRNYRKNPVQEQTYQHEEDEEDFYQGSMECADEPCDAYEVEQTPQGFRSTLRAPSLLYKHI

SEQ ID NO: 4295 - protein, 54 aa, Homo sapiens
MQGPYSLNGYRVRVYRQDSATQWFTGIITHHDLFTRTMIVMNDQVKILALHHDA

SEQ ID NO: 4296 - protein, 103 aa, Homo sapiens
MHTAQFRNTQEDSCRLNSWHRTEMKRVLTRKCQTFGETNFLLLPTQLKGKIKPSSPEQNRFSPNKYNDSAGLAVNSFTLLNSRAHLHPVLYIFYISIKRLLGS

SEQ ID NO: 4297 - protein, 126 aa, Homo sapiens
  UNSURE 122: Xaa =  * ,Leu,Ser
  UNSURE 106: Xaa = Asp,His
  UNSURE 103,120: Xaa = Pro,Arg
  UNSURE 116: Xaa = Pro,Gln
MASAKFGAAQQVENRGALSKRSRNDVSVREGDWNCPQCGNVNFSFRNVCNRGACGAPRPSPSPSPRMMPGPPASGYDRSPLFYGGGGGAPPPIPLGTGSYGAXYPXLGMRYGYGPXVGPXGXYGLF

SEQ ID NO: 4298 - protein, 63 aa, Homo sapiens
  UNSURE 3: Xaa = Cys,Trp
  UNSURE 50: Xaa = Gly,Val
  UNSURE 62: Xaa = Leu,Met
  UNSURE 24: Xaa = Leu,Val
MAXAEFSFHVPSLEELAGVMQKGXKDNFADVQVSVVDCPDLTKEPFTFPXKASVGKLELQKXE

SEQ ID NO: 4299 - protein, 58 aa, Homo sapiens
  UNSURE 36: Xaa = Ser,Thr
MSGMRRYEVALEAEEEIYWGCFYFFPWLRMWRRERXRAHPGEQKLEPLRGLMSCLSSG

SEQ ID NO: 4300 - protein, 133 aa, Homo sapiens
  UNSURE 96: Xaa = His,Gln
  UNSURE 105: Xaa = Met,Arg
MVVVMKFFRWVRRAWQRIISWVFFWRQKIKPTISGHPDSKKHSLKKMEKTLQVVETLRLVELPKEAKPKLGESPELADPCVLAKTTEETEVELGQXGQSLLQLPXTAVKSVSTLMVSALQSGWQMCSWKSSVS

SEQ ID NO: 4301 - protein, 70 aa, Homo sapiens
  UNSURE 59: Xaa = Phe,Ser
MTETLSCLQFLAYATDKEEEEGSEDDSNVKPDFMVTLKTDFSARCFLDQFEDDADGFIXPMDDKIPSKCS

SEQ ID NO: 4302 - protein, 58 aa, Homo sapiens
MSSVKRPRGRPPSSKKSDGSGTYTKLQNTQVRVMSEKKQRKKVESESKQEKANRIISE

SEQ ID NO: 4303 - protein, 125 aa, Homo sapiens
MAERYTAVIEVTSGGPWGDWAWPEMCPDGFFASGFSLKVEPPQGIPGDDTALNGIRLHCARGNVLGNTHVVESQSGSWGEWSEPLWCRGGAYLVAFSLRWRHPRPSVTTQQRTTCASAVSDGEEL

SEQ ID NO: 4304 - protein, 60 aa, Homo sapiens
  UNSURE 59: Xaa = Cys,Phe
MLTCYLTLIPRKFYKVSYMKNAVIGNNKQKANLIVLGAVPRLLYLLQQETSSTELKTEXA

SEQ ID NO: 4305 - protein, 121 aa, Homo sapiens
MSFIFEWIYNGFSSVLQFLGLYKKSEKLVFLGLDNAGKTTLLHMLKDDRLGQHVPTLHPTSEELTIAGMTFTTFDLGGHEQARRVWKNYLPAINGIVFLVDCADHSRLVESKVELNALMTD

SEQ ID NO: 4306 - protein, 140 aa, Homo sapiens
MGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLMRGTCG

SEQ ID NO: 4307 - protein, 152 aa, Homo sapiens
MSFRGGGRGGFNRGGGGGGFNRGGSSNHFRGGGGGGGGGNFRGGGRGGFGRGGGRGGFNKGQDQGPPERVVLLGEFLHPCEDDIVCKCTTDENKVPYFNAPVYLENKEQIGKVDEIFGQLRDFYFSVKLSENMKASSFKKLQKFYIDPYKLL

SEQ ID NO: 4308 - protein, 133 aa, Homo sapiens
MATSLDFKTYVDQACRAAEEFVNIYYETMDKRRRALTRLYLDKATLIWNGNAVSGLDALNNFFDTLPSSEFQVNMLDCQPVHEQATQSQTTVLVVTSGTVKFDGNKQHFFNQNFLLTAQSTPNNTVWKIASDC

SEQ ID NO: 4309 - protein, 68 aa, Homo sapiens
MVRHPGTDVTEQLDAGVRYLDLRIAHMLEGSEKNLHFVHMVYTTALVEDTLTEISEWLERHPREVGHP

SEQ ID NO: 4310 - protein, 147 aa, Homo sapiens
MCSGCCGAPPPIPLQVRCPVLQMLGTLPADFHSCTPLWELWTSEGPTLLQSSLQDPESCQVWDAWSERQLHKRSCCASCSSTVATESSRCEGTMLISGLSKLEASLLLQVWYGSTHLLCPSTLYYISMHLIREAREPAGTASRKASW

SEQ ID NO: 4311 - protein, 167 aa, Homo sapiens
MGTKMADLDSPPKLSGVQQPSEGVGGGRCSEISAELIRSLTELQELEAVYERLCGEEKVVERELDALLEQQNTIESKMVTLHRMGPNLQLIEGDAKQLAGMITFTCNLAENVSSKVRQLDLAKNRLYQAIQRADDILDLKFCMDGVQTALRSEDYEQAAAHTHRYLC

SEQ ID NO: 4312 - protein, 109 aa, Homo sapiens
MMPIKHAIQWLYPYSILLGHEGKMAVEGVLKRFELQDSGSSLLPKEIVKVEKMTENHVSQASVTIRIADKEVTIKVPAGTRLLSQPCASDRFIQTLSHKQLQAEMMQSH

SEQ ID NO: 4313 - protein, 82 aa, Homo sapiens
MSHRTQPTFLSLYFGSVSLSFLKSLIPPDEKHPQVWRGRPPFISRAWWHMPVIPATQEAEGRIAWAWETEVAVSQIAPLRSS

SEQ ID NO: 4314 - protein, 52 aa, Homo sapiens
MVWVRPLLNRHVENDLSAGRGDSRLGRPRRVDYLRSGVQDQPGQHGETPSLQ

SEQ ID NO: 4315 - protein, 139 aa, Homo sapiens
  UNSURE 129: Xaa = Glu,Lys
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRRXAWVSLAYFVS

SEQ ID NO: 4316 - protein, 128 aa, Homo sapiens
MSKLQSDSLRDAIASITNDSREKQRKFVETIELQIGLKNYDPQKDKRFSGSVKLPHIPRPKMKVCMLGDAQHVEEAERMGIDNMDVEALKKMNKNKKLVKKLAKKYHAFLASEAIIKQIPRLLGPGLN

SEQ ID NO: 4317 - protein, 74 aa, Homo sapiens
MNLLLEHSPRPFFRRVYTKFLVPSSAAKGEGPIEERIQRSIEGPRGKGCGSGWEGLQLAWWGRTSTTYPVGNKV

SEQ ID NO: 4318 - protein, 86 aa, Homo sapiens
  UNSURE 9,72: Xaa = Gly,Arg,Trp
  UNSURE 67: Xaa = Lys,Met,Arg,Thr
  UNSURE 2: Xaa = Phe,Leu
  UNSURE 85: Xaa = Ser,Tyr
MXLVDWFYXVLSSLGLWQKEAKILFLGLDNAGKTTLLHMLKDERLVQHQPTQYPTSEELSIGRIKFXAFDLXGHQIARRVWKDYXA

SEQ ID NO: 4319 - protein, 124 aa, Homo sapiens
MENQVLTPHVYWAQRHRELYLRVELSDVQNPAISITENVLHFKAQGHGAKGDNVYEFHLEFLDLVKPEPVYKLTQRQVNITVQKKVSQWWERLTKQEKRPLFLAPDFDRWLDESDAEMELRAKE

SEQ ID NO: 4320 - protein, 93 aa, Homo sapiens
MSNIYIQEPPTNGKVLLKTTAGDIDIELWSKEAPKACRNFIQLCLEAYYDNTIFHRVVPGFIVQGGDPTGTGSGGESIYGAPFKDEFHSRLRF

SEQ ID NO: 4321 - protein, 75 aa, Homo sapiens
MPRENLPIVFSWRKAQALELFSVYSTLPQASVICPGVWLKRKHAYICLAAIWAYASFWTTMPLIIAKVKSFFQRS

SEQ ID NO: 4322 - protein, 65 aa, Homo sapiens
  UNSURE 63: Xaa = Ala,Gly
  UNSURE 41: Xaa = Ala,Pro,Ser
  UNSURE 58: Xaa = Leu,Val
  UNSURE 52: Xaa = Pro,Ser
MGLEALVPLAMIVAIFLLLVDLMHRHQRWAARYPPGPLPLXGLGNLAACGLXEHTILXRPVAXPL

SEQ ID NO: 4323 - protein, 99 aa, Homo sapiens
MGKGIPLNDQDRIPWLCNLHDILLRDVASGQRVVLACSALKKTYRDILTQGKDGVALKCEESGKEAKQAEMQLLVVHLSGSFEVISGRLLKREGHFMPL

SEQ ID NO: 4324 - protein, 50 aa, Homo sapiens
  UNSURE 46: Xaa = Ala,Gly
MRPKVPAASLLATFPISQRLIPLTPARKHCPSESETSTWVVSKAPXTPRT

SEQ ID NO: 4325 - protein, 74 aa, Homo sapiens
MKVAQAKLEMIKPEEVNLEEYEEWHQDYRKFRETTMYLIIGLENFQRESYIDSLLFLICAYQNNKELLSKGLYR

SEQ ID NO: 4326 - protein, 91 aa, Homo sapiens
MATDSGDPASTEDSEKPDGISFENRVPQVAATLTVEARLKEKNSTFSASGETVERKRFFRKSVEMTEDDKVAESSPKDERIKAANEYSKSR

SEQ ID NO: 4327 - protein, 96 aa, Homo sapiens
MSVMDLANTCSSFQSDLDFCSDCGSVLPLPGAQDTVTCIRCGFNINVRDFEGKVVKTSVVFHQLGTAMPMSVEEGPECQGPVVDRRCLDVVMKEWH

SEQ ID NO: 4328 - protein, 122 aa, Homo sapiens
MNQSRSRSDGGSEETLPQDHNHHENERRWQQERLHREEAYYQFINELNDEDYRLMRDHNLLGTPGEITSEELQQRLDGVKEQLASQPDLRDGTNYRDSEVPRESSHEDSLLEWLNTFRRTGN

SEQ ID NO: 4329 - protein, 116 aa, Homo sapiens
  UNSURE 29: Xaa = Cys,Gly,Arg,Ser
MEAAAEPGNLAGVRHIILVLSGKGGVGKXTISTELALALRHAGKKVGILDVDLCGPSIPRMLGAQGRAVHQCDRGWAPVFLDREQSISLMSVGFLLEKPDEAVVWRGPKKNALIKQ

SEQ ID NO: 4330 - protein, 94 aa, Homo sapiens
MLYSRFSACSDDNTDVSIAVVDLLQELTDIDTLHESEEGAEVLIDALVDGQVVALLVQNLERLDESVKEEADGVHNTLAIVENMAEFRPEMCTE

SEQ ID NO: 4331 - protein, 129 aa, Homo sapiens
MASSLNEDPEGSRITYVKGDLFACPKTDSLAHCISEDCRMGAGIAVLFKKKFGGVQELLNQQKKSGEVAVLKRDGRYIYYLITKKRASHKPTYENLQKSLEAMKSHCLKNGVTDLSMPRIGCGLDRLQW

SEQ ID NO: 4332 - protein, 119 aa, Homo sapiens
  UNSURE 66: Xaa =  * ,Trp
MAAFLKMSVSVNFFRPFTRFLVPFTLHRKRNNLTILQRYMSSKIPAVTYPKNESTPPSEELELDKXKTTMKSSVQEECVSTISSSKDEDPLAATREFIEMWRLLGREVPEHITEEELKT

SEQ ID NO: 4333 - protein, 154 aa, Homo sapiens
  UNSURE 135: Xaa = Asp,His
  UNSURE 136: Xaa = Leu,Val
  UNSURE 129: Xaa = Ser,Thr
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVAXMPDLYXXLVELNAVQSLLGLLGHDN

SEQ ID NO: 4334 - protein, 92 aa, Homo sapiens [sequence omitted]

SEQ ID NO: 4335 - protein, 53 aa, Homo sapiens
  UNSURE 24: Xaa = Phe,Val
MGLCSKKERETYPNCLAHSKHQVXAPSYPSPAGNCNFSTWLRPPGGKTCVSPT

SEQ ID NO: 4336 - protein, 98 aa, Homo sapiens
MGARKRGGQLSLSSRLQLTLYQYKTCPFCSKVRAFLDFHALPYQVVEVNPVRRAEIKFSSYRKVPILVAQEGESSQQLNDSSVIISALKTYLGVGGGD

SEQ ID NO: 4337 - protein, 60 aa, Homo sapiens
  UNSURE 53: Xaa =  * ,Gly,Leu,Val
  UNSURE 52: Xaa = Cys,Phe
  UNSURE 51: Xaa = Gly,Val
MTLFFEMEFCSCCPGWSAMARFSAYRNCRLLGSSDSWDYRHAPPCPANLFXXXVETGFLH

SEQ ID NO: 4338 - protein, 75 aa, Homo sapiens
MGDGPAWVGVQRVPSGGRALPRPCTFNQASPALGSRGLPGNSPRGLEGLRSQPCCQVTLSPAPSSQAGVSVRAFV

SEQ ID NO: 4339 - protein, 133 aa, Homo sapiens
MATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTV

SEQ ID NO: 4340 - protein, 50 aa, Homo sapiens
MPCQFKAGSLLLKLLRNDIFIQVKIQDEFQLYDIVYVPQTCYLSLQRLVS

SEQ ID NO: 4341 - protein, 55 aa, Homo sapiens [sequence omitted]

SEQ ID NO: 4342 - protein, 89 aa, Homo sapiens
  UNSURE 73,76: Xaa = His,Gln
  UNSURE 81: Xaa = Lys,Asn
MARSSSLGRECGTPRSGLGKGGPPRPQGPQARCTLGRRCTVSGKCRRPRPSWTMAPPQNVVKIAIQMRDAIPXLIXLDQAXPLAAVLKE

SEQ ID NO: 4343 - protein, 144 aa, Homo sapiens
MNPLTKVKLINELNEREVQLGVADKVSWHSEYKDNAWIFLGGLPYELTEGDIICVFSQYGEIVNINLVRDKKTGKSKGFCFLCYEDQRSTILAVDNFNGIKIKGRTIRVDHVSNYRAPKDSEEIDDVTRQLQEKGCGARTPSPS

SEQ ID NO: 4344 - protein, 51 aa, Homo sapiens
  UNSURE 34: Xaa = Glu,Lys
MVSDYIFSAEKGTTAQHIKHFYSKKKKKKKKKKXKKKKKKKKKKKKKKKKK

SEQ ID NO: 4345 - protein, 85 aa, Homo sapiens
  UNSURE 30: Xaa =  * ,Glu,Lys,Gln
MLDWNAVGEIDFEKFYMLVCMLLAHQNHLXGQFMYRHSRPVFDLLDLKGDLRIGAKNFEMYRFLFNIQKQELKDLFRDFDITGDK

SEQ ID NO: 4346 - protein, 78 aa, Homo sapiens
  UNSURE 34: Xaa =  * ,Cys,Gly
  UNSURE 31: Xaa =  * ,Ser
  UNSURE 51: Xaa =  * ,Tyr
  UNSURE 38: Xaa = Ala,Asp,Glu
  UNSURE 33: Xaa = Ala,Asp,Glu,Lys,Asn,Thr
  UNSURE 28: Xaa = Ala,Glu
  UNSURE 68: Xaa = Ala,Pro
  UNSURE 42: Xaa = Ala,Thr
  UNSURE 53: Xaa = Cys,Asp,Gly,Tyr
  UNSURE 35: Xaa = His,Asn
  UNSURE 21: Xaa = Ile,Leu,Pro,Thr
  UNSURE 67: Xaa = Ile,Met
  UNSURE 39: Xaa = Ile,Thr
  UNSURE 18: Xaa = Leu,Pro
  UNSURE 60: Xaa = Leu,Val
  UNSURE 27: Xaa = Met,Val
  UNSURE 24: Xaa = Ser,Trp
MKDIQELYNTGRVWWLMXVIXTLXEAXXGRXLXXXEFXXSLXNMAKPHLYXKXKKIRLAXVGLMPVXXALWEAKVGIS

SEQ ID NO: 4347 - protein, 69 aa, Homo sapiens
  UNSURE 21,30,34,59: Xaa = Ala,Thr
  UNSURE 28: Xaa = Arg,Ser
  UNSURE 22: Xaa = Asn,Ser
  UNSURE 27: Xaa = Gln,Arg
  UNSURE 38,48: Xaa = Gly,Ser
  UNSURE 55: Xaa = His,Arg
  UNSURE 51: Xaa = Lys,Arg
MASSRPPKNLERVYVDTQVSXXRDFLXXRXRGTXGPGXSGSGSPRGRXRLXRPGXSPGXAPSSVSRGRK

SEQ ID NO: 4348 - protein, 81 aa, Homo sapiens
  UNSURE 11: Xaa = Cys,Gly,Arg,Ser
  UNSURE 44: Xaa = Phe,Ile,Leu,Met,Val
  UNSURE 45: Xaa = Phe,Leu
MCSEAAALGQXLPGHTEEHMGGQGFGCGCTQSKHHLGLAHWQSXXGGMCCTSQGENLSELSIRVYQNTPFQGMYALLFLSC

SEQ ID NO: 4349 - protein, 94 aa, Homo sapiens
  UNSURE 50: Xaa = Arg,Thr
  UNSURE 25: Xaa = Lys,Met,Arg,Thr
MRRFRIQQCSAVIPVSVETLGLWRXTGLLEMSELPGDSSVPQVGTASGVXTYCGGQVGGGVRVQEAREGPVAEAARSMGFILHNKLRKQVSKKK

SEQ ID NO: 4350 - protein, 60 aa, Homo sapiens
MEYHLTPECTLSTGLLEPADPEGGCCWNPHCKQAVYFFSPAPDPRALLGGPRTVSYAVEF

SEQ ID NO: 4351 - protein, 53 aa, Homo sapiens [sequence omitted]

SEQ ID NO: 4352 - protein, 120 aa, Homo sapiens
  UNSURE 75: Xaa =  * ,Tyr
  UNSURE 22: Xaa = Ala,Pro
  UNSURE 21: Xaa = Arg,Thr
  UNSURE 42: Xaa = Cys,Phe
  UNSURE 108: Xaa = Glu,Gln
  UNSURE 5,31: Xaa = Leu,Val
  UNSURE 102: Xaa = Phe,Leu
MSVTXHTDVGDIKIEVFCERXXKTCENFLAXCASNYYNGCIXHRNIKGFMVQTGDPTGTGRGGNSIWGKKFEDEXSEYLKHNVRGVVSMANNGPNTNGSQFXITYGKXPHLDMKYTVFGK

SEQ ID NO: 4353 - protein, 69 aa, Homo sapiens
  UNSURE 36: Xaa = Ala,Cys,Asp,Gly,Ser,Tyr
  UNSURE 10: Xaa = Asp,Glu
  UNSURE 9: Xaa = His,Gln
MGWCEAREXXPLQDRVYSPTFLALRGSCLYKFLAPXSDHLGLDESREKHSQFMRLCARSSRYDQYVVSI

SEQ ID NO: 4354 - protein, 58 aa, Homo sapiens
MAKGGEALPQGSPAPVQDPHLIKVTVKTPKDKEDFSVTDTCTIQQLKEEISQRFKAHP

SEQ ID NO: 4355 - protein, 90 aa, Homo sapiens
MVSSQKLEKPIEMGSSEPLPIADVTGGGRRSGGAGPLTPCQESLKIIEKQAGHSRSRVFREVETLYQCQGNKNILELIEFFEDDTRFYLV

SEQ ID NO: 4356 - protein, 59 aa, Homo sapiens
MTRDGPARHMSWVMGRKRDRCLVINHLFIHSSMEYSPCARPGHSARNNTDKNLPHTAII

SEQ ID NO: 4357 - protein, 97 aa, Homo sapiens
  UNSURE 96: Xaa =  * ,Gly,Arg
MTPESIQEMYAAIKADPDGDGWVGDVDDYSLHGGCLVTRGTKWIANNWINVDPSRARQACSNRRWPALPEKGARLTARVGSGPGLPRCARGTLREXV

SEQ ID NO: 4358 - protein, 56 aa, Homo sapiens [sequence omitted]

SEQ ID NO: 4359 - protein, 93 aa, Homo sapiens
MGVVAGILVQNVLKFLLNFGTVSFYLGYNAMQDFFPTMSMKPNPQCDDRNCRKQQEEYKKKVAALPKQEVIQEEEEIIHEDNEWGIELVSEVF

SEQ ID NO: 4360 - protein, 92 aa, Homo sapiens
MKEPSSPPPAPTSSTFGLQDGNLRAPHKESTLPRSGSSGGQQPSGMKEGVKRYEQEHAAIQDKLFQVAKREREAATKHSKASLPTGEGSISH

SEQ ID NO: 4361 - protein, 65 aa, Homo sapiens [sequence omitted]

SEQ ID NO: 4362 - protein, 106 aa, Homo sapiens
  UNSURE 104: Xaa = Ala,Gly
  UNSURE 20,73: Xaa = Arg,Ser
  UNSURE 77: Xaa = Asp,Glu
  UNSURE 24: Xaa = Leu,Gln
  UNSURE 15: Xaa = Leu,Val
  UNSURE 30: Xaa = Phe,Tyr
MKTYQSDASTRQGTXRISNXYQKXGDRQLXGFSSGPLEGTNPVNTLILDFWPPHLREYISVVLSYLVCSHCYXSPYXTLETNIAPMTPSLLTTPTFCDNEHARXGP

SEQ ID NO: 4363 - protein, 73 aa, Homo sapiens
MSSGVQSGTPVTNDLFSQALQHALQASGQPSLQSQWQPQLQQLRDMGIQDDELSLRALQGTGGDIQAALELIF

SEQ ID NO: 4364 - protein, 100 aa, Homo sapiens
  UNSURE 49: Xaa = Glu,Gly
  UNSURE 28: Xaa = Leu,Pro
MPAYTRNLHHELELGVVMGKRCRESPRXRPWTTWAAMPVPGYDRPGRAXRVQEEGAALDSGEELHGVLPGQRVRAQGERSLTLTSWKLWLKVNGELRQGG

SEQ ID NO: 4365 - protein, 118 aa, Homo sapiens
MGKKHHIGGTPGFLHSWWCVFWDLYCAAPERRETCEHSSEAKAFHDYSAAAAPSPVLGNIPPGDGMPVGPVPPGFFQPFMSPRYPGGPRPPLRIPNQALGGVPGSQPLLPSGMDPTRQ

SEQ ID NO: 4366 - protein, 135 aa, Homo sapiens
MAAQIPIVATTSTPGIVRNSKKRPASPSHNGSSGGGYGASKKKKASASSFAQTCLLPSAMIVRPPQPRGNGISMEAMSQNKMVPSEFSTGPVEKAAKPLPFKDPNFVHSGHGGAVAGKKNRTWKNLKQILASERA

SEQ ID NO: 4367 - protein, 56 aa, Homo sapiens
  UNSURE 13: Xaa = Leu,Met
MRTHSCVRHVTLXSVVVNMCILSNKIQLVRLFWAVSVTHFLCCDCSEDRVALTTVR

SEQ ID NO: 4368 - protein, 67 aa, Homo sapiens
MTASNSHITILTLNVNRLNALIKRHRLANWIKSQDPLVCCFQETHLTCKDTHRLKIKGWKKIYQANV

SEQ ID NO: 4369 - protein, 66 aa, Homo sapiens
MLTKCLNEKQNQARGWAASHPVMWNVHFLRFLGRKYLRKAKWKRWELVSEVGVGFGYTKCETRSSH

SEQ ID NO: 4370 - protein, 127 aa, Homo sapiens
MAGKGGKGLLAAKTTAAKSAEKDKGKKAPISRSSRAGLQFPVGRIHRQLKQRTQANGRVGATAAVYSAAILEYLTAEVLELAGNASKDLKVKRITPRHLQLAIRGDEELDTLIKGTIAGGGVIPAHS

SEQ ID NO: 4371 - protein, 60 aa, Homo sapiens
  UNSURE 8: Xaa = Arg,Thr
  UNSURE 9: Xaa = His,Leu,Pro,Arg
MSSGASAXXLQRLVEQLKLEAGVERIKVSQAAAELQQYCMQNACKMPCWWVFQLEVTPSG

SEQ ID NO: 4372 - protein, 63 aa, Homo sapiens
  UNSURE 60: Xaa = Lys,Arg
MSGRASSFRRGCRARPSILPFEKEGRSGGDSFSWRRRRRLGLSRRGRCCTSKMAAPVSWXDCE

SEQ ID NO: 4373 - protein, 100 aa, Homo sapiens
  UNSURE 19: Xaa = Arg,Ser,Thr
  UNSURE 31: Xaa = His,Leu,Arg
MAPHMCMPPRPSCFPWSGXNQLAGVKQQLYXPALPTLRHMDRDTVKACLPDEHCQSTTYCRKDEFDNAHFTLLGVPNKPLQCLDITATGQKLRNRYHEGK

SEQ ID NO: 4374 - protein, 65 aa, Homo sapiens [sequence omitted]

SEQ ID NO: 4375 - protein, 61 aa, Homo sapiens
MFSLEKVEVIVTKDDATMPLKKKGDEPQMEKYIQERSMLVSMNEHIAKISGRTAMPRAGGT

SEQ ID NO: 4376 - protein, 136 aa, Homo sapiens
MKILREVLRKSKEEYDQEEERKRKKQLSEAKTEEPTVHSSEAAIMNNSQGDGEHFAHPPSEVKMHFANQSIEPLGRKVERSETSSLPQKGLKIPGLEHASIEGPIANLSVLGTEELRQREHYLKQKRDKLMSMRKD

SEQ ID NO: 4377 - protein, 84 aa, Homo sapiens [sequence omitted]

SEQ ID NO: 4378 - protein, 64 aa, Homo sapiens
MLIAEKYLLILAKTITEEWWGQNSINTGILSGTAGGGESTDCCFPKSTVSRGAVDREGDGQRDG

SEQ ID NO: 4379 - protein, 179 aa, Homo sapiens
  UNSURE 27: Xaa = Ile,Asn,Ser,Thr
  UNSURE 28: Xaa = Ile,Val
MASWSSPSSAAAASGARFGPFPSRAQXXVPYPSLARGTPASTLVLRPHPDGRGHGLLAHTGSSSSRCRAVAAEVEGLNIANHVSQLIGKTPMVYLNNVVKGSVANVAAKLEIMEPCCSVKDRIGYSMINDAEQKGLITPGKSVLVEATSGNTGIGLAFIAASKGYKLILTMPSSMSMER

SEQ ID NO: 4380 - protein, 124 aa, Homo sapiens
MLRAEQDSEVGPQEINKEELEGNSMRCGRKLAKDGEYCWRWTGFNFGFDLLVTYTNRYIIFKRNTLNQPCSGSVSLQPRRSIAFRLRLASFDSSGKLICSRTTGYQILTLEKDQEQVVMNLDSR

SEQ ID NO: 4381 - protein, 63 aa, Homo sapiens
MIVTGQYGRLFAVVHFASRQWKVTSEDLILIGNELDLACGERIRLEKVLLVGADNFTLLGKPL

SEQ ID NO: 4382 - protein, 61 aa, Homo sapiens
MSSTMKPNTKCHSPERAHHRSPDPRPRSIIRRESLLQRFLTPEMILHIPEKGQSYKLIFFF

SEQ ID NO: 4383 - protein, 104 aa, Homo sapiens
MIIPSLEELDSLKYSDLQNLAKSLGLRANLRADKLLKALKGYIKHEARKGNENQDESQTSASSCDETEIQISNQEEAERQPLGHVTKTRRRCKTVRVDPDSQQN

SEQ ID NO: 4384 - protein, 59 aa, Homo sapiens [sequence omitted]

SEQ ID NO: 4385 - protein, 156 aa, Homo sapiens
MSDVVKGVYKEKDNEELTISCPVPADEQTECTSAQQLNMSTSSPCAAELTALSTTQQEKDLIEDSSVQKDGLNQTTIPVSPPSTTKPSRASTASPCNNNINAATAVALQEPRKLSYAEVCQKPPKEPSSVLVQPLRELRSNVVSPTKNEDNGAPEN

SEQ ID NO: 4386 - protein, 101 aa, Homo sapiens
  UNSURE 64: Xaa =  * ,Lys,Gln
  UNSURE 2: Xaa = Asp,Gly
MXDKEPKRWPTLRDRLCSDGFLFPQYPIKPYHLKGIHRAVFYRDLEELKFVLLTRYDINKRDRXERLSRTWDVETLAGASTQVIFTSSKTKTKLQLVSNHS

SEQ ID NO: 4387 - protein, 137 aa, Homo sapiens
  UNSURE 132: Xaa = Asp,Gly
MASQNTEQEYEAKLAPSVGGEPTSGGPSGSSPDPNPDSSEVLDRHEDQAMSQDPGSQDNSPPEDRNQRVVNVEDNHNLFRLSFPRKLWTIVEEDTFKSVSWNDDGDAVIIDKDLFQREVLQRKGAERIFKTXNLTSF

SEQ ID NO: 4388 - protein, 83 aa, Homo sapiens
  UNSURE 54: Xaa = Ile,Lys,Arg,Thr
MVVLDAGRYQKLRVGSSGFSHFNSSNEEQRSNTPIGDYPSRAKISGQNSSVRGXGITRLLESISNSSSNIHKFSNCDTSLSPY

SEQ ID NO: 4389 - protein, 84 aa, Homo sapiens
  UNSURE 81: Xaa = Asp,Glu
MEFPDLGKHCSEKTCKQLDFLPVKCDACKQDFCKDHFPYAAHKCPFAFQKDVHVPVCPLCNTPIPVKKGQIPDVVVGDHIXRDC

SEQ ID NO: 4390 - protein, 88 aa, Homo sapiens
MQARLGILANDGVLLAAERRNIHKLLDEVFFSEKIYKLNEDMACSVAGITSDANVLTNELRLIAQRYLLQYQEPIPCEQLVTALCDIK

SEQ ID NO: 4391 - protein, 54 aa, Homo sapiens
MPAFLRSALQILFSEDSTKLFVASNQGALHIVQLSGGSFKHLHAFQPQSGTVGG

SEQ ID NO: 4392 - protein, 128 aa, Homo sapiens
MYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLD

SEQ ID NO: 4393 - protein, 53 aa, Homo sapiens
MEGVDPSFATGEDLLSKALSQESIQPCQQPSPKTFTSWKRTCWLFTSACIGQT

SEQ ID NO: 4394 - protein, 62 aa, Homo sapiens
  UNSURE 51: Xaa = His,Pro
  UNSURE 4: Xaa = Lys,Arg
  UNSURE 55: Xaa = Phe,Leu
MALXRALPALRPCIPRFVQLSTAPASREQPAAGPAAVPGGGSATAVRPPVXAVDXGNAQEAY

SEQ ID NO: 4395 - protein, 97 aa, Homo sapiens
MISAHCNLELLNSNPLSSASQVTRTTGVHHHTQLIFKSFVETGSCYVVQPSLASSNSPAFDSQSAGTISIHHHTQSREFCHTKIRGSPKTATTSYCF

SEQ ID NO: 4396 - protein, 85 aa, Homo sapiens
MNKRDYMNTSVQEPPLDYSFRSIHVIQDLVNEEPRTGLRPLKRSKSGKSLTQSLWLNNNVLNDLRDFNQVASQLLEHPENLAWID

SEQ ID NO: 4397 - protein, 90 aa, Homo sapiens
  UNSURE 46: Xaa = Phe,Ile
  UNSURE 43: Xaa = Phe,Leu
MLVRPVLNSRPQVVHPLWPPKMLGLQALATTPGLFIYLLMVFXFCXFFFEMESCSIVQAGVQCHDLGSLQPPPPGFKLFSCLSLPSSWDY

SEQ ID NO: 4398 - protein, 61 aa, Homo sapiens
  UNSURE 38: Xaa = Ala,Glu,Gly,Val
  UNSURE 61: Xaa = Asp,Glu
  UNSURE 48: Xaa = Lys,Arg
  UNSURE 57: Xaa = Lys,Met,Arg
  UNSURE 47: Xaa = Met,Arg
MGPGDFRRCRERISQGLQGLPGRADFGSHLVPRATSSXTAGARTSRXXPSPPARCWXTSDX

SEQ ID NO: 4399 - protein, 75 aa, Homo sapiens
MRPIGHDGYHPTSVAEWLDSIELGDYTKAFLINGYTSMDLLKKIWEVELINVLKINLIGHRKRILASLGDRAARR

SEQ ID NO: 4400 - protein, 67 aa, Homo sapiens
  UNSURE 58: Xaa = Lys,Asn
MNPESSIFIEDYLKYFQDQVSRENLLQLLTDDEAWNGFVAAAELPRDEADELRKALNXACKSHGHEG

SEQ ID NO: 4401 - protein, 144 aa, Homo sapiens
MGKMAAAVGSVATLATEPGEDAFRKLFRFYRQSRPGTADLEGVIDFSAAHAARGKGPGAQKVIKSQLNVSSVSEQNAYRAGLQPVSKWQAYGLKGYPGFIFIPNPFLPGYQWHWVKQCLKLYSQKPNVCNLDKHMSKEETQDLW

SEQ ID NO: 4402 - protein, 107 aa, Homo sapiens
MAFYFERDDVALEHFGRYFLHQSDEKMEHAQELMRLQNQRSGRICLHDIREPERQGWQSGLEAMECAFHLEKSINYSLLELHQLALEKGEPSCATSWRATTLHQQVK

SEQ ID NO: 4403 - protein, 70 aa, Homo sapiens
  UNSURE 59: Xaa = Lys,Thr
MCRHRPGGSECWQPREGPAFPAEGREALPTALGLRINKYKNYYEVLGVTKDSGDEDLKXAYRKLALKFHP

SEQ ID NO: 4404 - protein, 66 aa, Homo sapiens
  UNSURE 40: Xaa = Leu,Arg
MASTSDKGAQGRNDKKDSQGRSNKALHLKSDAEFKKIFGXTKDLRVCLTRIPDHLTSGEGSIPLAV

SEQ ID NO: 4405 - protein, 62 aa, Homo sapiens
MTKPHLYKNTKINWAWWPVPVVLATQEAEVGESLEPGDGGCSEPRSRHCNPVWVTERDSISK

SEQ ID NO: 4406 - protein, 75 aa, Homo sapiens
MCYIPLPINILNVGEGPENGTQEPAGMPIPHTPPSCSNPAIHSPGGTGAPGRGGGSPLSTLTHTLPTHLPDPLGW

SEQ ID NO: 4407 - protein, 110 aa, Homo sapiens
  UNSURE 94: Xaa = Ile,Lys,Arg,Thr
MTSKSKKRKTSIDPSPESHEVMERILDSVQGKSTVSEQADKENNLENEKMVKNKPDFYTKAFRSLSEIHSPNIQDSSFDSVREGLVPLSVSSGXNVIIKENFALECSPAF

SEQ ID NO: 4408 - protein, 61 aa, Homo sapiens
MGRINIVKMTILRKAIHRFNAIPTKTPPSFFTELEKTILKFMWNQKRVCIAKTRLSKKKKK

SEQ ID NO: 4409 - protein, 78 aa, Homo sapiens
  UNSURE 50: Xaa = Asp,His
MVQLVFTKNTKTKISQGWWYAPAVPATWEAEQQNRLNPRQGGCDEPRSCXCTPAWGDRARLHLKNKNKTKQQQKKKLN

SEQ ID NO: 4410 - protein, 58 aa, Homo sapiens
MTKPHLYKNTKINWAWWPVPVVLATQEAEVGESLEPGDGGCSEPRSRHCNPVWVTERD

SEQ ID NO: 4411 - protein, 124 aa, Homo sapiens
  UNSURE 110: Xaa = Lys,Arg
MAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNXLEKNATDNIRQAFP

SEQ ID NO: 4412 - protein, 94 aa, Homo sapiens
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNI

SEQ ID NO: 4413 - protein, 75 aa, Homo sapiens
  UNSURE 61: Xaa = Ala,Cys,Asp,Phe,Gly,Ser,Val,Tyr
  UNSURE 11: Xaa = Ala,Ser
  UNSURE 6: Xaa = Cys,Gly
  UNSURE 4: Xaa = Glu,Lys
MHQXQXQFSLXKIVSRGELNTAAVRNGFTYALVSSQPPTATNSPQQEDYRRRSQTSCPHMXTKELVHSTPGKKCH

SEQ ID NO: 4414 - protein, 111 aa, Homo sapiens
  UNSURE 18: Xaa = His,Pro
MAVLDTDLDHILPSSVLXPFWAKLVVGSVAIVCFARSYDGDFVFDDSEAIVNNKDLQAETPLGDLWHHDFWGSRLSSNTSHKSYRPLTVLTFRINYYLSGGFHPVAFTWST

SEQ ID NO: 4415 - protein, 65 aa, Homo sapiens
MATSSMSKGCFVFKPNSKKRKISLPIEDYFNKGKNEPEDSKLRFETYQLIWQQMKSENERLQEEL

SEQ ID NO: 4416 - protein, 68 aa, Homo sapiens
MNQSIVLKGKIPSDIKLHFPRTSNINHPDFNYGITGAMRISSVEDRKICVTGTLWIWHLLQDVCPTPG

SEQ ID NO: 4417 - protein, 103 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHWMCS

SEQ ID NO: 4418 - protein, 73 aa, Homo sapiens
  UNSURE 65: Xaa = Gly,Arg
MNLYQFIQLYKDITSQAAGVLAQSSTSEEPDENSSSVTSCQASLWMGRVKQLTDEEECCICMDGXADLILPCA

SEQ ID NO: 4419 - protein, 56 aa, Homo sapiens
MDIHRLLFMLFMTLDYIFLTCFYRYIVLYIYKSCMLLALISVNHFKLIVYSVKGQL

SEQ ID NO: 4420 - protein, 59 aa, Homo sapiens [sequence omitted]

SEQ ID NO: 4421 - protein, 138 aa, Homo sapiens
MSLRCGDAARTLGPRVFGRYFCSPVRPLSSLPDKKKELLQNGPDLQDFVSGDLADRSTWDEYKGNLKRQKGERLRLPPWLKTEIPMGKNYNKLKNTLRNLNLHTVCEEARCPNIGECWGGGEYATATATIMLMGDTCT

SEQ ID NO: 4422 - protein, 89 aa, Homo sapiens
MAFRRQVKNFVKNYSDAEIKVREATSNDPWGPSSSLMLDISDLTFNTISLSEIMNMLWHRLNDHGKNWRHVYKSLTLMDYLIKNGSKKV

SEQ ID NO: 4423 - protein, 106 aa, Homo sapiens
MSSPLQRAVGDTKRALSASSSSSAGLPFDDRDSNHTSEGNGDSLLADEDTDFEDSLNRNVKRAAKRPPKTTPVAKHPKKGSRVVHRHSRKQSEPPANDLFNAVKAA

SEQ ID NO: 4424 - protein, 61 aa, Homo sapiens
MYSHGIELACQKQKEFVKSSVACKWNLAEAQQKLGSLALHNSESLDQEHAKAQTAVSELRQ

SEQ ID NO: 4425 - protein, 65 aa, Homo sapiens
  UNSURE 65: Xaa =  * ,Asp,Glu,His,Lys,Asn,Gln,Tyr
  UNSURE 64: Xaa =  * ,Glu,Lys,Gln
MYSHGIELACQKQKEFVKSSVACKWNLAEAQQKLGSLALHNSESLDQEHAKAQTAVSELRQREXX

SEQ ID NO: 4426 - protein, 145 aa, Homo sapiens
MTTKDYPSLWGFGTTKTFKIPIEHLDFKYIEKCSDVKHLEKILCVLRSGEEGYYPELTEFCEKHLQALAPESRALRKDKPAATAASFTAEEWEKIDGDIKSWVSEIKKEEDKMHFHETETFPAMKDNLPPVRGSNSCLHVGKEKY

SEQ ID NO: 4427 - protein, 128 aa, Homo sapiens
MSDATFEESSEHFPHFSEPGDDFGEFGDINAVSCQEETILTKSDLKQTSDNLSEECQLARKSSGTGTEPDAKLKNGQEGEIGHFDSVPNIQDDCNGFQDSDDFADFSSAGPSQVVDWNAFEDEQKDSC

SEQ ID NO: 4428 - protein, 53 aa, Homo sapiens
MIKLQQMRGYYLWMSKEGGEDAVNIGEMTTKDLEYYINLVDKAVSGFERIDSS

SEQ ID NO: 4429 - protein, 80 aa, Homo sapiens
MGKKRTKGKTVPIDDSSETLEPVCRHIRKGLEQGNLKKALVNVEWNICQDCKTDNKVKDKAEEETEEKPSVWLCLKCGHQ

SEQ ID NO: 4430 - protein, 60 aa, Homo sapiens [sequence omitted]

SEQ ID NO: 4431 - protein, 142 aa, Homo sapiens
MPATLLRAVARSHHILSKAHQCRRIGHLMLKPLKEFENTTCSTLTIRQSLDLFLPDKTASGLNKSQILEMNQKKSDTSMLSPLNAARCQDEKAHLPTMKSFGTHRRVTHKPNLLGSKWFIKILKRHFSSVSTETFVPKQTST

SEQ ID NO: 4432 - protein, 51 aa, Homo sapiens
  UNSURE 23: Xaa = Ala,Glu,Gly,Val
  UNSURE 19: Xaa = Ala,Pro,Ser,Thr
  UNSURE 31: Xaa = Ile,Asn,Ser,Thr
MGQAGLVQGPGALSAHLSXLPPXTQMSRLGXAVPDCHINAPEPASWALGRW

SEQ ID NO: 4433 - protein, 51 aa, Homo sapiens
MSVIPSLWEAEVGGSYESRSSRPSWAMWGNPISTKSARISRAWCCVPVVSA

SEQ ID NO: 4434 - protein, 121 aa, Homo sapiens
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPA

SEQ ID NO: 4435 - protein, 133 aa, Homo sapiens
MTSKFLTALAQDGVINEEALSVTELDRVYGGLTTKVQESLKTQEGLLKNIQVSHQEFSKMKQSNNEANLRKEVLKNLATAYDNFVELVANSKEDTKFYNELTEILVRFQNKCSDIVLAWKTERDELLKPENWE

SEQ ID NO: 4436 - protein, 101 aa, Homo sapiens
MSELSVAQKPEKLLERCKYWPACKNGDECAYHHPISPCKAFPNCKFAEKCLFVHPNCKYDAKCTKPDCPFTHVSRRIPVLSPKPVAPPAPPSSSQLCRYFP

SEQ ID NO: 4437 - protein, 126 aa, Homo sapiens
MAMQAAKRANIRLPPEVNRILYIRNLPYKITAEEMYDIFGKYGPIRQIRVGNTPETRGTAYVVYEDIFDAKNACDHLSGFNVCNRYLVVLYYNANRAFQKMDTKKKGGTVEASQGEIWHQHRSTQN

SEQ ID NO: 4438 - protein, 149 aa, Homo sapiens
MVSTNFTSGSRCHGCPKSLETTTSPLPRRWRRPGAVWPRKPGNWPTTCRKLRVSMKSTNTTRNSSKKSWRRTWTKDHHYFKYCKISALALLKMVMHARSGGNLEVMGLMLGKVDGETMIIMDSFALPVEGTETRVNAQAAAYEYMAAYI

SEQ ID NO: 4439 - protein, 106 aa, Homo sapiens
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKL

SEQ ID NO: 4440 - protein, 75 aa, Homo sapiens
MEVWESSGQWMFSVYSPVKKKPNISVHNSKEKLPTIWSDKLRNRECWIYNVMPQVFQTFSFKPGRGEQVWQVSDR

SEQ ID NO: 4441 - protein, 146 aa, Homo sapiens
  UNSURE 64: Xaa = His,Arg
  UNSURE 16: Xaa = Leu,Val
MPESSPPPCLLLSRGXQTEGSNGKKEVLSGFQVVLEDTVLFPEGGGQPDDRGTINDISVLRVTXRGEQADHFTQTPLDPGSQVLVRVDWERRFDHMQQHSGQHLITAVADHLFKLKTTSWELGRFRSAIELDTPSMTAEQVAAIEQ

SEQ ID NO: 4442 - protein, 98 aa, Homo sapiens
MLIEDVDALKSWLAKLLEPICDADPSALANYVVALVKKDKPEKELKAFCADQLDVFLQKETSGFVDKLFESLYTKNYLPLLEPVKPEPKPLVQKKKKK

SEQ ID NO: 4443 - protein, 112 aa, Homo sapiens
  UNSURE 13: Xaa = Glu,Gln
MNPGPGHSSLAEXVPCGPYSSIQAPVLSAPEFLFGIQEELGHPHGLKGYGQRPVFPLFNESGSWIPPRSLPKDPQRKGAIVRGSGCLPVWSFDGLEVRDKTSFTWPNMHGSN

SEQ ID NO: 4444 - protein, 104 aa, Homo sapiens
  UNSURE 19: Xaa = Phe,Leu
MSQACHEVDDSSVVGLKYXLLGAIHKCLGNSEDAVQYFQRAVKDELCRQNNLYVQPYACYELGCLLLDKPETVGRGRALLLQAKEDFSGYDFENRLHVRIHAAL

SEQ ID NO: 4445 - protein, 104 aa, Homo sapiens
  UNSURE 79: Xaa = Asn,Ser
MQADHWLRRREDSGWELKCPGAAGVLGPHTEYKELTAEPTIVAQLCKVLRADGLGAGDVAAVLGPLGLQEVASFVTKRXAWKLVLLGADEEEPQLRVDLDTADF

SEQ ID NO: 4446 - protein, 112 aa, Homo sapiens
MPLPDTMFCAQQIHIPPELPDILKQFTKAAIRTQPADVLRWSAGYFSALSRGDPLPVKDRMEMPTATQKTDTGLTQGLLKVLHKQCHHKRYVELTDLEQKWKNLCLPKEKFK

SEQ ID NO: 4447 - protein, 87 aa, Homo sapiens
  UNSURE 79: Xaa =  * ,Trp
MPLPDTMFCAQQIHIPPELPDILKQFTKAAIRTQPADVLRWSAGYFSALSRGDPLPVKDRMEMPTATQKTDTGLTQGLXKFCTSSVT

SEQ ID NO: 4448 - protein, 103 aa, Homo sapiens [sequence omitted]

SEQ ID NO: 4449 - protein, 159 aa, Homo sapiens
MGSVPEGVLEDIKARTCFVSDLKRGLKIQAAKFNIDGNNERPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLG

SEQ ID NO: 4450 - protein, 57 aa, Homo sapiens
MIRTLEIKWPIFQMTKLRPSFFNDSAKVNLLVTDITQISNHFSDLSKKKYFRIAVIR

SEQ ID NO: 4451 - protein, 128 aa, Homo sapiens
MRGQGPPLSSFGVWLASRAASDPSRPRRQGYDIHFHDKKILLLEAGPKKVLEKLSETYSNRVSSISPGSATLLSSFGAWDHICNMRYRAFRRMQVWDACSEALIMFDKDNLDDMPISWRMMSSCMLSL

SEQ ID NO: 4452 - protein, 86 aa, Homo sapiens [sequence omitted]

SEQ ID NO: 4453 - protein, 54 aa, Homo sapiens [sequence omitted]

SEQ ID NO: 4454 - protein, 57 aa, Homo sapiens
MKSHRHGAFSTGASTTLTPLKVRDSPTTKMKGETQSCYAAQASLEPLTSSNPPVSAS

SEQ ID NO: 4455 - protein, 58 aa, Homo sapiens
  UNSURE 35: Xaa = Phe,Leu
  UNSURE 31,43: Xaa = Pro,Arg
  UNSURE 3: Xaa = Pro,Gln
MGXRIRELPYRLCGGRKDSNSSWHKLTGHYXPWSXSVRPLRMXLPMQKSFVPWSLLPK

SEQ ID NO: 4456 - protein, 53 aa, Homo sapiens
MDEFLDTYTLLRPNEEEVESLNRTITGSEIEAIMNRLPTKKKVQDQTDSQLNS

SEQ ID NO: 4457 - protein, 101 aa, Homo sapiens
  UNSURE 18: Xaa =  * ,Trp
  UNSURE 7: Xaa = Ala,Glu,Gly
  UNSURE 19: Xaa = Ile,Asn
  UNSURE 13: Xaa = Phe,Ile
MEDIAEXRNSRKXKGKTXXRTKSSCKDPGLVAGHPGAQDTAACSPQGLDNSVLVADDAVEGAGEETAGSSDRLRNQREGSDQAPVFGPYVACPRRYCQVLN

SEQ ID NO: 4458 - protein, 145 aa, Homo sapiens
MGKRDNRVAYMNPIAMARSRGPIQSSGPTIQDYLNRPRPTWEEVKEQLEKKKKGSKALSEFEEKMNENWKKELEKHREKLLSGSESSSKKRQRKKKEKKKSGRYSSSSSSSSDSSSSSSDSEDEDKKQGKRRKKKKNRSHKSSES

SEQ ID NO: 4459 - protein, 62 aa, Homo sapiens
MSIEEKMEADARSIYVGNVDYGATAEELEAHFHGCGSVNRVTILCDKFSGHPKGFAYIEFSD

SEQ ID NO: 4460 - protein, 142 aa, Homo sapiens
  UNSURE 130: Xaa =  * ,Leu,Ser,Trp
MSRGCSSDLRFHTWLGLRMLKNIIAVALLMLGKNEKKAPAPPMEPEVPEMSQSKTEHMKTPEEELQPESSPAETSACKDPLKPLKIRPVSQPFVNPAVKNKAEECETWIDRFRKLENALYLCDLSTQEFXERNEPDASFTTT

SEQ ID NO: 4461 - protein, 52 aa, Homo sapiens
MWQGHLEVGGQERRLALGRKKRSFAMAGVKYPGQDPVDLDIYQSSHMVDYQP

SEQ ID NO: 4462 - protein, 69 aa, Homo sapiens
  UNSURE 16: Xaa = Ala,Gly
  UNSURE 30: Xaa = Ala,Pro
  UNSURE 18: Xaa = Glu,Lys
  UNSURE 34: Xaa = Leu,Ser
  UNSURE 32: Xaa = Phe,Leu
MRSRILRLREARDGYXRXGFGAPRVRVPSXTXTXGKRADSAAIWPLREPQCLMGTSRATPARWRTRPLQ

SEQ ID NO: 4463 - protein, 91 aa, Homo sapiens
  UNSURE 83: Xaa = Ile,Asn,Ser,Thr
MTPTMLAIQTAILDILNACLKELKCHNPSLEVEDLSLENAIGKPFDKVLFFLLSTVYYVVILKNASYFNICNVVNRNLLLFKXKIGGHLKT

SEQ ID NO: 4464 - protein, 91 aa, Homo sapiens
MRDNASVREERCYIEYELLSYIPGERPGNYCIILLKIWPSKLLHPVQLTKSCIPQRRIKKTKLTNILLLFKTKLQLEYPVQFCLLHFKKDL

SEQ ID NO: 4465 - protein, 100 aa, Homo sapiens
  UNSURE 76: Xaa =  * ,Ala,Glu,Lys,Leu,Met,Ser,Thr,Val
MAKKWKICVQTCHESNMLSSVHNKVPTFTISAFKISQEGLKKMLKFLAKGEVPKGSCEDEPMDSTMDDAVAGDFAXINKLDIQCDLKTLSDDIKESLESE

SEQ ID NO: 4466 - protein, 78 aa, Homo sapiens
MGGEQEEERFDGMLLAMAQQHEGGVQELVNTFFSFLRRKTDFFIGGEEGMAEKLITQTFSHHNQLAQKTRREKRARQE

SEQ ID NO: 4467 - protein, 81 aa, Homo sapiens
  UNSURE 10: Xaa =  * ,Trp
  UNSURE 9: Xaa = Ala,Pro
  UNSURE 16: Xaa = Arg,Ser
  UNSURE 12: Xaa = Gly,Trp
  UNSURE 8: Xaa = Lys,Arg
MLARGLVXXXNXGNRXPVFTISFHHLPTWNLYISPSLSFLICETAANTGFQRVVKNPCEHLLQLPSTQNRLFHWRRRRDGR

SEQ ID NO: 4468 - protein, 93 aa, Homo sapiens
  UNSURE 67: Xaa = Ala,Gly
  UNSURE 88: Xaa = Leu,Val
  UNSURE 8: Xaa = Phe,Leu
  UNSURE 79: Xaa = Ser,Trp
MTEQAISXAKDFLAGDRRRHLQDGRGSDRAGQAAAAGPARQQADRRRQAVQGHRGLHCPHPQGAGRXVLLEGQPCQRHXLLPHSSPQXRLQRI

SEQ ID NO: 4469 - protein, 54 aa, Homo sapiens [sequence omitted]

SEQ ID NO: 4470 - protein, 91 aa, Homo sapiens
  UNSURE 30: Xaa = Ala,Thr
  UNSURE 11: Xaa = Cys,Gly,Arg,Ser
  UNSURE 15: Xaa = Cys,Ser
  UNSURE 4: Xaa = Ile,Asn,Ser,Thr
  UNSURE 8: Xaa = Met,Arg
  UNSURE 7: Xaa = Phe,Leu
MPLXLGXXESXIGWXRRATSLCFVYPLDFXRTRLAADVGKAGAEREFRGLGDCLVKIYKSDGIKGLYQGFNMSVQGIIIYRAAYFGIYDTA

SEQ ID NO: 4471 - protein, 109 aa, Homo sapiens
MQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLG

SEQ ID NO: 4472 - protein, 81 aa, Homo sapiens
  UNSURE 6: Xaa = Gly,Arg
MPRAAXRRLRGGSDWAVPAPETMPFPVTTQGSQQTQPPQKHYGITSPISLAAPKETDCVLTQKLIETLKPFGFLKRKRNCS

SEQ ID NO: 4473 - protein, 98 aa, Homo sapiens
MLMVGMEWTRAGASPESRPFQNLTLHPASSSLHYSLQLFEGMKAFKGKDQQVRLFRPWLNMDRMLRSAMRLCLPSFDKLELLECIPPAHRSGQGLGPD

SEQ ID NO: 4474 - protein, 106 aa, Homo sapiens
MAASTDMAGLEESFRKFAIHGDPKASGQEMNGKNWAKLCKDCKMADGKSVTGTDVDIVFSKVKGKSARVINYEEFKKALEELATKRFKGKSKEEAFDAICQLVAGK

SEQ ID NO: 4475 - protein, 100 aa, Homo sapiens
MKTSFKYKFYFKHSDKLRLRKNPRQIRKWCSYNVSCMQCPSYYSAHDVHLSIHPSIHPFIHPSIHPASQPAIHKKMPCPGSNAIHSTKMFCSPLRKTLCM

SEQ ID NO: 4476 - protein, 59 aa, Homo sapiens
  UNSURE 30: Xaa = Cys,Phe,Ser,Tyr
  UNSURE 31: Xaa = Phe,Leu
MEEISLANLDTNKLEAIAQEIYVDLIEDSXXGFCFEVHRAVKCGYFYLEFAETGSVKDF

SEQ ID NO: 4477 - protein, 115 aa, Homo sapiens
MGKCLRYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGH

SEQ ID NO: 4478 - protein, 79 aa, Homo sapiens
  UNSURE 68: Xaa = Asp,Glu
  UNSURE 71: Xaa = Glu,Lys
  UNSURE 69: Xaa = Ile,Lys,Asn,Arg,Ser
MPKRKPKRRSARLSAMLVPVTPEVKPKRTSSSRKMKTKSDMMEENIDTSAQAVAETKQEAVVEEDYNXXCXKWRSQNYR

SEQ ID NO: 4479 - protein, 80 aa, Homo sapiens
MPKRKPKRRSARLSAMLVPVTPEVKPKRTSSSRKMKTKSDMMEENIDTSAQAVAETKQEAVVEEDYNENAKNGEAKITEA

SEQ ID NO: 4480 - protein, 63 aa, Homo sapiens
  UNSURE 51: Xaa = Glu,Lys,Gln
MPKRKPKRRSARLSAMLVPVTPEVKPKRTSSSRKMKTKSDMMEENIDTSAXAVAETKQEAVVE

SEQ ID NO: 4481 - protein, 52 aa, Homo sapiens
  UNSURE 17: Xaa =  * ,Arg
MYVKLISSDGHEFIVKXEHALTSGTIKAMLSGPGQFAENETNEVNLTYMASG

SEQ ID NO: 4482 - protein, 87 aa, Homo sapiens
MTASESVCVRFSLFYLRRSFTLVAQAGVQWCDLSSLQPPPPGFKRFSCLSLPSSWDYRHPPPCPAKFWYFSRDGVHHVGQAGLELLT

SEQ ID NO: 4483 - protein, 57 aa, Homo sapiens
MAPEINLPGPMSLIDNTKGQLVVNPEALKILSAITQPVVVVAIVGLYRTGKSYLMNK

SEQ ID NO: 4484 - protein, 133 aa, Homo sapiens
  UNSURE 126: Xaa = Ala,Pro,Ser
MKVYNPVRAEWRQMNNIPLVSETNNYRIIKHGQKLLLITSRTPQWKKNRVTVYEYDIRGDQWINIGTTLGLLQFDSNFFCLSARVYPSCLEPGQSFLTEEEEIPSESSTEWDLGGFSEPDSESGSXSSLSDDD

SEQ ID NO: 4485 - protein, 50 aa, Homo sapiens
MSKSVFPLPSQTVWPVESVWFVFISPSFLEQGLRPCHISYALHPRLFWTL

SEQ ID NO: 4486 - protein, 87 aa, Homo sapiens
MHWFRTWKLMEITVQQLMAHLDAIRKDMVILEKSEFANLRAENEKMKIELDQVKQQLMHETSRIRADNKLDINLERSRVTDMFTDQE

SEQ ID NO: 4487 - protein, 67 aa, Homo sapiens
MKQITQLLPEDLRKELYELWEEYETQSSAEAKFVKQLDQCEMILQASEYEDLEHKPGRLQTSMIPQQ

SEQ ID NO: 4488 - protein, 66 aa, Homo sapiens
  UNSURE 44: Xaa = Ala,Pro
MQAILDATVSQGEPIQELLVTHGKVPTLVEELIAVEMWKQKVFXVFCRVEGLQAPEHLPHLHSGAH

SEQ ID NO: 4489 - protein, 101 aa, Homo sapiens
MGEKIANLRVKNIQELIHGAHIGKPISSSASVKIIYVEESGEEKTFARIILGGCSEFRFNDNLVSRSVYIAELEKIGIIVKAQNCLVFQGTVESISVKKPK

SEQ ID NO: 4490 - protein, 62 aa, Homo sapiens
  UNSURE 8: Xaa = Asp,Gly
  UNSURE 58: Xaa = Asp,His
MMLCPTTXSHTSLGTRICPQSDSLPFQHALPWPGQCCPHPHEGGVGAAHVPAVRSASXRSSS

SEQ ID NO: 4491 - protein, 68 aa, Homo sapiens
MFRRIYRHLRPGGILVLEPQPWSSYGKRKTLTETIYKNYYRIQLKPEQFSSYLTSPDVGFSSYELVAT

SEQ ID NO: 4492 - protein, 97 aa, Homo sapiens
MMFDGPFQPFYDPSTQRCLRDILDGFFPSELQRLYPNGVPFKVSDLRNQVYLEDGLDPFPGEGRVVGRQRMHKALDRVEEHPGSRMTAEKFLNRLPK

SEQ ID NO: 4493 - protein, 53 aa, Homo sapiens
MACSGWASPWTRRTQRARQSQSMAKRDWMTAKKFWKPGDSLAPPEVDFDRLLA

SEQ ID NO: 4494 - protein, 150 aa, Homo sapiens
MGNGGRTGLQQGKGNVDGVAATPTAASASCQYRCIECNQEAKELYRDYNHGVLKITICKSCQKPVDKYIEYDPVIILINAILCKAQAYRHILFNTQINIHGKLCIFCLLCEAYLRWWQLQDSNQNTAPDDLIRYAKEWDFYRMFAIAALE

SEQ ID NO: 4495 - protein, 67 aa, Homo sapiens
MSEHQKEQTPDKPSLRTVTLTARVRGFILEVSKTKSSPILDTAPLFTTAKKWKQFKCPSTDEWINCG

SEQ ID NO: 4496 - protein, 132 aa, Homo sapiens
MAARDATSGSLSEESSALDLPSACDIRDYVLQGPSQEANSEAFSSLEFHSFPYSSDVDPDTSNLNIEQNNSWTAENFWLDPAVKGQSEKEEDDDLRKSLDRFYEMFGHPQPGSANSLSASVCSACLRNHSTK

SEQ ID NO: 4497 - protein, 99 aa, Homo sapiens
MDAQEESIHERTVSRKKKSKRHKEELDGAGGEEYPMDIWLLLASYIRPEDIVNFSLICKNAWTVTCTAAFWTRLYRSTTRWMLPCLCVCDQSQWRSCAV

SEQ ID NO: 4498 - protein, 66 aa, Homo sapiens
  UNSURE 63: Xaa =  * ,Tyr
  UNSURE 58: Xaa = Glu,Gln
  UNSURE 52: Xaa = Ile,Arg
MSRVAKYRRQVSEDPDIDSLLETLSPEEMEELEKELDVVDPDGSVPVGLRQXNQTEKXSTGVXNRG

SEQ ID NO: 4499 - protein, 89 aa, Homo sapiens
MVLAFLSKIRLECSGMISAHCNLHLPDSLASASRVAGITGVHHHARLTFLFLTGTGFHHVGQAGLELLTNMEEPVSTKNTKLAGRGGAC

SEQ ID NO: 4500 - protein, 106 aa, Homo sapiens
MLQVGSCKHSGYQKIKEKPQFCLFVEIDRDKASDLTEIKRKLSEMQDLEETMAKLQLELNLCQKEKERLSDELLVKSDLETVVHQLEQEKQRLSKKVESFAVTERT

SEQ ID NO: 4501 - protein, 62 aa, Homo sapiens
MDLHPVYVESQLMDADLEVSLVPPLEDQSLVAIPMEASSEEPPPPPPLPPERAEGSWGRGIK

SEQ ID NO: 4502 - protein, 84 aa, Homo sapiens
  UNSURE 43: Xaa = Leu,Gln
MVNKDMNGFPVKKCSAFQFFKKRVRRWIKSPMVSVDKHQSPSXKYTGSSMVHIPPGEPDFESSLCQTCLGEHAFQRGVLLRRTS

SEQ ID NO: 4503 - protein, 51 aa, Homo sapiens
MCFVKQLLEGSMLLESHHHSLISSTQGHKHCGRPQDLCLGKPGIVQGFSPC

SEQ ID NO: 4504 - protein, 61 aa, Homo sapiens
  UNSURE 42: Xaa = Asp,Glu
MSASAPAAEGEGTPTQPASEKEPEMPGPREESEEEEDEDDEXEEEEEKEKSLIVEGKKKKK

SEQ ID NO: 4505 - protein, 83 aa, Homo sapiens
MMDTMDPFWFNAFKRTNTILHHLRMSKHTDAAEEVLLEKKGCTGVITLNRPKFLNALTLNMIRQIYPQLKKLEQDPETFLIII

SEQ ID NO: 4506 - protein, 54 aa, Homo sapiens [sequence omitted]

SEQ ID NO: 4507 - protein, 81 aa, Homo sapiens
MESRGKSASSPKPDTKVPQVTTEAKVPPAADGKAPLTKPSKKEAPAEKQQPPAAPTTAPAKKTSAKADPALLNNHSNLKPA

SEQ ID NO: 4508 - protein, 107 aa, Homo sapiens
MAQEVSEYLSQNPRVAAWVEALRCDGETDKHWRHRRDFLLRNAGDLAPAGGAASASTDEAADAESGTRNRQLQQLISFSMAWANHVFLGCRYPQKVMDKILSMAEGI

SEQ ID NO: 4509 - protein, 115 aa, Homo sapiens
  UNSURE 108: Xaa = Ile,Met
MNRPIQVKPADSESRGEDRKLFVGMLNKQQSEDDVRRLFEAFGNIEECTILRGPDGNSKGCAFVKYSSHAEAQAAINALHGSQTMPGASSSLVVKFADTDKERTMRRXSRWLARW

SEQ ID NO: 4510 - protein, 60 aa, Homo sapiens [sequence omitted]

SEQ ID NO: 4511 - protein, 130 aa, Homo sapiens
  UNSURE 5: Xaa =  * ,Cys,Asp,Glu,Gly,Tyr
  UNSURE 14: Xaa = Ala,Gly
  UNSURE 7,16,17: Xaa = Ala,Gly,Pro,Arg
  UNSURE 11: Xaa = Ala,Phe,Ser,Val
  UNSURE 9: Xaa = Asp,Glu,Gly,His,Gln,Arg
  UNSURE 8: Xaa = Cys,Pro,Arg,Ser,Trp
  UNSURE 3,12: Xaa = His,Asn,Pro,Thr
  UNSURE 89: Xaa = His,Gln
  UNSURE 10: Xaa = His,Ile,Lys,Leu,Met,Asn,Gln
  UNSURE 15: Xaa = Pro,Arg,Ser,Trp
  UNSURE 90: Xaa = Pro,Ser
MPXPXPXXXXXXPXXXXLMRDFKRLQEDPPAGVSGAPSENNIMVWNAVIFGPEGTPFEDVYADGSICLDILQNRWSPTYDVSSILTSIXXLLDEPNPNSPANSQAAQLYQENKREYEKRVSAIVEQSWRD

SEQ ID NO: 4512 - protein, 72 aa, Homo sapiens
MRGKEFSDPIHNNTFDHIWRTKEHNEAGWLLLNSVDKVVKENDGPGAVAHACNPSTLGGRGGRITRSGDRDH

SEQ ID NO: 4513 - protein, 65 aa, Homo sapiens
MAAFTTTLQHHKDEVAGDIFDMLLTFTDFLAFKEMFLDYRAEKEGRGLDLSSGLVVTSLCNHLLC

SEQ ID NO: 4514 - protein, 79 aa, Homo sapiens [sequence omitted]

SEQ ID NO: 4515 - protein, 136 aa, Homo sapiens
  UNSURE 26: Xaa = Ser,Trp
MKTGALLLQGFIQDRAGRMGGGGTRXWPWTRVPQDASTKKLSECLKRIGDELDSNMELQRMIAAVDTDSPREVFFRVAADMFSDGNFNWGRVVALFYFASKLVLKALCTKVPGTDQNHHGAGHWTSSGERLLGWIQ

SEQ ID NO: 4516 - protein, 81 aa, Homo sapiens
  UNSURE 26: Xaa = His,Leu,Gln
MDLCSLRNSLAPHFTYVFMYVFKKSXGPGMVAHACNPSTYGRPRWVDDLRSGVRDQPDQHGETPSLLKIKNQPGVVAHAII

SEQ ID NO: 4517 - protein, 153 aa, Homo sapiens
MLAISLVHGGPSPGFFSKTLFNCLVYGPENTQPILDDVSDFDVAQIIIRINTATTVADLKSIINECYNYLELIGCLRLITTLSDKYMLVKDILGYHVIQRVHTPFESFKQGLKTLGVLEKIQAYPEAFCSILCHKPESLSAKILSELFTVHTL

SEQ ID NO: 4518 - protein, 158 aa, Homo sapiens
  UNSURE 148: Xaa = Ala,Pro
MAGDTEVWKQMFQELMREVKPWHRWTLRPDKGLLPNVLKPGWMQYQQWTFARFQCSSCSRNWASAQVLVLFHMNWSEEKSRGQVKMRVFTQRCKKCPQPLFEDPEFTQENISRILKNLVFRILKKCYRGRFQLIEEVPMIKDISLEGXHNSDTVRHVC

SEQ ID NO: 4519 - protein, 69 aa, Homo sapiens
  UNSURE 46: Xaa = Ile,Lys,Arg,Thr
  UNSURE 41: Xaa = Pro,Gln
  UNSURE 47: Xaa = Ser,Thr
MACARPLISVYSEKGESSGKNVTLPAVFKAPIRPDIVNFVXPTCAXXTDSPMLSVNLAGHQTSAESWGY

SEQ ID NO: 4520 - protein, 58 aa, Homo sapiens
MTEEVWMGTWRPHRPRGPIMALYSSPGPKYLIPPTTGFMKHTPTKLRAPAYSFRGAPC

SEQ ID NO: 4521 - protein, 85 aa, Homo sapiens
MYKVHEKNRSYTWLEKQHGPYGAGAFFILKQGGAVKFRDKEWIRPDKYGHFSQEFWNFCEVPVEAVDAGDCDINYEGLDNLLRLK

SEQ ID NO: 4522 - protein, 153 aa, Homo sapiens
  UNSURE 69: Xaa =  * ,Glu
  UNSURE 34: Xaa = Asn,Ser
MAAPWASLRLVAPMWNGRIRGIHRLGAAVAPEGXQKKKRTILQFLTNYFYDVEALRDYLLQREMYKVHXKNRFRDKEWIRPDKYGHFSQEFWNFCEVPVEAVDAGDCDINYEGLDNLLRLKELQSLSLQRCSHVDDWCLSRLYPLADSLQELS

SEQ ID NO: 4523 - protein, 50 aa, Homo sapiens
  UNSURE 25: Xaa =  * ,Tyr
MKTEARTVALAIFSRKLIHVRATVXPRPHRVFPLCCRSLSPAKISLVAEL

SEQ ID NO: 4524 - protein, 90 aa, Homo sapiens
  UNSURE 7: Xaa = Gly,Arg
  UNSURE 10: Xaa = Phe,Leu
MYRTKLXWPXKGPQLPSGKAGKAGRIDGTLLVAITGEVTTFFRILGTSWTMPSPSPQSLESLEMMQRPALKRMPCMLMFSIFRFYLSPVL

SEQ ID NO: 4525 - protein, 80 aa, Homo sapiens
  UNSURE 59: Xaa = Ala,Pro,Ser,Thr
MLRKILASQQPDRCKRAQAFISTQGLKPDTVAELVAEEVTRELLTSSQGTGHKQMFNPXEESQTFLQLTTLCQDRTLVSK

SEQ ID NO: 4526 - protein, 72 aa, Homo sapiens
MREEDNRSGKLSSVIFIRDRNSHGQEISGYIDYAHRLKTEDFEVYFTGKKRLLPRPTDISFYNWDADIAVSN

SEQ ID NO: 4527 - protein, 157 aa, Homo sapiens
MAVPTELDGGSVKETAAEEESRVLAPGAAPFGNFPHYSRFHPPEQRLRLLPPELLRQLFPESPENGPILGLDVGCNSGDLSVALYKHFLSLPDGETCSDASREFRLLCCDIDPVLVKRAEKECPFPDALTFITLDFMNQRTRKVLLSSFLSQFGRSV

SEQ ID NO: 4528 - protein, 107 aa, Homo sapiens
MGGIMAPKDIMTNTHAKSILNSMNSLRKSNTLCDVTLRVEQKDFPAHRIVLAACSDYFCAMFTSELSEKGKPYVDIQGLTASTMEILLDFVYTETVHVTVENVQELL

SEQ ID NO: 4529 - protein, 177 aa, Homo sapiens
MAAATEHNRPSSGDRNLERRCSPNLSREVLYEIFRSLHTLVGQLDLRDDVVKITIDWNKLQSLSAFQPALLFSALEQHILYLQPFLAKLQSPIKEENTTAVEEIGRTEMGNKNEVNDKFSIGDLQEEEKHKESDLRDVKKTQIHFDPEVVQIKAGKAEIDRRISAFIERKQAEINEN

SEQ ID NO: 4530 - protein, 72 aa, Homo sapiens
  UNSURE 57: Xaa = Ala,Gly
  UNSURE 52: Xaa = Lys,Thr
MEVSWGVTAFFLGHHKQETQRPLRASFGISKGEGCPSPYKESLHIGWARWLXPVIPXIFGGEAEAGGSLEVR

SEQ ID NO: 4531 - protein, 130 aa, Homo sapiens
MRLSVAAAISHGRVFRRMGLGPESRIHLLRNLLTGLVRHERIEAPWARVDEMRGYAEKLIDYGKLGDTNERAMRMADFWLTEKDLIPKLFQVLAPRYKDQTGGYTRMLQIPNRSLDRAKMAVIEYKGNSS

SEQ ID NO: 4532 - protein, 63 aa, Homo sapiens
MDESNLRDLNRKSNQVKTCKAKIELLGSYDPQKQLIIEDPIMGMTLTLRRCTAVCQVLQTFLE

SEQ ID NO: 4533 - protein, 76 aa, Homo sapiens
MSAEVETSEGVDESEKKNSGALEKENQMRMSDLSELLKEGTKEAHDRAENTQFVKDFLKGNIKKELFKLATTALYF

SEQ ID NO: 4534 - protein, 147 aa, Homo sapiens
MLKSRISMRSRHPRRAISEGHKSEGTMPPNKEASGLSSSPAGLICLPPISEELQLVWTQAAQTSELDSNEHLLKTFSYFPYPSLADIALLCLRYGLQMEKVKTWFMAQRLRCGISWSSEEIEETRARVVYRRDQLHFKSLLSFTHHA

SEQ ID NO: 4535 - protein, 71 aa, Homo sapiens
MIILSHQDIYTASCVFPQNTHELQREYSNLAVEKLGRYHPNQIIKSNTISNWTNWQCAPFDEMHRGKHSIA

SEQ ID NO: 4536 - protein, 61 aa, Homo sapiens
  UNSURE 11: Xaa = Ala,Cys,Gly,Ser
  UNSURE 60: Xaa = Ile,Arg
  UNSURE 56: Xaa = Lys,Asn
  UNSURE 10: Xaa = Pro,Arg
MPLHTLFSPXXTFSPLLLPLQTPMQPSTPILLWKAFPIPFATTTTNIYSLSPLCAXHCSXH

SEQ ID NO: 4537 - protein, 134 aa, Homo sapiens
MLKNPYTIKKQPLHQFVQRPLFPLPAAFYHPVRYMFIQTQDTPNPNSLKFIPGKPVLETRTMDFPTPAAAFRSPLARQLFRIEGVKSVFFGPDFITVTKENEELDWNLLKPDIYATIMDFFASGLPLVTEETPS

SEQ ID NO: 4538 - protein, 90 aa, Homo sapiens
  UNSURE 83: Xaa = Ala,Pro
  UNSURE 15: Xaa = Phe,Leu
MTPAARDTKTHLLLXPRSCRDDGPLSFPHTFQAHARPGEEMSHREGLAQDHTAGRAGHETKHSGSRVHVFNSTEYSAMAESTXCRPLLGL

SEQ ID NO: 4539 - protein, 81 aa, Homo sapiens
MNGKNTFWDVDGSMVPPEWHRWLHSMTDDPPTTKPLTARKFIWTNHKFNVTGTPEQYVPYSTTRRRFRSGSHLQHLTSKTM

SEQ ID NO: 4540 - protein, 77 aa, Homo sapiens
MSPRRGTWLPRSGVYFHLLPVAGSFPPNPFPGQVILRSSSRLSPLFISSVVCPRCCIPRCYRYTQSPAVVSVLGSRM

SEQ ID NO: 4541 - protein, 129 aa, Homo sapiens
  UNSURE 129: Xaa =  * ,Tyr
  UNSURE 26: Xaa = Ala,Val
  UNSURE 37: Xaa = Lys,Gln
MATELEYESVLCVKPDVSVYRIPPRXSNRGYRASDWXLDQPDWTGRLRITSKGKTAYIKLEDKVSGELFAQAPVEQYPGIAVETVTDSSRYFVIRIQDGTGKRTGILSGTTVRKTGECTAMKSVSDCIX

SEQ ID NO: 4542 - protein, 80 aa, Homo sapiens
MDNFSFPGRASDSVLKGCTQAETQDGYVSFYNLAVLISGSNWHFIFTVTSPPGVNFTARSKPFAVLPVTRKEKSTIILAA

SEQ ID NO: 4543 - protein, 142 aa, Homo sapiens
MEAAADGPAETQSPVEKDSPAKTQSPAQDTSIMSRNNADTGRVLALPEHKKKRKGNLPAESVKILRDWMYKHRFKAYPSEEEKQMLSEKTNLSLLRISNWFINARRRILPDMLQQRRNDPIIGHKTGKDAHATHLQSTEASV

SEQ ID NO: 4544 - protein, 67 aa, Homo sapiens
MEAAADGRLRPKARWKKTARRRPKAQPKDTSIMSRNNADTGRVLALPEHKKKRKGNLPSRVPFKILP

SEQ ID NO: 4545 - protein, 51 aa, Homo sapiens
MKTYIVFCGENWPHLTRVTPMVGDALPRPGPPCRSAEGLWLSFLPSQPALP

SEQ ID NO: 4546 - protein, 78 aa, Homo sapiens
  UNSURE 51: Xaa = Lys,Met
MSNEVETSATNGQPDQQAAPKAPSKKKKKKGPEKTDEYLLARFKGDGVKYXAKLIGIDDVPDARGDKMSQDSMMKLKG

SEQ ID NO: 4547 - protein, 151 aa, Homo sapiens
MVYEYICRCLFKADQLMFALHFVRGMHPELFQENEWDTFTGVVVGDMLRKADSQQKIRDQLPSWIDQERSWAVATLKIALPSLYQTLCFEDAALWRTYYNNSMCEQEFPSILAKKVSLFQQILVVQALRPDRLQSAMALFACKTLGKCDAF

SEQ ID NO: 4548 - protein, 78 aa, Homo sapiens
MFKNTFQSGFLSILYSIGSKPLQIWDKKVRNGHIKRITDNDIQSLVLEIEGTNVSTTYITCPADPKKTLGIKLPFPCH

SEQ ID NO: 4549 - protein, 151 aa, Homo sapiens
  UNSURE 42: Xaa = Gly,Ser
  UNSURE 110: Xaa = Gly,Val
  UNSURE 74: Xaa = Leu,Arg
MAAPLGGMFSGQPPGPPQAPPGLPGQASLLQAAPGAPRPSSXTLVDELESSFEACFASLVSQDYVNGTDQEEIXTGVDQCIQKFLDIARQTECFFLQKRLQLSVQKPEQXIKEDVSELRNELQRKDALVQKHLTKLRHWQQVLEDINVQHK

SEQ ID NO: 4550 - protein, 163 aa, Homo sapiens
  UNSURE 150: Xaa = Gly,Arg,Trp
MEDLLDLDEELRYSLATSRAKMGRRAQQESAQAENHLNGKNSSLTLTGETSSAKLPRCRQGGWAGDSVKASKFRRKASEEIEDFRLRPQSLNGSDYGGDIPIIPDLEEVQEEDFVLQVAAPPSIQIKRVMTYRDLDNDLMKYSAIQTLDXEIDLKLLTKVLAP

SEQ ID NO: 4551 - protein, 70 aa, Homo sapiens [sequence omitted]

SEQ ID NO: 4552 - protein, 83 aa, Homo sapiens
MFTLSQTSRAWFIDRARQAREERLVQKERERAAVVIQAHVRSFLCRSRLQRDIRREIDDFFKADDPESTKRSALCIFKIARKL

SEQ ID NO: 4553 - protein, 63 aa, Homo sapiens
MIVSFLRPRQPCGTMESCPVAQAGVRWCHLGSLQPLPPRFKRFSCLTLPSSWDYRGHYFQSQR

SEQ ID NO: 4554 - protein, 147 aa, Homo sapiens
MHWLRKVQGLCTLWGTQMSSRTLYINSRQLVSLQWGHQEVPAKFNFASDVLDHWADMEKAGKRLPSPALWWVNGKGKELMWNFRELSENSQQAANVLSGACGLQRGDRVAVVLPRVPEWWLVILGCIRAGLIFMPGTIQMKSTDILY

SEQ ID NO: 4555 - protein, 54 aa, Homo sapiens
MLPLEKAFASPRSSPAPPDLPTPGSAAGVQQEEPETIPERTPADLEFSRLRFRE

SEQ ID NO: 4556 - protein, 50 aa, Homo sapiens [sequence omitted]

SEQ ID NO: 4557 - protein, 90 aa, Homo sapiens
MRRTHGVCSKGPQAGGEHPVLHCPPGFPEAHRLLSALSLRGWPPGPREEEECQEGPGWGWGWRRRGGGLSPPVPPGLLDCLVFLPNKQDQ

SEQ ID NO: 4558 - protein, 110 aa, Homo sapiens
MTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRQ

SEQ ID NO: 4559 - protein, 92 aa, Homo sapiens
MYGVGKWKRSWRGRRRLTCTEYFIRTSENQLLIMARDIHSLEEPRDRLLYTHTATGPLLYCLLDNGCKMFKNKTKQKRGTSLSAITQRGIFI

SEQ ID NO: 4560 - protein, 83 aa, Homo sapiens
  UNSURE 67: Xaa = Asp,His,Asn,Tyr
  UNSURE 53: Xaa = Lys,Asn
  UNSURE 60: Xaa = Lys,Met
MFPHRKNVNKPVGGTNVPEMFIKKEELQELKCADVEDEDWDISSLEEEISLGXKSGKEQXEPPPAKXEPHFAHVLNAWGHLIL

SEQ ID NO: 4561 - protein, 59 aa, Homo sapiens
MKAVGLAWAIGFPCGILLFILTKREVDKDRVKQMKARQNMRLSNTGEYESQRFRASSQS

SEQ ID NO: 4562 - protein, 139 aa, Homo sapiens
MNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGIPSRQRTPKINM

SEQ ID NO: 4563 - protein, 162 aa, Homo sapiens
MAGELEVLRSQERRLKEKVTNMEVALDKASLQFAECQDIIQRQEQESVRLKLQHTLDIKELQGPGYTSNSSLKPRLLQPASVTRSHSNVPSSQSTASFLSHHSTKANTLKEDPTRDLKQLLQELRSVINEEPAVSLSKTEEDGRTSLGALEDRVRDCITESS

SEQ ID NO: 4564 - protein, 68 aa, Homo sapiens
MEKRLQEAQLYKEEGNQRYREGKYRDAVSRYHRALLQLRGLDPSLPSPLPNLGPQGPASRLNKKTYCI

SEQ ID NO: 4565 - protein, 105 aa, Homo sapiens
MYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVNLRRLLL

SEQ ID NO: 4566 - protein, 148 aa, Homo sapiens
MFKKFDEKENVSNCIQLKTSVIKGIKNQLIEQFPGIEPWLNQIMPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVM

SEQ ID NO: 4567 - protein, 85 aa, Homo sapiens
MGVGRQQRGPFQGVRVKNSVKELLLHIRSHKQKASGQAVDDFKTQGVNIEQFRELKNTVSYSGKRKGPDSLSDGPACKRPALLHS

SEQ ID NO: 4568 - protein, 152 aa, Homo sapiens
  UNSURE 151: Xaa = Lys,Met,Arg,Thr
MPEIRVTPLGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVQLHQTVQVDDELEIXA

SEQ ID NO: 4569 - protein, 62 aa, Homo sapiens
  UNSURE 59: Xaa = Glu,Lys,Gln
MSAEVETSEGVDESEKKNSGALEKENQMRMADLSELLKEGTKEAHDRAVFLKKKKKKKXKKK

SEQ ID NO: 4570 - protein, 148 aa, Homo sapiens
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKKKKR

SEQ ID NO: 4571 - protein, 53 aa, Homo sapiens
MSAEVETSEGVDESEKKNSGALEKENQMRMADLSELLKEGTKEAHDRAVFLKK

SEQ ID NO: 4572 - protein, 60 aa, Homo sapiens
MLRIVEPYVTWGFPNLKSVRELILKRGQAKVKNKTIPLTDNTVIEEHLGECYSLGVSWGR

SEQ ID NO: 4573 - protein, 99 aa, Homo sapiens
  UNSURE 98: Xaa =  * ,Leu
  UNSURE 66: Xaa = Ala,Glu,Gly,Val
MWSVGVIMYVSLSGTFPFNEDEDINDQIQNAAFMYPASPWSHISAGAIDLINNLLQVKMRKRYSVXQISQPPLVTGVPDVAGPPRAGGEDGRAIHHAXE

SEQ ID NO: 4574 - protein, 139 aa, Homo sapiens
  UNSURE 129: Xaa = Ala,Thr
MPPNLTGYYRFVSQKNMEDYLQALNISLAVRKIALLLKPDKEIEHQGNHMTVRTLSTFRNYTVQFDVGVEFEEDLRSVDGRKCQTIVTWEEEHLVCVQKGEVPNRGWRHWLEGEMLYLELTARDAVLRXGLQEGQIALR

SEQ ID NO: 4575 - protein, 63 aa, Homo sapiens
MADSTTMLSISDPIHMVLIKTDIFGETTLVASYFLEWRSVLGSENGVTSLTVELMGAQNQKFL

SEQ ID NO: 4576 - protein, 92 aa, Homo sapiens
MSLPPEKASELKQLIHQQLSKMDVHGRIREILAETIREELAPDQQHLSTEDLIKALRRRGIIDDVMKELNFVTDSVEQELPSSPKQPICFDR

SEQ ID NO: 4577 - protein, 54 aa, Homo sapiens [sequence omitted]

SEQ ID NO: 4578 - protein, 63 aa, Homo sapiens [sequence omitted]

SEQ ID NO: 4579 - protein, 125 aa, Homo sapiens
  UNSURE 124: Xaa = Ala,Pro,Ser,Thr
MVKIAFNTPTAVQKEEARQDVEALLSRTVRTQILTGKSTIYRGEMCFFDSEDPANSLRGGEPNFLPVTEEADIREDDNIAIIDVPVPSFSDSDPAAIIHDFEKGMTAYLDLLLGNCYLMPSILXI

SEQ ID NO: 4580 - protein, 124 aa, Homo sapiens
MFGAAGRQPIGAPAAGNSWHFSRTMEELVHDLVSALEESSEQARGGFAETGDHSRSISCPLKRQARKRRGRKRRSYNVHHPWETGHCLSEGSDSSLEEPSKDYRENHNNNKKDHSDSDDQMLVA

SEQ ID NO: 4581 - protein, 93 aa, Homo sapiens
MELKDNILVSGNADSTVKIWDIKTGQCLQTLQGPNKHQSAVTCLQFNKNFVITSSDDGTVKLWDLKTGEFIRNLVTLESGGSGGVVWRIRASN

SEQ ID NO: 4582 - protein, 98 aa, Homo sapiens
MGTPASGRKRTPVKDRFSAEDEALSNIAREAEARLAAKRAARAEARDIRMRELERQQKELDEKSDKQYAENYTRPSSRNSASATTPLSGNSSRRGSGD

SEQ ID NO: 4583 - protein, 61 aa, Homo sapiens
MDEKVELYRIKFKESFAEMNRGSNEWKTVVGGACSSSVSPRSLSCGQKHYVYGPPPAKLLT

SEQ ID NO: 4584 - protein, 64 aa, Homo sapiens
  UNSURE 42: Xaa = Gly,Leu,Arg,Val
MDEKVELYRIKFKESFAEMNRGSNEWKTVVGGACSSSVSPRXVIMWQKHYVYGPLPQSFDKEWV

SEQ ID NO: 4585 - protein, 91 aa, Homo sapiens
MVQPFTTIPFPPPPQNGIPTEYGVPHTQDYAGQTGEHNLTLYGSTQAHGEQSSNSPSTQNGSLTTEGGAQTDGQQSQTQSSENSRRVNLPE

SEQ ID NO: 4586 - protein, 82 aa, Homo sapiens
MMYLWGNQEPTTTPDAMVQPFTTIPFPPPPQNGIPTEYGVPHTQDYAGQTGEHNLTLYGSTQAHGEQSSNSPSTQNGSLTTE

SEQ ID NO: 4587 - protein, 80 aa, Homo sapiens
  UNSURE 22: Xaa = His,Lys,Asn,Gln
  UNSURE 23: Xaa = Phe,Ile
MVGSALRRGAHAYVYLVSKASXXSRGHQHQAWGSRPPAAECATQRAPGSVVELLGKSYPQDDHSNLTRKVLTRVVRNLHN

SEQ ID NO: 4588 - protein, 127 aa, Homo sapiens [sequence omitted]

SEQ ID NO: 4589 - protein, 76 aa, Homo sapiens
MEPAFVETVGCPVASQIGVLGIRFDPEIPQTLRLEFAKANTKMAKNKLVGTPNPSTPLPNTVPQFIAREPYELTVP

SEQ ID NO: 4590 - protein, 127 aa, Homo sapiens
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSP

SEQ ID NO: 4591 - protein, 107 aa, Homo sapiens
MENPYKEPLKKCILCGKHVDYKNVQLLSQFVSPFTGCIYGRHITAFYFTGLCGKKQKEITKAIKRAQIMGVYASYIQGSWHISRTLKFVTSDIGNKFYHVTTKKKKK

SEQ ID NO: 4592 - protein, 81 aa, Homo sapiens
MRDADKHYIKPITKCESSTQTNTHILPPTIVRSYEWNEWELRRKAIKLANLRQKVTHSVQTDLSHLRRENCSQVYPPKDTS

SEQ ID NO: 4593 - protein, 64 aa, Homo sapiens
MGLDKSITICIHFCSIIQSGCHCPQNLCALPIHHSLLILGNLDFSVFLLFQTVMYSIWNHTVCS

SEQ ID NO: 4594 - protein, 50 aa, Homo sapiens
MLPNYAQIRQILNCTNQGNSEYNFLCSGYKYISPLWMWSHSEQSSFWDGA

SEQ ID NO: 4595 - protein, 50 aa, Homo sapiens
MPALTTPSRFSPSGSLSFVLFIQGTLHLKLSASPTRSEKLKDLSCVGAQY

SEQ ID NO: 4596 - protein, 64 aa, Homo sapiens
MNLVGPQSIEGGAHEGLQHLGPFGNIPNIVAELTGDNIPKDFSEDQGYQTLQIPVLLEKQMMDV

SEQ ID NO: 4597 - protein, 55 aa, Homo sapiens
  UNSURE 20: Xaa = Phe,Val
MVAHSSCTLQYRGKDGEIFXPRTQITGSRLLFLETSCMPPAQPFLWTYYEDYIGD

SEQ ID NO: 4598 - protein, 62 aa, Homo sapiens [sequence omitted]

SEQ ID NO: 4599 - protein, 96 aa, Homo sapiens
  UNSURE 76: Xaa = Arg,Ser
MNLILCDCDEFRKIKPKNSKQAEREEKRVLGLVLLRGENLVSMTVEGPPPKDTGIARVPLAGAAGGPGIGRAAGQXESQLGFPCPRLLQELAGPVR

SEQ ID NO: 4600 - protein, 75 aa, Homo sapiens
  UNSURE 58: Xaa = His,Pro
  UNSURE 28: Xaa = Met,Val
  UNSURE 19: Xaa = Pro,Gln
  UNSURE 53: Xaa = Ser,Tyr
MEDLDQSPLVSSSDSPPRXQPAFKYQFXREPEDEEEDLEELEVLERKPAAGLXAAPVXTAPAAGAPLMDFGNDFV

SEQ ID NO: 4601 - protein, 75 aa, Homo sapiens; identical to SEQ ID NO: 4600
  UNSURE 58: Xaa = His,Pro
  UNSURE 28: Xaa = Met,Val
  UNSURE 19: Xaa = Pro,Gln
  UNSURE 53: Xaa = Ser,Tyr

SEQ ID NO: 4602 - protein, 141 aa, Homo sapiens
  UNSURE 124: Xaa =  * ,Ala,Glu,Ser
  UNSURE 127: Xaa =  * ,Arg,Ser,Thr,Trp
  UNSURE 118: Xaa =  * ,Asp,Glu,Phe,Leu,Val,Tyr
  UNSURE 136: Xaa =  * ,Cys,Phe,Leu,Arg
  UNSURE 119: Xaa =  * ,Cys,Pro,Arg,Ser
  UNSURE 131: Xaa =  * ,Phe,Ile,Lys,Leu,Asn,Tyr
  UNSURE 128,130: Xaa =  * ,Phe,Ile,Lys,Leu,Met,Asn,Tyr
  UNSURE 133: Xaa = Ala,Val
  UNSURE 47: Xaa = Asn,Ser
  UNSURE 122,134: Xaa = Asp,Glu,Gly,Lys,Asn,Arg,Ser
  UNSURE 120: Xaa = Asp,Glu,His,Leu,Gln,Val
  UNSURE 117: Xaa = Gly,Ile,Ser,Val
  UNSURE 121: Xaa = His,Asn,Pro,Thr
  UNSURE 116: Xaa = Ile,Thr
  UNSURE 115: Xaa = Leu,Gln
  UNSURE 135: Xaa = Lys,Gln,Arg
  UNSURE 132: Xaa = Lys,Leu,Met,Gln
  UNSURE 123: Xaa = Phe,His,Leu,Tyr
  UNSURE 126: Xaa = Ser,Thr
MQGSTRRMGVMTDVHRRFLQLLMTHGVLEEWDVKRLQTHCYKVHDRXATVDKLEDFINNINSVLESLYIEIKRGVTEDDGRPIYALVNLATTSISKMATDFAENELDLFRKALEXXXXXXXXXXSXXXIXXXXXXXKGKKM

SEQ ID NO: 4603 - protein, 99 aa, Homo sapiens
  UNSURE 43: Xaa = Asp,Glu
MSWDCGFKYIFAFSPTLKAGVMCKLQERDEIGRIELVQKLAKXNYQFLQTDKKEQEKSEHQDDEVTTVQVKEQDQSVLVLKKVQCCGPAPTAGSAESHW

SEQ ID NO: 4604 - protein, 120 aa, Homo sapiens
MSDNEDNFDGDDFDDVEEDEGLDDLENAEEEGQENVEILPSGSDRSQPEANHHTIHDQVRASPRAGHPSAPDCDVCPCDGGAGGETDPLLIAMKELKARKIPIIIRRYLPDGSYEDWGVD

SEQ ID NO: 4605 - protein, 61 aa, Homo sapiens
  UNSURE 39: Xaa = Ile,Arg,Ser
MSEHQKEQTPDKPSLRTVTLTARVRGFILEVSKTKSSPXLDTAPLFTTAKKWKQFKCPSTD

SEQ ID NO: 4606 - protein, 101 aa, Homo sapiens
MSENAVRQNGQLVRNDSLVTPSPQQARVCPPHMLPEDGANLSSARGILSLIQSSTRRAYQQILDVLDENRRPVLRGGSAAATSNPHHDNVRYGISNIDTSE

SEQ ID NO: 4607 - protein, 128 aa, Homo sapiens
MSENAVRQNGQLVRNDSLVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQ

SEQ ID NO: 4608 - protein, 127 aa, Homo sapiens
MSENAVRQNGQLVRNDSLVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRL

SEQ ID NO: 4609 - protein, 121 aa, Homo sapiens
MSENAVRQNGQLVRNDSLVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQII

SEQ ID NO: 4610 - protein, 123 aa, Homo sapiens
  UNSURE 78: Xaa = Pro,Ser
MSENAVRQNGQLVRNDSLVTPSPQQARVCPPHMLPEDGANLSSARGILSLIQSSTRRAYQQILDVLDENRRPVLRGGXAAATSNPHHDNVRYGISNIDTTIEGTSDDLTVVDAASLRRQIIKL

SEQ ID NO: 4611 - protein, 129 aa, Homo sapiens
  UNSURE 43: Xaa = Cys,Ser
  UNSURE 75: Xaa = Gly,Arg
  UNSURE 19,50: Xaa = Leu,Val
MSENAVRQNGQLVRNDSLXTPSPQQARVCPPHMLPEDGANLSXARGILSXIQSSTRRAYQQILDVLDENRRPVLXGGSAAATSNPHHDNVRYGISNIDTTIEGTSDDLTVVDAASLRRQIIKLNRRLQL

SEQ ID NO: 4612 - protein, 124 aa, Homo sapiens
MLWQDGGERRPPSYFYRQHLREAHFQSGHERGQAEGARLYRAWYREVPNTVHQFQLDITVKMGRDKVREMFMKNAHVTDPRVVDLLVIKGKIELEETIKVWKQRTHVMRFFHETEAPRPKDFPI

SEQ ID NO: 4613 - protein, 51 aa, Homo sapiens
  UNSURE 26: Xaa = Gly,Arg
  UNSURE 25: Xaa = Ile,Lys,Met,Asn,Arg,Ser,Thr
MRVAPLFEAVPELSSHRLLRTEPGXXTVPVWLDAPKLTTEVPFSCGSSSWS

SEQ ID NO: 4614 - protein, 148 aa, Homo sapiens
MTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNAGALSAHRYFRDNPSELCCIIV

SEQ ID NO: 4615 - protein, 88 aa, Homo sapiens
MRRSRNLTSKARKKPYVNSLCFRPRRKRSLQETISLTLFHGHKQEVPGSTVSRPTCNMTLQLIPSEDGNYFFTPLNLGWLCNLFWPIE

SEQ ID NO: 4616 - protein, 100 aa, Homo sapiens
  UNSURE 78: Xaa = Asn,Thr
  UNSURE 37: Xaa = Asp,Glu
  UNSURE 34: Xaa = Cys,Phe,Tyr
MLKKDVDAAYMNKVELEAKVDALMDEINFMKMFXDAXCPRCRRMSLTPQWSSPWTTTATWTWIASSLRSRPSMRRLPXAAGQKPSPGIRPSMRSCSRQLA

SEQ ID NO: 4617 - protein, 153 aa, Homo sapiens
  UNSURE 41: Xaa = Glu,Gln
MEPQRRETQVAAWLKKIFGDHPIPQYEVNPRTTEILHHLSXRNRVRDRDVYLVIEDLKQKASEYESEAKYLQDLLMESVNFSPANLSSTGSRYLNALVDSAVALETKDTSLASFIPAVNDLTSDLFRTKSKSEEIKIELEKLEKNLTATLVLE

SEQ ID NO: 4618 - protein, 85 aa, Homo sapiens
MDNEEKQGGMMAHPRVAQSQRTPHPRPREEVSYCVTPPGKPRFSQEATCGPGDLMNPLYQSLGSDTQSCAESWQSSHSGTHRNPG

SEQ ID NO: 4619 - protein, 52 aa, Homo sapiens
MSAEVETSEGVDESEKKNSGALEKENQMRMADLSELLKEGTKEAHDRAVFLK

SEQ ID NO: 4620 - protein, 133 aa, Homo sapiens
  UNSURE 109: Xaa = Ala,Glu,Gly,Val
  UNSURE 50: Xaa = Ala,Val
  UNSURE 120: Xaa = Cys,Gly,Arg,Ser
  UNSURE 115: Xaa = Lys,Gln
  UNSURE 128: Xaa = Pro,Gln
MIITTWIVYILARKGVGLPFLPITSSDIDVVESEAVSVLHHWLKKTEEEXSRGIKEKLSINHPSQGVREKMSTDSPPTHGQDIHVTRDVVKHHLSKSDLLANQSQEVLXERTRIXFIRWXHTRIFQVXSEMTE

SEQ ID NO: 4621 - protein, 84 aa, Homo sapiens
MYDFAAEPGNNELTVNEGEIITITNPDVGGGWLEGRNIKGERGLVPTDYVEILPSDGKDQFSCGNSVADQASLILSQPAQLRPV

SEQ ID NO: 4622 - protein, 84 aa, Homo sapiens
  UNSURE 53: Xaa =  * ,Glu
  UNSURE 79: Xaa = Gly,Arg
  UNSURE 66: Xaa = Ile,Met,Val
  UNSURE 33: Xaa = Lys,Thr
MREIVHLQAGQCGNQIGAKFWEVISDEHGIDPXGTYHGDSDLQLERINVYYNXATGGKYVPRAVLXDLEPGTMDSVRSXPFGQI

SEQ ID NO: 4623 - protein, 117 aa, Homo sapiens
  UNSURE 35: Xaa =  * ,Trp
  UNSURE 48: Xaa = Ala,Pro
  UNSURE 36: Xaa = Asp,His
MAAAAAAAPSGGGGGGEEERLLHKNTDSPVPALMXXVTPQNTPCFCRXAPTGFHGSWDVRAQSLAVSQAGVRWCDLGSLQPPPSGFGRFSCLSLPNSWDYRTQEGEAAARGSLFVGG

SEQ ID NO: 4624 - protein, 56 aa, Homo sapiens
  UNSURE 43: Xaa = Pro,Thr
MFGALGLPHPLGGLQSEDFSSHTGTCTGTVLSAYCQVGREPGXLSCLPPSMCLPYP

SEQ ID NO: 4625 - protein, 105 aa, Homo sapiens
  UNSURE 93: Xaa =  * ,Tyr
  UNSURE 85: Xaa = Ala,Gly
  UNSURE 98: Xaa = Lys,Arg
MPLHSHCLQSLCPRTPSTSHPLGGLQSEDFSSHTGTCTGTVLSAYCQVGREARTPQLSATIYVPPLPPSFLSTDGATLGLPQEKXSPLLSPIXPVCGXHCSLCFV

SEQ ID NO: 4626 - protein, 114 aa, Homo sapiens
MTSLFAQEIRLSKRHEEIVSQRLMLLQQMENKLGDQHTEKASQLQTVETAFKRNLSLLKDIEAAEKSLQTRIHPLPRPEVVSLETRYWASVEEYIPKWEQFLLGEHHILLLLKI

SEQ ID NO: 4627 - protein, 120 aa, Homo sapiens
MAKFVIRPATAADCSDILRLIKELAKYEYMEEQVILTEKGNSTVAGRGTSVRCLSPSPRPLPPLLPLLADLLEDGFGEHPFYHCLVAEVPKEHWTPEGNPSPFPEARETKCYVRSSVGCV

SEQ ID NO: 4628 - protein, 94 aa, Homo sapiens
MKSCQKMEGKPENESEPKHEEEPKPEEKPEEEEKLEEEAKAKGTFRERLIQSLQEFKEDIHNRHLSNEDMFREVDEIDEIRRVRNKLIVMRWKV

SEQ ID NO: 4629 - protein, 157 aa, Homo sapiens
MKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAF

SEQ ID NO: 4630 - protein, 113 aa, Homo sapiens
MKAEIRMFFETNDSKDTIYKNLWDTFKAVCRVKFIALNAHKRKQERSKIDTLTSQLKELEKQEQTHSKASRRQEVTKIRVELKEIETQKTLQKINESRSWFSERINKIDRPLA

SEQ ID NO: 4631 - protein, 59 aa, Homo sapiens
MAQSKLDCRSPVGLDCCNCCLDLAHRSGLQRGSSGENNNPGSPTVSNFRQLQEKLVFEN

SEQ ID NO: 4632 - protein, 75 aa, Homo sapiens
  UNSURE 5: Xaa = Lys,Arg
MTCRXRRRNGSKEGNHHSTQPKRNKRNPIFQDSQDTEFSWSDNERSSSRINIPERASGPEGNLNQIVTEPDANFP

SEQ ID NO: 4633 - protein, 115 aa, Homo sapiens
  UNSURE 3: Xaa = Asp,Glu
  UNSURE 23: Xaa = Gly,Arg
MAXCRRCRSQRRSHCCQDRRLRXQDSLCGDTIRLCHFHCLWHPQTQTPSDPYLPRCGLNYKSCFQPLFQFEDMQEIIQNFVRVHVDAPGMEREPLCSLWISVPISGPACRHDPLR

SEQ ID NO: 4634 - protein, 52 aa, Homo sapiens
MGWDLGTRLFQRQEQRSRLSRIWLEKTRVFLEGSTRTPALSHCLFWLLQVPS

SEQ ID NO: 4635 - protein, 102 aa, Homo sapiens
MRLTEKSEGEQQLKPNNSNAPNEDQEEEIQQSEQHTPARQRTQRADTQPSRCRLPSRRTPTTSSDRTINLLEVLPWPTEWIFNPYRLPDLFELYPEFLLVFK

SEQ ID NO: 4636 - protein, 77 aa, Homo sapiens
MRDNIIISGSTDRTLKVWNAETGECIHTLYGHTSTVRCMHLHEKRVVSGSRDATLRVWDIETGQCLHVLMGHVAAVR

SEQ ID NO: 4637 - protein, 216 aa, Homo sapiens
  UNSURE 180: Xaa = Ala,Asp
MPERVAPSAQVQQVAARGGAGGGGGGGGGWGGAGGKCCDAVPGRGRRVEAEYQFPSGKAAMAIFSVYVVNKAGGLIYQLDSYAPRAEAEKTFSYPLDLLLKLHDERVLVAFGQRDGIRVGHAVLAINGMDVNGRYTADGKEVLEYLGNPANYPVSIRFGRPRLTSNEKLMLASMFHSLFXIGSQLSPEQGSSGIEMLETDTFKLHCYQTLTGDQSL

SEQ ID NO: 4638 - protein, 166 aa, Homo sapiens
MAPKGSSKQQSEEDLLLQNFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNY

SEQ ID NO: 4639 - protein, 131 aa, Homo sapiens
  UNSURE 8: Xaa = Leu,Val
MPRPLRAXRRVVVEPQLSRGLALFWSPRPNPPEEMSGGLAPSKSTVYVSNLPFSLTNNDLYRIFSKYGKVVKVTIMKDKDTRKSKGVAFILFLDKDSAQNCTRAINNKQLFGRVIKASIAIDNGRAAEFIR

SEQ ID NO: 4640 - protein, 191 aa, Homo sapiens
  UNSURE 166: Xaa = Glu,Gly
MAAAADERSPEDEEDEEEEEQLVLVELSGIIDSDFLSKCENKCKVLGIDTERPILQVDSCVFAGEYEDTLGTCVIFEENVEHADTEGNNKTVLKYKCHTMKKLSMTRTLLTEKKEGEENIGGVEWLQIKDNDFSYRPNMICNFLHENEDEEVVASAPDKSLELEEXEIQMNDSSNLSCEQEKPNHLEIEDS

SEQ ID NO: 4641 - protein, 102 aa, Homo sapiens
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVE

SEQ ID NO: 4642 - protein, 58 aa, Homo sapiens
MVLQIVSKTPALSAVFWWPEMRAPCSEVPGSGTVETPLARTMESAQDHAVGHTASCAE

SEQ ID NO: 4643 - protein, 55 aa, Homo sapiens
MLDKDLQGRMRKPGTVQEGRALVVERSDDKGLRQKGNGGVKEAAGEGLKTMCSHS

SEQ ID NO: 4644 - protein, 59 aa, Homo sapiens
  UNSURE 40: Xaa = His,Gln
MILSLSPLFMQIIHGVSMQIAWSLSDRSWALVEVRKLNGXGKIECRFLRESLLGFQPAF

SEQ ID NO: 4645 - protein, 55 aa, Homo sapiens
  UNSURE 50: Xaa = Ala,Val
MVNLGRLYRSLGENSMAEEWYKRALQVAHKAEILSPLGALYYNTGRYEEXLQIYQ

SEQ ID NO: 4646 - protein, 89 aa, Homo sapiens
MAAQIPESDQIKQFKEFLGTYNKLTETCFLDCVKDFTTREVKPEETTCSEHCLQKYLKMTQRISMRFQEYHIQQNEALAAKAGLLGQPR

SEQ ID NO: 4647 - protein, 133 aa, Homo sapiens
  UNSURE 128: Xaa = Arg,Trp
MSQEGVELEKSVRRLREKFHGKVSSKKAGALMRKFGSDHTGVGRSIVYGVKQKDGQELSNDLDAQDPPEDMKQDRDIQAVATSLLPLTEANLRMFQRAQDDLIPAVDRQFACSSCDHVWWRACPSGRXYPVPE

SEQ ID NO: 4648 - protein, 104 aa, Homo sapiens
MEPEAFEICPYDPHHRIPLSRFQYHLASCRRKNPKKAKKMATCKYNACHVVPIKNVEEHEAVCVNRSAVEEEDTENPLKVSPPSSEQNDDTQQVSPCLPSPDIW

SEQ ID NO: 4649 - protein, 55 aa, Homo sapiens
  UNSURE 31: Xaa = Gly,Arg,Trp
  UNSURE 28: Xaa = Ile,Met
MSAEVETSEGVDESEKKNSGALEKENQXENXLDLSELLEGRDQGSTRPGSISKKK

SEQ ID NO: 4650 - protein, 147 aa, Homo sapiens
MGISRDNWHKRRKTGGKRKPYHKKRKYELGRPAANTKIGPRRIHTVRVRGGNKKYRALRLDVGNFSWGSECCTRKTRIIDVVYNASNNELVRTKTLVKNCIVLIDSTPYRQWYESHYALPLGRKKGAKLTPEEEEILNKKRSKKKKK

SEQ ID NO: 4651 - protein, 64 aa, Homo sapiens
MDPGPSEKQKPVFTPLRRPGMLVPKQNVSPPDMSALSLKGDQALLGGIFYFLNIFSHGELPPHC

SEQ ID NO: 4652 - protein, 93 aa, Homo sapiens
MVNTLFKSKVWKSNPPGLGVPTPQTLQLHSLTHVIEEKGVKLKLTVTDTPGFGDQINNDNCWDPILGYINEQYEQYLQEEILITRQRHIPDTR

SEQ ID NO: 4653 - protein, 83 aa, Homo sapiens [sequence omitted]

SEQ ID NO: 4654 - protein, 143 aa, Homo sapiens
MGISRDNWHKRRKTGGKRKPYHKKRKYELGRPAANTKIGPRRIHTVRVRGGNKKYRALRLDVGNFSWGSECCTRKTRIIDVVYNASNNELVRTKTLVKNCIVLIDSTPYRQWYESHYALPLGRKKGAKLTPEEEEILNKKKKK

SEQ ID NO: 4655 - protein, 65 aa, Homo sapiens
MMLALVYIERLRHRNPDYLQHVSSSDLFLISMMVASKYLYDEGEEEEVFNDEWGAAGGVAVPLSM

SEQ ID NO: 4656 - protein, 125 aa, Homo sapiens
MVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPV

SEQ ID NO: 4657 - protein, 105 aa, Homo sapiens [sequence omitted]

SEQ ID NO: 4658 - protein, 66 aa, Homo sapiens
MKKLKPGLTDPVLKFSAKCKQQHWSIVILSRHLNIAKLILFIFINIGHTNQILSFNKINVTKKLTS

SEQ ID NO: 4659 - protein, 143 aa, Homo sapiens; identical to SEQ ID NO: 4654

SEQ ID NO: 4660 - protein, 151 aa, Homo sapiens
  UNSURE 31: Xaa = Glu,Lys
MQRRVKEGYRDGIDAGKAVTLQQGFNQGYKXGAEVILNYGRLRGTLSALLSWCHLHNNNSTLINKINNLLDAVGQCEEYVLKHLKSITPPSHVVDLLDSIEDMDLCHVVPAEKKIDEAKDERLCENNAEFNKNCSKSHSGIDCSYVECCRH

SEQ ID NO: 4661 - protein, 58 aa, Homo sapiens
MRRPPCSHDVEPADFYLFPRIKNSANGKKKKKKKKKKKKKKKKKKKKKKKKKKKKKKK

SEQ ID NO: 4662 - protein, 84 aa, Homo sapiens
MKKRLQEKCQALERKNSAIPSELNEKQELVYTNKKLELQVESMLSEIKMEQAKTEDEKSKLTVLQMTHNKLLQEHNNALKTIEE

SEQ ID NO: 4663 - protein, 78 aa, Homo sapiens
MQTLQNVSMVQSEISEILNKSIIEVENPQFSSEKNLVFGTRIEKDLPTENQEENLSMEKSHHFEDSKTLHSVEEKLSG

SEQ ID NO: 4664 - protein, 142 aa, Homo sapiens
  UNSURE 137: Xaa = Lys,Arg
MSPEKQHREEDEVDSVLLSASKILNSSEGVKESGCSDTEYGCIAESENQIQPQSALKVLQQQLESFQALRMQTLQNVSMVQSEISEILNKSIIEVENPQFSSEKNLVFGTRIEKDLPTENQEENLSMEKSHHFEDSXTLHFS

SEQ ID NO: 4665 - protein, 71 aa, Homo sapiens
  UNSURE 23: Xaa = Cys,Trp
MVLLRYCSLTPDRERRNPLRAPXVHRSLSITLSVFRIIIQVAFPNFVGYIRSTPAPWDDQCAFFLFLKTAK

SEQ ID NO: 4666 - protein, 150 aa, Homo sapiens
MGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAE

SEQ ID NO: 4667 - protein, 65 aa, Homo sapiens [sequence omitted]

SEQ ID NO: 4668 - protein, 89 aa, Homo sapiens
MKTPNAQEAEGQQTRAAAGRATGSANMTKKKVSQKKQRGRPSSQPRRNIVGCRISHGWKEGDEPITQWKGTVLDQVPINPSLYLVKYDG

SEQ ID NO: 4669 - protein, 82 aa, Homo sapiens
MSAARESHPHGVKRSASPDDDLGSSNWEAADLGNEERKQKFLRLMGAGKGKKTRKLMKNWSLNISKVWTVNYQEEYRRHCGL

SEQ ID NO: 4670 - protein, 95 aa, Homo sapiens
  UNSURE 16: Xaa = Asp,His
  UNSURE 83: Xaa = His,Asn
MTEQAISFAKDFLAGXRRRHLQDGRGSDRAGQAAAAGPARQQADRRRQAVQGHRGLHCPHPQGAGRAVLLEGQPCQRHSLLPXSSPQLRLQGIRY

SEQ ID NO: 4671 - protein, 89 aa, Homo sapiens
  UNSURE 23: Xaa =  * ,Glu,Leu,Val
  UNSURE 13: Xaa =  * ,Gly
  UNSURE 11: Xaa = Ala,Pro
  UNSURE 24: Xaa = Glu,Lys
  UNSURE 17,20: Xaa = Leu,Pro
  UNSURE 22: Xaa = Met,Arg
  UNSURE 19: Xaa = Phe,Ile,Asn,Tyr
MRQMIRSFSEXFXRDLXSXXEXXXGRAHNRRGHNDGEDSLTHTDVSSFQTMDQMVSNMRNYMQKLERNFGQLSVDPNGHSFCSSSVMTY

SEQ ID NO: 4672 - protein, 55 aa, Homo sapiens
  UNSURE 23: Xaa = Gly,Arg
MGLARWLTPVIPTLWEAEEGGSXDQEFETSLANMGEIWKKTHKPRHQHLETWEKA

SEQ ID NO: 4673 - protein, 60 aa, Homo sapiens
  UNSURE 45: Xaa = Asp,Glu
  UNSURE 52: Xaa = Gly,Ser
MAAAGAPDGMEEPGMDTEAETVATEAPARPVNCLEAEAAAGAAAXDSGAARXSLQPAPAQ

SEQ ID NO: 4674 - protein, 87 aa, Homo sapiens
MNPPEGKNSEHIPTSEGTNSGHAAFKNCNNARVRGFILEVSKTKNPIPDTFGPPTRARLHEVLVTKHAHRCPGTAPSAIQRCLLQMK

SEQ ID NO: 4675 - protein, 111 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTE

SEQ ID NO: 4676 - protein, 70 aa, Homo sapiens [sequence omitted]

SEQ ID NO: 4677 - protein, 70 aa, Homo sapiens
MRLNLGEEVPVIIHRDNIISDYDQIIDYVERTFTGEHVVALMPEVGSLQHDGCCSTGSCWTHCPWMPTRM

SEQ ID NO: 4678 - protein, 88 aa, Homo sapiens
MQVDLGCNFFVDTVVPDTSRIYVALGYGFFLELTLAEALKFIDRKSSLLTELSNSLTKDSMNIKAHIHMLLEGLRELQGLQNFPEKPH

SEQ ID NO: 4679 - protein, 88 aa, Homo sapiens; identical to SEQ ID NO: 4678

SEQ ID NO: 4680 - protein, 81 aa, Homo sapiens
  UNSURE 68: Xaa = Glu,Gly
MAAVGRVGSFGSSPPGIILDLHWRPLGQRDSVGQRWRRGRRRRGRAEPLVLHPQRGLHPLALQAPCGXRTCYCWVKMELEK

SEQ ID NO: 4681 - protein, 124 aa, Homo sapiens
MRGPEPGPQPTMEGDVLDTLEALGYKGPLLEEQALTKAAEGGLSSPEFSELCIWLGSQIKSLCNLEESITSAGRDDLESFQLEISGFLKEMACPYSVLISGDIKDRLKKKEDCLKLLLFLSTEL

SEQ ID NO: 4682 - protein, 55 aa, Homo sapiens
  UNSURE 55: Xaa = Lys,Asn
MSAEVETSEGVDESEKKNSGALEKENQMRMADLSELLKEGTKEAHDRAVFLKKKX

SEQ ID NO: 4683 - protein, 53 aa, Homo sapiens
MGTSCSPWISEAKQWDPTLQSLNGVGQCPLRCPVGNDKSRADYEAGILWSSSL

SEQ ID NO: 4684 - protein, 91 aa, Homo sapiens
  UNSURE 30: Xaa = Ala,Gly
  UNSURE 28: Xaa = Arg,Thr
  UNSURE 32: Xaa = His,Leu,Pro,Gln,Arg
MASSCPPPSCRCMGRLVPAAPASLVGSXLXLXLLRPEVDFVVFRGCLAFRPFWGSGIMTFDLKDSRDFGRDPWARARPALGSHPDPHGFAL

SEQ ID NO: 4685 - protein, 94 aa, Homo sapiens
MRRPRGEPAPGARDRLEGATCAGPGGVMVSITQLHASSPALCSDLPCSAVWPAADPSSTALLFGAQQMGGPACWRRPQCRSCARTAAASGTGEE

SEQ ID NO: 4686 - protein, 51 aa, Homo sapiens
  UNSURE 40: Xaa = Asp,His,Asn,Tyr
  UNSURE 37: Xaa = Leu,Arg
MLAMPIDLDTLSPEERRARLRKREAQLQSRKEYEQEXSDXLHVERYRQFWT

SEQ ID NO: 4687 - protein, 67 aa, Homo sapiens
  UNSURE 38: Xaa = Ser,Thr
MAKAAAIGIDLGTTYSCVGVFQHGKVEIIANDQGNRTXPSYVAFTDTERLIGDAAKNQVALNPQNTV

SEQ ID NO: 4688 - protein, 86 aa, Homo sapiens
MAGLELLSDQGYRVDGRRAGELRKIQARMGVFAQADGSAYIEQGNTKALAVVYGPHEIRGSRARALPDRALVNCQYSSATFSTGER

SEQ ID NO: 4689 - protein, 50 aa, Homo sapiens
  UNSURE 25: Xaa = Arg,Trp
MFSPECQHAYLCIESQCKNFSDYCXPIFYEAPKRSFIQWIKNQNKVRLLK

SEQ ID NO: 4690 - protein, 54 aa, Homo sapiens [sequence omitted]

SEQ ID NO: 4691 - protein, 51 aa, Homo sapiens
  UNSURE 32: Xaa = Leu,Pro
MAPKFFVSTGISPMAPIATAKPTAPPVLPASXLGPPLPTESHSILRAPSLK

SEQ ID NO: 4692 - protein, 76 aa, Homo sapiens
  UNSURE 66: Xaa = Lys,Asn
MFQRRMETLNLRWEELGVKEAQLKAHIQKSEQFIQENDQKRIRAMKKANKERELKCQHMQELTKRXREMVALRLEH

SEQ ID NO: 4693 - protein, 64 aa, Homo sapiens
MDLGLSEDHFSRPVGLFLASDVQQLRQSIEECKQVILELPEQSEKQKDAVVRLIHLRLKLQELK

SEQ ID NO: 4694 - protein, 54 aa, Homo sapiens
MEQANYTIQSLKDTKTTVDAMKLGVKEMKKAYKQVKIDQIEDFTRPARGYDGRC

SEQ ID NO: 4695 - protein, 79 aa, Homo sapiens
  UNSURE 50: Xaa = Ala,Gly
  UNSURE 39: Xaa = Asp,Glu
  UNSURE 44: Xaa = Cys,Trp
  UNSURE 42: Xaa = Ile,Arg
  UNSURE 62,79: Xaa = Pro,Arg
MASRNSGGDLEDLSIPGTILASPGRTATQMRVLGLVLQXEGXGXPWRDVXLPFYILQIALGXRSCAPTPLSPACSSVFX

SEQ ID NO: 4696 - protein, 97 aa, Homo sapiens
MQVMNLNVPMRPGILVQRQSKEVLATPLENRRDMEAEEENQINEKQEPENAGETGQEEDDGLQKIHTSVTRTPSVVESQKRPLKGVTFSREVIVVDL

SEQ ID NO: 4697 - protein, 51 aa, Homo sapiens
MVPAFASSEDLRLLLLMVESKRDQMSDSSFRFFVFFFVYICQFAVHVLQAA

SEQ ID NO: 4698 - protein, 74 aa, Homo sapiens
  UNSURE 43: Xaa = Gly,Arg,Trp
  UNSURE 57: Xaa = Ile,Lys,Arg,Thr
  UNSURE 15: Xaa = Leu,Met,Arg,Trp
MCGSQFWKTEVRGRXPSSFGVWCGTAFQLMQETEAQRGGASLXPAWVYSVPSESSGXIESTFRLKLQPEAAMGT

SEQ ID NO: 4699 - protein, 124 aa, Homo sapiens
MKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELT

SEQ ID NO: 4700 - protein, 152 aa, Homo sapiens
MTKYTEKLEEIKKNYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLLLDVRDRDSYQQC

SEQ ID NO: 4701 - protein, 94 aa, Homo sapiens
MSDLEDDETPQLSAHALAALQEFYAEQKQQIEPGEDDKYNIGIIEENWQLSQFWYSQETALQLAQEAIAAVGEGGRIACVSAPSVYQKLRELSR

SEQ ID NO: 4702 - protein, 136 aa, Homo sapiens
MASRGGGRGRGRGQLTFNVEAVGIGKGDALPPPTLQPSPLFPPLEFRPVPLPSGEEGEYVLALKQELRGAMRQLPYFIRPAVPKRDVERYSDKYQMSGPIDNAIDWNPDWRRLPRELKIRVRKLQKERITILLPKR

SEQ ID NO: 4703 - protein, 152 aa, Homo sapiens
  UNSURE 28: Xaa = Asp,Glu
  UNSURE 87: Xaa = Glu,Lys
MAKSGLRQDPQSTAAATVLKRAVELDSXSRYPQALVCYQEGIDLLLQVLKGTKDNTKRCNLREKISKYMDRAENIKKYLDQEKEDGXYHKQIKIEENATGFSYESLFREYLNETVTEVWIEDPYIRHTHQGIEQVQQSRGLQEIEESLRSHG

SEQ ID NO: 4704 - protein, 80 aa, Homo sapiens
  UNSURE 30: Xaa = Ala,Gly
  UNSURE 17: Xaa = Asp,Glu
  UNSURE 18: Xaa = Gly,Arg
MDRAENIKKYLDQEKEXXEYHKQIKIEENXTGFSYESLFREYLNETVTEVWIEDPYIRHTHQLYNFLRFCEMLIKRPCKV

SEQ ID NO: 4705 - protein, 136 aa, Homo sapiens
MIFKGPRWASWNIGVFICIRCAGIHRNLGVHISRVKSVNLDQWTQEQIQCMQEMGNGKANRLYEAYLPETFRRPQIDPAVEGFIRDKYEKKKYMDRSLDINAFRKEKDDKWKRGSEPVPEKKLEPVVFEKVKMPQK

SEQ ID NO: 4706 - protein, 63 aa, Homo sapiens
MNVFLPDITHLRTGLYKSQRPCVTHIKTEPVAIFSHQSETLPLLRPRPRPSLSSPVYSAHTRR

SEQ ID NO: 4707 - protein, 145 aa, Homo sapiens
  UNSURE 133: Xaa = Cys,Ser
MHPQSLAEEEIKTEQEVVEGMDISTRSKDPGSAERTAQKRKFPSPPHSIQWPLAADTSTSPIKKKKKPGLLNSNNKEQDGRNDFYCWVCHREGQVLCCELCPRVYHAKCLRLTSEPEGDWFCPECEKITVAEXIETQSKAMTMLT

SEQ ID NO: 4708 - protein, 148 aa, Homo sapiens
MAFLASGPYLTHQQKVLRLYKRALRHLESWCVQRDKYRYFACLMRARFEEHKNEKDMAKATQLLKEAEEEFWYRQHPQPYIFPDSPGGTSYERYDCYKVPEWCLDDWHPSEKAMYPDYFAKREQWKKLRRESWEREVKQLQEETPPGG

SEQ ID NO: 4709 - protein, 87 aa, Homo sapiens
MSRDAFLEKAYTKLKLQVTPEGRIPLKNIYRLFSADRKRVETALEACSLPSSRNDSIPQEDFTPEVYRVFLNNLCPRPEIDNIFSEF

SEQ ID NO: 4710 - protein, 67 aa, Homo sapiens
MDEVTFRSDTVLSDVHLYTPNHRHLMVRLNSVGQPVFLSQFKLLWSQDSSTDSGAKGGSHRDVHTKE

SEQ ID NO: 4711 - protein, 125 aa, Homo sapiens
  UNSURE 5: Xaa = Asp,Glu
MSSDXEKYSLPVVQNDSSRGSSVSSNLQEEYEELLHYAIVTPNIEPCASQSSHPKGELVPDVRISTIHDILHSQGNNSEVRETAIEVGKGCDFHISSHSKTDESSPVLSPREPSHPVMDFFSSHL

SEQ ID NO: 4712 - protein, 50 aa, Homo sapiens
MVFGSQLDIHSGGIDLAFPHHENEIAQCEVFHQCEQWGNYFLHSGHLHAK

SEQ ID NO: 4713 - protein, 101 aa, Homo sapiens [sequence omitted]

SEQ ID NO: 4714 - protein, 124 aa, Homo sapiens
  UNSURE 31: Xaa =  * ,Ile,Leu,Met,Arg,Trp
MLQRPVRTLLSWLVEVTTMAQNSTELSKTSXFQGGDPTGTGRGGASIYGKQFEDELHPDLKFTGAGILAMANAGPDTNGSQFFVTLAPTQWLDGKHTIFGRVCQGIGMVNRVGNGRKQTPRTAL

SEQ ID NO: 4715 - protein, 103 aa, Homo sapiens
MYTSLKSTFVAFADGRGTTESMPSPPLANSNHESPVNQLGNMQNMRLGPSFILTGIFLGNGRTEASPFFTDEFALSKIFPEYKRNLFGKFQTNILCKVSYTSE

SEQ ID NO: 4716 - protein, 111 aa, Homo sapiens
MEPLYQAGSILMTVNTLQGKKMIESGLQSGDFSLSQSWPSCLPPPADLEILQQKVAGVQRELEDFKKEALKSIHYLEDAFCEMNGALVQQEEQAARVRQRLREEEDRGIVR

SEQ ID NO: 4717 - protein, 80 aa, Homo sapiens
  UNSURE 18: Xaa = Cys,Gly
MSLQMVTVSNNIALIQPXFSLMNFDGQVFFFGQKGWPKRSCPTGVFHLDVKHNHVKLKPTIFSKDSATSLLFATQPLAHS

SEQ ID NO: 4718 - protein, 113 aa, Homo sapiens
  UNSURE 102: Xaa =  * ,Glu,Lys,Gln
MAESGKEKIKWTTTIIISSSLKSYEVATALENRSHKVRYSDSVENGSIIFSLSGVAFLLMDTKECLLSTEEIFLAKIEKFINIHQNSFLGLSAALHGPEEWXLMVQDSAEIPG

SEQ ID NO: 4719 - protein, 84 aa, Homo sapiens
MLSCNICGETVTSEPDMKAHLIVHMESEIICPFCKLSGVNYDEMCFHIETAHFEQNTLERNFERINTVQYGTSDNKKDNTLQCG

SEQ ID NO: 4720 - protein, 78 aa, Homo sapiens
MVKGEKGPKGKKITLKVARNCIKITFDGKKHLDLSKMGITTFPKCILRLSDMDELDLSRNLIRKIPDSISKFQNLRLH

SEQ ID NO: 4721 - protein, 62 aa, Homo sapiens
MSLRLEAFQGWPRRPQGPGVACKGREQLFSRKDPKGSKAKGAICFPTDSEDKQEKCPVSPIL

SEQ ID NO: 4722 - protein, 158 aa, Homo sapiens
  UNSURE 20: Xaa = Ser,Thr
MASSAAGCVVIVGSGVIGRXGAMLFASGGFQVKLYDIEQQQIRNALENIRKEMKLLEQAGSLKGSLSVEEQLSLISGCPNIQEAVEGAMHIQVNPPYYIPLVELVPHPETAPTTVDRTHALMKKIGQCPMRVQKEVAGFVLNRLQYAIISEAWRLVEE

SEQ ID NO: 4723 - protein, 129 aa, Homo sapiens
  UNSURE 41: Xaa =  * ,Glu,Gly,Lys,Leu,Met,Gln,Arg,Val,Trp
  UNSURE 21: Xaa = Glu,Lys
  UNSURE 24: Xaa = Gly,Ser
  UNSURE 23: Xaa = Leu,Arg
MAAPGLRLGAGRLFEMPAVLXRXXRYNSTSQAFAEVLRLPXQQLRKLLYPLQEVERFLAPYGRQDLHLRIFDPSPEDIARADNIFTATERNRIDYVSSAVRIDHAPDLPRPEGHTKKMNFFKVGKHFTV

SEQ ID NO: 4724 - protein, 104 aa, Homo sapiens
MVRILANGEIVQDDDPRVRTTTQPPRGSIPRQSFFNRGHGAPPGGPGPRQQQAGARLGAAQSPFNDLNRQLVNMGFPQWHLGNHAVEPVTSILLLFLLMMLGVR

SEQ ID NO: 4725 - protein, 134 aa, Homo sapiens
  UNSURE 52: Xaa =  * ,Tyr
  UNSURE 49,51: Xaa = Ala,Gly
  UNSURE 44: Xaa = Cys,Trp
  UNSURE 47: Xaa = Gly,Arg
  UNSURE 53: Xaa = Lys,Arg
  UNSURE 45: Xaa = Phe,Leu
MEYVLEVKNSPRHLLKQFTVCDVPLYDICDYNVSRDRCQELGCXXLXKXFXXXKAVPIYIHVFSALIVIKAGAFVITIIYRVIQESRKEKAIPVDVALPQKSSEKAELASSSSKLGLKLRVLGLKVLGLDESDE

SEQ ID NO: 4726 - protein, 50 aa, Homo sapiens
  UNSURE 45: Xaa = Asn,Thr
  UNSURE 50: Xaa = Lys,Asn
MTVTDGQEKEDSGSLHLPREQEMPPSMAQVYLLLECFFLNGKKKXKKKKX

SEQ ID NO: 4727 - protein, 69 aa, Homo sapiens
MAAQSAPKVVLKSTTKMSLNERFTNMLKNKQPTPVNIRASMQQQQQLASARNRRLAQQMENRPSVQGQH

SEQ ID NO: 4728 - protein, 68 aa, Homo sapiens
MAAQSAPKVVLKSTTKMSLNERFTNMLKNKQPTPVNIRASMQQQQQLASARNRRLAQQMENRPSVQAA

SEQ ID NO: 4729 - protein, 89 aa, Homo sapiens
  UNSURE 87: Xaa = His,Gln
  UNSURE 73: Xaa = Lys,Asn
MPHASMNVPYIPAEKNIDLCKEMVDGLRITFDYTLPLVLLYPYEQAQYKKVTASKVFLAIKESATNTNRSHEXLSPSLRLLNPSMPXST

SEQ ID NO: 4730 - protein, 79 aa, Homo sapiens
MVFLQQKLSCAGRPRLSKRCTFHRTFGKAFHQLLQKMDSVTVKTNGRAQWLTPVIPALWEAEEGGSRGQEVEIILAIST

SEQ ID NO: 4731 - protein, 54 aa, Homo sapiens
MKCPRPDPSPSSMMPARDWSRLGSFYSQDAEYMDVVEQQTENLELHTNALQILL

SEQ ID NO: 4732 - protein, 65 aa, Homo sapiens
MNSRRREPITLQDPEAKYPLPLIEKEKISHNTRRFRFGLPSPDHVLGLPVGNYVQLLAKIDNELV

SEQ ID NO: 4733 - protein, 52 aa, Homo sapiens
MKVGYERDFLRYLQSLLAEVERRIRRGHARLALSQNQQSSGAAGQQAKKKKK

SEQ ID NO: 4734 - protein, 119 aa, Homo sapiens
  UNSURE 25: Xaa = Arg,Thr
MISAAQLLDELMGRDRNLAPDEKRXTCGGTTRAFVNIISVVFVLRNCSQIHVLILVRVKKIHDENLRKQYEKSSRFMKVGYERDFLRYLQSLLAEVERRIRRGHARLALSQNQQSSGGR

SEQ ID NO: 4735 - protein, 53 aa, Homo sapiens; identical to SEQ ID NO: 4571

SEQ ID NO: 4736 - protein, 79 aa, Homo sapiens
  UNSURE 12: Xaa =  * ,Ile,Lys,Leu,Met,Pro,Gln,Ser,Thr
MMSNSSSEIDVXPNIVSDASCNTEEQLKTVDDVLIHCQVIYDALQNLDKKIDVIRRKVSKIQRFHARSLWTNHKRYGYK

SEQ ID NO: 4737 - protein, 63 aa, Homo sapiens
  UNSURE 8: Xaa = His,Gln
  UNSURE 52: Xaa = Ile,Lys,Met,Thr
  UNSURE 10: Xaa = Phe,Val
MINLAAAXSXGSVPPLRAVTLTAKVCNFTPGASKTTNAPRGMNNSGHTIFKXRNTHRKVCNFI

SEQ ID NO: 4738 - protein, 54 aa, Homo sapiens
  UNSURE 20: Xaa = Lys,Asn
  UNSURE 13: Xaa = Phe,Ser
MHRMASHVSPAKXIMTVVLXVRNLTLEKNSWLINYAHHQTLTKLLSEVLDILAL

SEQ ID NO: 4739 - protein, 84 aa, Homo sapiens
MTEHNPTFTRLVEESKLIPLIFEVTLEHQESILGNTMQSVIALLSNLVACKDSNMELLYEQGLVSHICNLLTETATLCLDVDNK

SEQ ID NO: 4740 - protein, 127 aa, Homo sapiens
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDN

SEQ ID NO: 4741 - protein, 106 aa, Homo sapiens
  UNSURE 50: Xaa = Arg,Thr
MKGFKGQLSRQVADQMWQAGKRQASRAFSLYANIDILRPYFDVEPAQVRXGLLESMIPIKMVNFPQKIAGELYGPLMLVFTLVAILLHGMKTSDTIIREGTLMGTK

SEQ ID NO: 4742 - protein, 90 aa, Homo sapiens
  UNSURE 82: Xaa = Ile,Lys
MSAGVSSVSSKRKGTWRGNKSLDCKIEESAETPALEDSSSSPVDSQQHSWQVSTDIENTERDMREMKNLLSKLRETMPLPLXNQDDSSLL

SEQ ID NO: 4743 - protein, 151 aa, Homo sapiens
MEQVAEGARVTAVPVSAADSTEELAEVEEGVGVVGEDNDAAARGAEAFGDSEEDGEDVFEVEKILDMKTEGGKVLYKVHWKGYTSDDDTWEPEIHLEDCKEVLLEFRKKIAENKAKAVRKDIQRLSLNNDIFEANSDSDQQSETKEDTSPK

SEQ ID NO: 4744 - protein, 59 aa, Homo sapiens
  UNSURE 31: Xaa =  * ,Ala,Cys,Asp,Glu,Phe,Gly,Leu,Ser,Val,Trp,Tyr
  UNSURE 28: Xaa = Asp,Glu
  UNSURE 32: Xaa = Asp,His,Asn,Tyr
MILFNHKKELSGRAQWLMPVIPATWEAXAEXXLNLGGGGCSELRLRHSTPAWATETRCQ

SEQ ID NO: 4745 - protein, 84 aa, Homo sapiens
MASRINTNFTLIPNQKLRRSNRQTSCYSKTLGSGFQPISTFGNFKALPLEIFQIILKYLSVKDISMLSMVSKTVSQHIINYIST

SEQ ID NO: 4746 - protein, 79 aa, Homo sapiens
  UNSURE 6: Xaa = Ile,Arg
MRDAGXPSMAKIKSHSQCVFISRNFHTGRFQLQEEQRKKEAAHIKAIKDHSKDEPQLATKNIICDPSETSSTTNRSSVT

SEQ ID NO: 4747 - protein, 75 aa, Homo sapiens
MRLPLVSRSTVSKSIKDNIRLSELLSNPNMLTNELKAEFLILLHMLQRKLGRKLNPEWFDVNQQWEKLLSITFLP

SEQ ID NO: 4748 - protein, 112 aa, Homo sapiens
  UNSURE 61: Xaa = Cys,Gly
MTSPEIASLSWGQMKVKGSNTTYKDCKVWPGGSRTWDWRETGTEHSPGVQPADVKEVVEKXVQTLVIGRGMSEALKVPSSTVEYLKKHGIDVRVLQTEQAVKEYNALVAQGV

SEQ ID NO: 4749 - protein, 110 aa, Homo sapiens
MTSPEIASLSWGQMKVKGSNTTYKDCKVWPGGSRTWDWRETGTEHSPGVQPADVKEVVEKGVQTLVIGRGMSEALKVPSSTVEYLKKHGIDVRVLQTEQAVKEYNALVAQ

SEQ ID NO: 4750 - protein, 121 aa, Homo sapiens
  UNSURE 102: Xaa =  * ,Cys,Arg,Ser,Thr
  UNSURE 103: Xaa = Ala,Pro,Thr
MMDPCSVGVQLRTTNECHKTYYTRHTGFKTLQELSSNNMLLLQLRTGMTLSGNNTICFHHVKIYIDRFEDLQKSCCDPFNIHKKLAKKNLHVIDLDDATFLXXKFGRQLVPGWKLCPKCTQ

SEQ ID NO: 4751 - protein, 107 aa, Homo sapiens
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQ

SEQ ID NO: 4752 - protein, 71 aa, Homo sapiens
MAKIKSHSQCVFISRNFHTGRFQLQEEQRKKEAAHIKAIKDHSKDEPQLATKNIICDPSETSSTTNRAVLH

SEQ ID NO: 4753 - protein, 118 aa, Homo sapiens
  UNSURE 71: Xaa = Ala,Pro,Ser,Thr
  UNSURE 40: Xaa = Ala,Ser
  UNSURE 65: Xaa = Arg,Thr
  UNSURE 51: Xaa = Asp,Glu
  UNSURE 58: Xaa = Phe,Leu
  UNSURE 103: Xaa = Ser,Tyr
MIGSFLRPHQKQMLPCFLYSLQNQKVCLPLHRKQEGKRWXCWKPGKEKLTXLQGANPXHLHPGLXSCHTKXLCCSEDQRGWSGVKWCDLGLLQPLPPRFKRFXCLSLLSSWDHRRLPS

SEQ ID NO: 4754 - protein, 136 aa, Homo sapiens
MPKRKAAGQGDMRQEPKRRSARLSAMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKEDEED

SEQ ID NO: 4755 - protein, 92 aa, Homo sapiens
  UNSURE 81,82: Xaa = Asn,Thr
MVPAGKFKMQEEMLECSSAVTAECSLHLPGLKQSCHLSLPSSWNYRPEPPHPANFLFFVKMGSHCVALADLKLLNPSNPFXXLASQSVRIRG

SEQ ID NO: 4756 - protein, 100 aa, Homo sapiens
  UNSURE 23: Xaa =  * ,Cys,Trp
  UNSURE 19,22: Xaa = Ala,Gly
  UNSURE 20: Xaa = Ala,Val
MAFNFGAPSGTSGTAAATXXPXXVWRIWDNIYNCRFCVHFSAPTNTGTTGLFGGTQNKGFGFGTGFGTTTGTSTGLGTGLGTGLGFGGFNTQQQQQQTTL

SEQ ID NO: 4757 - protein, 101 aa, Homo sapiens
  UNSURE 29: Xaa =  * ,Gln
  UNSURE 99: Xaa = Ala,Pro,Ser,Thr
  UNSURE 64: Xaa = Arg,Thr
  UNSURE 52: Xaa = Cys,Arg
  UNSURE 63: Xaa = Gly,Arg
  UNSURE 45: Xaa = His,Pro
MMAGWQEEPHTQAECQVLQPPLSHSYPKXQNISRMRKVPIVNHLXHIHVAIXPSTCISGTNVXXFILSMHGTFTKINLTYFVPANLNIFESNQITQHVXDH

SEQ ID NO: 4758 - protein, 82 aa, Homo sapiens
MADSSGRGAGKPATGPTNSSSAKKKDKRVQGGRVIESRYLQYEKKTTQKQIAVGSERVTCSPRCWKGMAQLHLTWISLLLMT

SEQ ID NO: 4759 - protein, 127 aa, Homo sapiens
  UNSURE 125: Xaa = Asp,Glu
  UNSURE 51: Xaa = Leu,Arg
MESQEPTESSQNGKQYIISEELISEGKWVKLEKTTYMDPTGKTRTWESVKXTTRKEQTADGVAVIPVLQRTLHYECIVLVKQFRPPMGGYCIEFPAGLIDDGETQKQLLSGSLKKKLATKGTLPXMF

SEQ ID NO: 4760 - protein, 118 aa, Homo sapiens
MLKAVILVGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLMLMSA

SEQ ID NO: 4761 - protein, 97 aa, Homo sapiens
  UNSURE 59: Xaa =  * ,Tyr
MLKAVILIGGPQKGTRFRPLSFEVPKPLFPVAGVPMIQHHIEACAQVPGMQEILLIGFXRPDEPLTQFLEAAQQEFNLPVRYLQEFAPLGTGGGLYH

SEQ ID NO: 4762 - protein, 143 aa, Homo sapiens
MAAKNPDSLVGEGPFHARINTAQPAANNWHKPGNEQGNDAVPEYHAETFPPGTAPAENTFHPNPDSNYTTEALNMPALDMPGSTSKDVHNSIDNLHGKPLIGQENREIRGVHPGKRKKERSVLEGVGASTTYSVFDKVRDTVA

SEQ ID NO: 4763 - protein, 111 aa, Homo sapiens
  UNSURE 92: Xaa = Glu,Gln
MVYLARKEGSSFAYISWKFECGSVGLKVDSISIRTSSQTFQTGTVEWKLRSDTAQVELTGDNSLHSYADFSGATEVILEAELSRGDGDVAWXHTQLFRQSLNDHEENCLEI

SEQ ID NO: 4764 - protein, 166 aa, Homo sapiens
  UNSURE 165: Xaa =  * ,Ser
MQPKDFNFKTPENDKRFQKKFEKMAKELQRQKTNLDDDVPILLFESNGSLIYTPTIEINSSHHSAMEKRLQEMKEKRENLSPTSSQMIQQSHDNPSNSLCEAPLNISRDTLCDEYFAGGLHSSFDDLCGNSGCGNQERKLEGSINDIKSDVCISSLVLKQYIHSXH

SEQ ID NO: 4765 - protein, 52 aa, Homo sapiens; identical to SEQ ID NO: 4619

SEQ ID NO: 4766 - protein, 154 aa, Homo sapiens
MGDREECLSTPQPPMSVVKSIELVLPEDRIYLAGSSIKGQVILTLNSTLVDPIVKVELVGRGYVEWSEEAGASCDYSRNVICNNKADYVHKTKTFPVEDNWLSAGSHTFDFHFNLPPRLPSTFTSKFGHVFYFVQASCMDGTHFSQEEDVLIGS

SEQ ID NO: 4767 - protein, 64 aa, Homo sapiens
MPTQLEMAMDTMIRIFHRYSGKERKRFKLSKGELKLLLQRELTEFLSCQKETQLVDKIVQDLDA

SEQ ID NO: 4768 - protein, 76 aa, Homo sapiens
MKVENFKTSEIQELFDIFTYSKEASMARMLSCFLNEHLFVSALKSYLKTFSYSSAEQDDLWRHFQMAIDDQSTVIL

SEQ ID NO: 4769 - protein, 187 aa, Homo sapiens
MAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWSATSRADL

SEQ ID NO: 4770 - protein, 152 aa, Homo sapiens
MAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWASLFRFLLLNRMCWLGMVAHACNPSTLGGRGGWI

SEQ ID NO: 4771 - protein, 61 aa, Homo sapiens
MAATLGADVVVTDLEELQDLLKMNINMNKHLVTGSVQAKVLKWGEEIEGFPSPPDFILMAD

SEQ ID NO: 4772 - protein, 55 aa, Homo sapiens
  UNSURE 7: Xaa = Leu,Pro,Gln
MNLIRTXEKKLKAVLQPQKRHQWIKSQRCMKRPRESPPVLIMRKREKTMTSRVWA

SEQ ID NO: 4773 - protein, 85 aa, Homo sapiens
  UNSURE 81: Xaa = His,Gln
MYGGRGKGLWPPRRHVFGAGGFPSAGSILKRRDTGNLGEGQPRSSWLLHRGAHTFSFDFRSADAVYPPPLPAAANKGRSYXKKKK

SEQ ID NO: 4774 - protein, 108 aa, Homo sapiens
  UNSURE 108: Xaa = Ile,Asn
MAPKQDPKPKFQEGERVLCFHGPLLYEAKCVKVAIKDKQVKYFIHYSGWNKKSAVRPRRSEKSLKTHEDIVALFPVPEGAPSVHHPLLTSSWDEWVPESRVLKYVDTX

SEQ ID NO: 4775 - protein, 63 aa, Homo sapiens
MYSSPLCLTQDEFHPFIEALLPHVRAFAYTWFNLQARNKVLQEAREADVEGRGACGQGRAAGE

SEQ ID NO: 4776 - protein, 69 aa, Homo sapiens [sequence omitted]

SEQ ID NO: 4777 - protein, 66 aa, Homo sapiens
  UNSURE 59: Xaa = Lys,Asn
  UNSURE 5: Xaa = Phe,Leu
MASIXSKLLTGRNASLLFATMGTSVLTTGYLLNRQKVCAEVREQPRLFPPSADYPDLRXTTTAWPS

SEQ ID NO: 4778 - protein, 139 aa, Homo sapiens
MVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIEREAE

SEQ ID NO: 4779 - protein, 157 aa, Homo sapiens
MVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVC

SEQ ID NO: 4780 - protein, 59 aa, Homo sapiens
  UNSURE 18: Xaa = Gly,Arg
  UNSURE 3,7: Xaa = His,Asn
  UNSURE 11: Xaa = Ile,Lys,Arg,Thr
MNXSGTXHPLXTVILTAXSATSFLKSVRPRTHQFRTHFGDFEETVTYHQVVRLLPSSET

SEQ ID NO: 4781 - protein, 149 aa, Homo sapiens
MATSIGVSFSVGDGVPEAEKNAGEPENTYILRPVFQQRFRPSVVKDCIHAVLKEELANAEYSPEEMPQLTKHLSENIKDKLKEMGFDRYKMVVQVVIGEQRGEGVFMASRCFWDADTDNYTHDVFMNDSLFCVVAAFGLFLLLNESLKK

SEQ ID NO: 4782 - protein, 132 aa, Homo sapiens
MATSIGVSFSVGDGVPEAEKNAGEPENTYILRPVFQQRFRPSVVKDCIHAVLKEELANAEYSPEEMPQLTKHLSENIKDKLKEMGFDRYKMVVQVVIGEQRGEGVFMASRCFWDADTDNYTHDVFMNDSLFC

SEQ ID NO: 4783 - protein, 148 aa, Homo sapiens
MDRYLLLVIWGEGKFPSAASMEAEHGPEVSSGEGTENQPDFTAANVYHLLKRSISASINPEDSTFPACSVGGIPGSKKWFFAVQAIYGFYQFCSSDWQEIHFDTEKDKIEDVLQTNIEECLGAVECFEEEDSNSRESLSLAEVLLCHP

SEQ ID NO: 4784 - protein, 61 aa, Homo sapiens
MRVFLFNSTTKSLIVTTSASTLVRRKDFSELQQSDFFLKIKLIFSIDSLQSNPINTHCNHF

SEQ ID NO: 4785 - protein, 58 aa, Homo sapiens
MSEQLAKELQLEEEAAVFPEVAVAEGPFITGENIDTSSDLMLAQMLQMEYDREYDAQL

SEQ ID NO: 4786 - protein, 131 aa, Homo sapiens
  UNSURE 97: Xaa = Ala,Glu
MVRLTLDLIARNSNLKPRKEETISQCLKKITHINFSDKNIDAIEDLSLCKNLSVLYLYDNCISQITNLNYATNLTHLYLQNNCISCIENLRSLKKLXKLYLGGNYIAVIEGLEGLGELRELHVENQRLPLG

SEQ ID NO: 4787 - protein, 82 aa, Homo sapiens
MGLLGPPPGQGVWQMQSFMSRWGWSWDASSSPVPSGPCCLQADIQPLGLLPCRNTRFEKSKKKKKKKKKKKKKKKKKKKKKK

SEQ ID NO: 4788 - protein, 70 aa, Homo sapiens
  UNSURE 56: Xaa =  * ,Tyr
  UNSURE 40: Xaa = His,Gln
  UNSURE 15: Xaa = Ile,Asn,Ser,Thr
  UNSURE 34: Xaa = Ile,Thr
MGFCHVGQAVLELLXSGDPTVSASQGAGITGVTXVPSLSXHAGLIFKFFVETGSHXVAQGWCQAPRSQVI

SEQ ID NO: 4789 - protein, 127 aa, Homo sapiens
MAGNLLSGAGRRLWDWVPLACRSFSLGVPRLIGIRLTLPPPKVVDRWNEKRAMFGVYDNIGILGNFEKHPKELIRGPIWLRGWKGNELQRCIRKRKMVGSRMFADDLHNLNKRIRYLYKHFNRHGKF

SEQ ID NO: 4790 - protein, 88 aa, Homo sapiens
MLIYSSKTLELRETSVTPSNLWGGQGLLGVSIRFCSFDGANENVWHVLEVESNSPAALAGLRPHSDYIIGADTVMNESEDLFILIETH

SEQ ID NO: 4791 - protein, 115 aa, Homo sapiens
  UNSURE 104: Xaa = Phe,Ile,Leu,Val
MVGREKELSIHFVPGSCRLVEEEVNIPNRRVLVTGATGLLGRAVHKEFQQNNWHAVGCGFRRARPKFEQVNLLDSNAVHHIIHDFQPHVIVHCAAERRPDVVEXSQMLPLNLMWM

SEQ ID NO: 4792 - protein, 158 aa, Homo sapiens
MMTNGVVHANVFGIKDWVTPYKIAVLVLLNEMSRTGEGAVSLMERRRLNQLLLPLLQGPDITLSKLYKLIEESCPQLANSVQIRIKLMAEGELKDMEQFFDDLSDSFSGTEPEVHKTSVVGLFLRHMILAYSKLSFSQVFKLYTALQQYFQNGEKKTV

SEQ ID NO: 4793 - protein, 99 aa, Homo sapiens
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQ

SEQ ID NO: 4794 - protein, 103 aa, Homo sapiens
  UNSURE 42: Xaa = Ala,Pro
  UNSURE 41: Xaa = His,Gln
MAEVEQKKKRTFRKFTYRGVDLDQLLDMSYEQLMQLYSARXXAAEPGPAAEAALPAEAPAQGQEGGAAMEKPEVVKTHLRDMIILPEMVGQHGGRLQRQRPFK

SEQ ID NO: 4795 - protein, 109 aa, Homo sapiens
MAEAQSGTGQLQEQKKGLLIAVSVSVDKIISHFGAARNLVQKPFRKDLITGQRRSSPWSVVEASVKPGSSTRSLGTLYSQVSRLAPLSSSRSRFHAFILGLLNTKQLEL

SEQ ID NO: 4796 - protein, 132 aa, Homo sapiens
MEMESAAASTRFHQPHMERKMSAMACEIFNELRLEGKLCDVVIKVNGFEFSAHKNILCSCSSYFRALFTSGWNNTEKKVYNIPGISPDMMKLIIEYAYTRTVPITPDNVEKLLAAADQFNIMGIVRGCCEFL

SEQ ID NO: 4797 - protein, 109 aa, Homo sapiens
MTKMDIRGAVDAAVPTNIIAAKAAEVRANKVNWQSYLQGQMISAEDCEFIQRFEMKRSPEEKQEMLQTEGSQCAKTFIKSDDSYLQRTDRFQVYTNYGWMICCRKSSAC

SEQ ID NO: 4798 - protein, 118 aa, Homo sapiens
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQENHQRVSIFFDYARCS

SEQ ID NO: 4799 - protein, 98 aa, Homo sapiens
MEKWYLMTVVVLIGLTVRWTVSLNSYSGAGKPPMFGDYEAQRHWQEITFNLPVKQWYFNSSDNNLQYWGLDYPPLTAYHSLLCAYVAKFINPDWIALH

SEQ ID NO: 4800 - protein, 104 aa, Homo sapiens
MEKWYLMTVVVLIGLTVRWTVSLNSYSGAGKPPMFGDYEAQRHWQEITFNLPVKQWYFNSSDNNLQYWGLDYPPLTAYHSLLCAYVAKFINPDWIASSIHHVDM

SEQ ID NO: 4801 - protein, 111 aa, Homo sapiens
MVRLTLDLIARNSNLKPRKEETISQCLKKITHINFSDKNIDAIEDLSLCKNLSVLYLYDNCISQITNLNYATNLTHLYLQNNCISCIENLRSLKKLEKLYLGGNYIAVIEG

SEQ ID NO: 4802 - protein, 147 aa, Homo sapiens
  UNSURE 59: Xaa = Phe,Leu
MAKSSQRKQRDCVNQCKSKPGLSTSIPLRMSSYTFKRPVTRITPHPGNEVRYHQWEESXEKPQQVCWQRRLQGLQAYSSAGELSSTLDLANTLQKLVPSYTGGSLLEDLASGLEHSCPMPHLACSSDAVEIIPAEGVGISQLLCKQF

SEQ ID NO: 4803 - protein, 86 aa, Homo sapiens
MESSPRATGSFTYEAVELVPAGAPTQAAWLAALSDRETRLQEVRSAFLAAYSSTVGLRAVAPVLPVPSGACWSNLPVVLDSGASAA

SEQ ID NO: 4804 - protein, 164 aa, Homo sapiens
MEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELGFMQWQWESLPCLQKWE

SEQ ID NO: 4805 - protein, 131 aa, Homo sapiens
MFLTAVNPQPLSTPSWQIETKYSTKVLTGNWMEERRKFTRDTDKTPQSIYRKEYIPFPDHRPDQISRWYGKRKVEGLPYKHLITHHQEPPHRYLISTYDDHYNRHGYNPGLPPLRTWNGQKLLWLPEKSDF

SEQ ID NO: 4806 - protein, 90 aa, Homo sapiens
  UNSURE 67: Xaa = Asp,Gly
MQQETVPVPVPSEKTKQPKECFLIQPKERKENTTKTRKRRKKKITDVLAKSEPKPGLPEDLQKLMKXYYSSRRLVIELEELNLPDSCFLK

SEQ ID NO: 4807 - protein, 64 aa, Homo sapiens
  UNSURE 59: Xaa =  * ,Gln
  UNSURE 46: Xaa =  * ,Ser
  UNSURE 17: Xaa = Ala,Glu
  UNSURE 30: Xaa = Ala,Gly
  UNSURE 21: Xaa = Ala,Gly,Pro,Arg
  UNSURE 19: Xaa = Arg,Ser
  UNSURE 31: Xaa = Asp,Glu
  UNSURE 39: Xaa = Ile,Thr
  UNSURE 14,45: Xaa = Pro,Arg
MADDLGDEWWENQXTGXGXSXEASDGEGEXXTEVMQQEXVPVPVXXEKTKQPKECFLIXPKERK

SEQ ID NO: 4808 - protein, 101 aa, Homo sapiens
  UNSURE 34: Xaa = Ala,Pro,Ser
  UNSURE 33: Xaa = Leu,Arg
  UNSURE 77: Xaa = Leu,Val
MPGGVARDGKVGDTLKRGNPRGRASLEGRKYRXXQAPPHPGSQSPASSGGFLHKRHPRCAALNIERMLGWAWYRLCXIPALWEAEVGGLLEPRSSRRAWAS

SEQ ID NO: 4809 - protein, 106 aa, Homo sapiens
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLIC

SEQ ID NO: 4810 - protein, 96 aa, Homo sapiens
  UNSURE 93: Xaa = His,Gln
  UNSURE 80: Xaa = Leu,Trp
MGPPLAPRPAHVPGEAGPRRTRESRPGAVSFADVAVYFSPEEWECLRPAQRALYRDVMRETFGHLGALGFSVPKPAFISXVEGEVEAWSPEAXDPD

SEQ ID NO: 4811 - protein, 101 aa, Homo sapiens
MRNDLFNKEKARQLSLTPRTEKIEVKHVGKTDPGTVFVMNKNISTPYSCAMHLSEWYCRKSILALVDGQPWDMYKPLTKSCEIKFLTFKDCDPGEVNKAYL

SEQ ID NO: 4812 - protein, 122 aa, Homo sapiens
MRPSCAPGWFYHKSNCYGYFRKLRNWSDAELECQSYGNGAHLASILSLKEASTIAEYISGYQRSQPIWIGLHDPQKRQQWQWIDGAMYLYRSWSGKSMGGNKHCAEMSSNNNFLTWSSNECN

SEQ ID NO: 4813 - protein, 90 aa, Homo sapiens
MASSVGNVADSTEPTKRMLSFQGLAELAHREYQAGDFEAAERHCMQLWRQEPDNTGVLLLLSSIHFQCRRLDRSAHFSTLAIKQNPLLAE

SEQ ID NO: 4814 - protein, 126 aa, Homo sapiens
MEDHQHVPIDIQTSKLLDWLVDRRHCSLKWQSLVLTIREKINAAIQDMPESEEIAQLLSGSYIHYFHCLRILDLLKGTEASTKNIFGRYSSQRMKDWQEIIALYEKDNTYLVELSSLLVRNVNYEI

SEQ ID NO: 4815 - protein, 119 aa, Homo sapiens
  UNSURE 48: Xaa = Glu,Gly
MVLQDENFVSKEEFQAVEKKLVEEKAAHAKTKVLLAKEEEKLQFALGXLEVLSKQLEKEKLAFEKALSSVKSKVLQESSKKDQLITKCNEIESHIIKQEIYLMGKENEIKGVAASYQQQ

SEQ ID NO: 4816 - protein, 79 aa, Homo sapiens
MASSVGNVADSTEPTKRMLSFQGLAELAHREYQAGDFEAAERHCMQLWRQEPDNTGVLLLLSSIHFQCRRLDRSAHFST

SEQ ID NO: 4817 - protein, 78 aa, Homo sapiens
MTLKSLRTFERTWRCTQSCSSKPGKTHHHLPPPHTANENQQLCFYSDNLRMHVRDVPITKKAIDFRIPEYLQKLLKHP

SEQ ID NO: 4818 - protein, 114 aa, Homo sapiens
  UNSURE 94: Xaa = Glu,Lys
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGXGLIVRGAKNTFSSGSDLNAV

SEQ ID NO: 4819 - protein, 96 aa, Homo sapiens
MVSHTFHMRTEESDASQEGDDLPKSSANTSHPKQDDSPKSSEETIQPKEGDIPKAPEETIQSKKEDLPKSSEKAIQPKRVTSPSPQQNPSSPSWQY

SEQ ID NO: 4820 - protein, 102 aa, Homo sapiens
  UNSURE 62: Xaa = Asn,Thr
  UNSURE 75: Xaa = Asp,His
  UNSURE 77: Xaa = Glu,Gln
MAQTDKPTCIPPELPKMLKEFAKAAIRAHQDLIQWGADYFEALSRGETPPVRERSERVALCXWAELTPELLKILXSXVAGRLIIRAEELAQMWKVVNLPKQI

SEQ ID NO: 4821 - protein, 112 aa, Homo sapiens
MEGISNFKTPSKLSEKKKSVLCSTPTINIPASPFMQKLGFGTGVNVYLMKRSPRGLSHSPWAVKKINPICNDHYRSVYQKRLMDEAKILKSLHHPNIVGYRAFTEANDGSLC

SEQ ID NO: 4822 - protein, 125 aa, Homo sapiens
  UNSURE 54: Xaa = Phe,Val
MKDFVRRRCWARKCKLVTSGPWLEVPPIALRDVSIIPESPGAEGSGHSIALWAXSDKGDVLCRLGVSELNPAGSSWLHVGTDQPFASISIGACYQVWAVARDGSASTGDPCTPRSQPVTAGTTSR

SEQ ID NO: 4823 - protein, 71 aa, Homo sapiens
MSKPHSEAGTAFIQTQQLHAAMADTFLEHMCRLDIDSPPITARNTGIICTIGPASRSVETLKEMIKSGMNV

SEQ ID NO: 4824 - protein, 91 aa, Homo sapiens
MQDAVLSWEHLLELKNNHCEQLTVNIKQMENMVGVLQKELCEAKETQLQLEHEKGQWEQERYSLRWSCLVEGKQAQGLSLILHHNDLKRRR

SEQ ID NO: 4825 - protein, 70 aa, Homo sapiens
MLYSEKAEDATKKLIELINKFSKVAEYRVSIQKSVAFPYTQSEQSKKEIKKAIPFIIATKGIKYLGINLT

SEQ ID NO: 4826 - protein, 61 aa, Homo sapiens
MQYPFRKLLRPSTESCCVAQARVQWCHLGSSQRLPPRFKQLSHFSLLSNKARLCPKKKKKK

SEQ ID NO: 4827 - protein, 56 aa, Homo sapiens
MEFSFPKREEHSTPGLDPLQAASCNLFGASVGKGSASLPTECPHVEHSGAGHPKIS

SEQ ID NO: 4828 - protein, 111 aa, Homo sapiens
  UNSURE 110: Xaa = His,Gln
MASLLQQIEIERSLYSDHELRALDENQRLAKKKADLHDEEDEQDILLAQDLEDMWEQKFLQFKLGARITEADEKNDRTSLNRKLDRNLVLLVREKFGDQDVWILPQAEWXP

SEQ ID NO: 4829 - protein, 88 aa, Homo sapiens
MNSGAMRIHSKGHFQGGIQVKNEKNRPSLKSLKTDNRPEKSKCKPLWGKVFYLDLPSVTISEKLQKDIKDLGGRVEEFQQRYQLSYFK

SEQ ID NO: 4830 - protein, 71 aa, Homo sapiens
  UNSURE 39: Xaa =  * ,Leu,Ser
  UNSURE 40: Xaa = Arg,Trp
MKEKMLRAAREKGQVTHKGKPIRLTADLSAETLQARKEXXPILNVLKEKNFQPRISYPAKLSFISEGEIKA

SEQ ID NO: 4831 - protein, 81 aa, Homo sapiens
MPQAFLLGSIHEPAGALMEPQPCPGSLAESFLEEELRLNAELSQLQFSEPVGIIYNPVEYAWEPHRNYVTRYCQGPKEVLF

SEQ ID NO: 4832 - protein, 113 aa, Homo sapiens
MPQAFLLGSIHEPAGALMEPQPCPGSLAESFLEEELRLNAELSQLQFSEPVGIIYNPVEYAWEPHRNYVTRYPGPQGSTLPGHEPWTFWHGQTGVPFGEVSMVRDWLGIVGLC

SEQ ID NO: 4833 - protein, 86 aa, Homo sapiens
MSLLDGLASSPRAPLQSSKARMKKLPKKSQNEKYRLKYLRLRKAAKATVFENAAICDEIARLEEKFLKAKEERRYLLKKLLQLQAL

SEQ ID NO: 4834 - protein, 66 aa, Homo sapiens
  UNSURE 41: Xaa = Leu,Pro
MSRSSRSPRCPPQPARSPDPESRRHSVADPPPPGGRRQRGXLPGSEALGSGRNKANRACSGPSEGR

SEQ ID NO: 4835 - protein, 50 aa, Homo sapiens
  UNSURE 47: Xaa = Phe,Ser
MVRPRRAPYRSGAGGPLGGRGRPPRPLVVRAVRSRSWPASPPRPAAXADP

SEQ ID NO: 4836 - protein, 126 aa, Homo sapiens
MNDLHYLNLDTWEWNELIPQGICPVGRSWHSLTPVSSDHLFLFGGFTTDKQPLSDVWTYCISKNEWIQFNHPYTEKPRLWHTACASDEGEVIVFGGCANNLLVHHRAAHSNEILIFSVQPKISCTA

SEQ ID NO: 4837 - protein, 78 aa, Homo sapiens
MVSGDGFLVSRPEAIHLGPRQAVRPSVRAESRRVDGGGRSPREPDGRGRSRQARFSPYPIPAVEPDLLRSVLQQRLIA

SEQ ID NO: 4838 - protein, 72 aa, Homo sapiens
MATVVLGGDTMGPERIFPNQTEELGHQGPSEGTGDWSSEEPEEEQEETGSGPAGYSYQPLNQDPEQEEVELA

SEQ ID NO: 4839 - protein, 131 aa, Homo sapiens
  UNSURE 34: Xaa = Ala,Glu,Gly,Val
MATVVLGGDTMGPERIFPNQTEELGHQGPSEGTXDWSSEEPEEEQEETGSGPAGYSYQPLNQDPEEEVELAPVGDGDVVADIQDRIQALGLHLPDPPLESEDEDEEGATALNNHSSIPMDPEHVELVKRTS

SEQ ID NO: 4840 - protein, 76 aa, Homo sapiens
MYLDNSSIEEASGVYPIDDDDYASASGSGTDEDVESPELTTSRPLPKILLTSAAPKVETTTLNIQNKIPAQTKSPE

SEQ ID NO: 4841 - protein, 51 aa, Homo sapiens
  UNSURE 37: Xaa = Asp,Glu
  UNSURE 10: Xaa = Ser,Thr
MTGVNAIHIXDAICMFTDIDDVMSECIHRSECIQLFXEGKAVFLDFGSIDI

SEQ ID NO: 4842 - protein, 90 aa, Homo sapiens
  UNSURE 81: Xaa = Ala,Asp,Glu,Gly,Ile,Lys,Asn,Arg,Ser,Thr,Val
  UNSURE 76: Xaa = Ala,Gly
  UNSURE 83: Xaa = Ala,Pro,Thr
MMSGEPLHVKTPIRDSMALSKMAGTSVYLKMDSAQPSGSFKIRGIGHFCKRWAKQGCAHFVCSSAGNAGMAAAYAXRQLGXPXPSWCPAQ

SEQ ID NO: 4843 - protein, 94 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLD

SEQ ID NO: 4844 - protein, 156 aa, Homo sapiens
MLALISRLLDWFRSLFWKEEMELTLVGLQYSGKTTFVNVIASGQFSEDMIPTVGFNMRKVTKGNVTIKIWDIGGQPRFRSMWERYCRGVNAIVYMIDAADREKIEASRNELHNLLDKPQLQGIPVLVLGNKRDLPNALDEKQLIEKMNLSAIQDRE

SEQ ID NO: 4845 - protein, 85 aa, Homo sapiens
MPYITLKVQYGYQGLFATGWGQIWAICIFYLQERMAFSVLNFLPCFGTGERHHFSRPLGYPGNSLELMELFAMRFCTLHRWNCHH

SEQ ID NO: 4846 - protein, 66 aa, Homo sapiens
  UNSURE 14: Xaa =  * ,Cys,Asp,Glu,Phe,Gly,His,Ile,Lys,Leu,Met,Asn,Gln,Arg,Ser,Val,Trp,Tyr
  UNSURE 15: Xaa = Gly,Leu,Met,Arg,Val,Trp
  UNSURE 12: Xaa = Lys,Met,Arg,Thr
MSEHQKEQTPDXPXXRTVTLTARVRGFILEVSKTKSSPILDTAPLFTTAKKWKQFKCPSTDEWINC

SEQ ID NO: 4847 - protein, 132 aa, Homo sapiens
MMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEA

SEQ ID NO: 4848 - protein, 102 aa, Homo sapiens
MERSPSRRRRLEEAPKLPYKNPTHLAQQQEPWSRLNSTPTITSMRRDAYYFDPEIPKDDLDFRLAALYNHHTGTFKNKSEILLNQKTTQDTYRTKIQFPGEF

SEQ ID NO: 4849 - protein, 101 aa, Homo sapiens
MEEAELVKGRLQAITDKRKIQEEISQKRLKIEEDKLKHQHLKKKALREKWLLDGISSGKEQEEMKKQNQQDQHQIQVLEQSILRLEKEIQDLEKAELQIST

SEQ ID NO: 4850 - protein, 103 aa, Homo sapiens
MVSSGKKYSRKSGKPSVEDQFTRAYDFETEDKKDLSGSEEDVIEGKTAVIEKRRKKRSSAGVVEDMGGEVQNMLEGVGVDINKALLAKRKRLEMYTKASLKTS

SEQ ID NO: 4851 - protein, 112 aa, Homo sapiens
MVVSADPLSSERAEMNILEINQELRSQLAESNQQFRDLKEKFLITQATAYSLANQLKKYKCEEYKDIIDSVLRDELQSMEKLAEKLRQAEELRQYKALVHSQAKELTQLREK

SEQ ID NO: 4852 - protein, 152 aa, Homo sapiens
  UNSURE 140: Xaa = Ser,Thr
MDRSAEFRKWKAQCLSKAHLIRKGSVDEDVVELVQFLNMRDQFFTTSSCAGRILLLDRGINGFEVQKQNCCWLLVTHKLCVKDDVIVALKKANGDATLKFEPFVLHVQCRQLQDAQILHSMAIDSGFRNSGITVGREEKXMLAVRSTHGLEV

SEQ ID NO: 4853 - protein, 119 aa, Homo sapiens
MTENKNTLFNTFSLPFSFPSGKATRKNQKWRGPDENIRANLRQYGLEKYYLDVLVSDASKPSWRKGTYFDAIITDPPYGIRESTRRTGSQKEIPKGIEKWEKCPESHVPVSLSYHLSDM

SEQ ID NO: 4854 - protein, 149 aa, Homo sapiens
MAGGPPNTKAEMEMSLAEELNHGRQGENQEHLVIAEMMELGSRSRGASQKKQKLEQKAAGSASAKRVWNMTATRPKKMGSQLPKPRMLRESGHGDAHLQEYAGNFQGIRFHYDRNPGTDAVAQTSLEEFNVLEMEVMRRQLYAVNRRLR

SEQ ID NO: 4855 - protein, 52 aa, Homo sapiens
MELNRDEVNIMATSIPLYRKILICINLYIDKPFFHCSYSLIFWNQPCRTKGT

SEQ ID NO: 4856 - protein, 63 aa, Homo sapiens
MDRLHLRRTTEQHVPEVEVQVKRRRTASLSNQECQLYPRRSQQQQVPVVDFQAELRQAFLAET

SEQ ID NO: 4857 - protein, 55 aa, Homo sapiens
  UNSURE 38: Xaa = Ala,Gly
  UNSURE 54: Xaa = Ala,Pro
MAPSRNGMVLKPHFHKDWQRRVATWFNQPARKIRRRKXRQAKARRIAPRPASGXI

SEQ ID NO: 4858 - protein, 56 aa, Homo sapiens
MFLNGNCLETLKKKEPEGGRRRLSHPGNMGWMRPSQETTPPDRSHHSGFGLFCGDP

SEQ ID NO: 4859 - protein, 73 aa, Homo sapiens
  UNSURE 64: Xaa = Asn,Ser
MPRLHDHFWSCSCAHSARRRGPPRASAAGLAAKVGEMINVSVSGPSLLAAHGAPDADPAPRGRXAAMSGPEPG

SEQ ID NO: 4860 - protein, 94 aa, Homo sapiens
  UNSURE 77,87: Xaa = Ala,Ser,Thr
  UNSURE 83: Xaa = Ala,Thr
  UNSURE 78: Xaa = Asp,Glu
  UNSURE 60: Xaa = Cys,Tyr
  UNSURE 74: Xaa = His,Asn
  UNSURE 49: Xaa = Pro,Thr
MHPSSSASQPSVARRQSPSLGGKSPEPSLPVAPLPRWMNLNPSQAPSWXQGPRTPETLGXGATEAQTGGRRPCXSGXXPVPGXHGNXSSTLPRF

SEQ ID NO: 4861 - protein, 154 aa, Homo sapiens
MSRIPLGKVLLRNVIRHRDAHNKIQEESDMWKIRELEKQMEDAYRGTKRKMLPSSSSRMRSDGFDEESQRYYWRPKNEISGTLEDDFLKAKSWNKKFYDYEANMPDRWGHSGYKELYPEEFETDSSDQQDITNGKKTSPQVKSSTHESRKHKKS

SEQ ID NO: 4862 - protein, 152 aa, Homo sapiens
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSSPQRFLLMRCCSKPV

SEQ ID NO: 4863 - protein, 111 aa, Homo sapiens
MSQVGRVRSSHHFESVCLDAEVRVVLVALDHAGLHTLSSALNESLRPIHREELHLLHFPNSPEENLRKRPAEPSPQIHGGAPHLPWLCVEKSDLLPENHAVFLQERTAQLF

SEQ ID NO: 4864 - protein, 91 aa, Homo sapiens
MTAIKHALQRDIFTPNDERLLSIVNVCKAGKKKKNCFLCATVTTERPVQVKVVKVKKSDKGDFYKRQIAWALRDLAVVDAKDAIKENPEFD

SEQ ID NO: 4865 - protein, 85 aa, Homo sapiens
  UNSURE 84: Xaa = Ile,Leu,Val
  UNSURE 69: Xaa = Met,Arg
MESKEELAANNLNGENAQQENEGGEQAPTQNEEESRHLGGGEGQKPGGNIRRGRVRRLVPNFRWAIPNXHIEHNEARDDVERFXG

SEQ ID NO: 4866 - protein, 86 aa, Homo sapiens
MESKEELAANNLNGENAQQENEGGEQAPTQNEEESRHLGGGEGQKPGRRRRRWGGRELMFLVLCDLFSVTLYPQHISLVRQKKKKK

SEQ ID NO: 4867 - protein, 86 aa, Homo sapiens
  UNSURE 35: Xaa = Ala,Gly
  UNSURE 37: Xaa = Ala,Pro
  UNSURE 86: Xaa = Gly,Arg,Trp
MESKEKRAVNSLSMENANQENEEKEQVANKGEPLXLXLDAGEYCVPRGNRRRFRVRQPILQYRWDMMHRLGEPQARMREENMERIX

SEQ ID NO: 4868 - protein, 81 aa, Homo sapiens
MESKEKRAVNSLSMENANQENEEKEQVANKGEPLALPLDAGEYCVPRGNRRRFRVRQPILQYRWDMMHRLGEPQARIERRE

SEQ ID NO: 4869 - protein, 80 aa, Homo sapiens
MESKEKRAVNSLSMENANQENEEKEQVANKGEPLALPLDAGEYCVPRGNRRRFRVREPILQYRWDMMHRLGEPQARMREE

SEQ ID NO: 4870 - protein, 113 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKLREKQLSHSLRAVSTDPP

SEQ ID NO: 4871 - protein, 89 aa, Homo sapiens
MESKEKRAVNSLSMENANQENEEKEQVANKGEPLALPLDAGEYCVPRGNRRRFRVRQPILQYRWDMMHRLGEPQARMREENMERIGEEV

SEQ ID NO: 4872 - protein, 76 aa, Homo sapiens
  UNSURE 54: Xaa = Gly,Arg
  UNSURE 69: Xaa = Lys,Arg
  UNSURE 37: Xaa = Pro,Arg,Ser,Thr
MESKEKRAVNSLSMENANQENEEKEQVANKGEPLALXLDAGEYCVPRGNRRRFXVRQPILQYRWDMMHXLGDHRQG

SEQ ID NO: 4873 - protein, 107 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKLREKQLSHSLRA

SEQ ID NO: 4874 - protein, 111 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKLREKQLSHSLRAVSTD

SEQ ID NO: 4875 - protein, 76 aa, Homo sapiens
MESKEKRAVNSLSMENANQENEEKEQVANKGEPLALPLDAGEYCVPRGNRRRFRVRQPILQYRWDMMHRLGEPQAR

SEQ ID NO: 4876 - protein, 85 aa, Homo sapiens
  UNSURE 52: Xaa = Gly,Arg
MESKEKRAVNSLSMENANQENEEKEQVANKGEPLALPLDAGEYCVPRGNRRXFRVRQPILQYRWDMMHRLGEPQARMREENMERI

SEQ ID NO: 4877 - protein, 90 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVR

SEQ ID NO: 4878 - protein, 111 aa, Homo sapiens; identical to SEQ ID NO: 4874

SEQ ID NO: 4879 - protein, 119 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKLREKQLSHSLRAVSTDPPHHDHHD

SEQ ID NO: 4880 - protein, 102 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKLREKQLS

SEQ ID NO: 4881 - protein, 68 aa, Homo sapiens
MESKEKRAVNSLSMENANQENEEKEQVANKGEPLALPLDAGEYCVPRGNRRRFRVRQPILQYRWDMMH

SEQ ID NO: 4882 - protein, 105 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKLREKQLSHSL

SEQ ID NO: 4883 - protein, 103 aa, Homo sapiens
  UNSURE 37: Xaa = Ala,Pro
  UNSURE 86: Xaa = Gly,Arg,Trp
MESKEKRAVNSLSMENANQENEEKEQVANKGEPLALXLDAGEYCVPRGNRRRFRVRQPILQYRWDMMHRLGEPQARMREENIERIXEEVRQLMEKLTEKQLSH

SEQ ID NO: 4884 - protein, 91 aa, Homo sapiens
  UNSURE 90: Xaa = Ile,Lys,Arg,Thr
MESKEKRAVNSLSMENANQENEEKEQVANKGEPLALPLDAGEYCVPRGNRRRFRVRQPILQYRWDMMHRLGEPQARMREENMERIGEEVXQ

SEQ ID NO: 4885 - protein, 80 aa, Homo sapiens
MESKEKRAVNSLSMENANQENEEKEQVANKGEPLALPLDAGEYCVPRGNRRRFRVRQPILQYRWDMMHRLGEPQARMREE

SEQ ID NO: 4886 - protein, 97 aa, Homo sapiens
  UNSURE 37: Xaa = Ala,Pro
  UNSURE 82: Xaa = Ile,Met
MESKEKRAVNSLSMENANQENEEKEQVANKGEPLALXLDAGEYCVPRGNRRRFRVRQPILQYRWDMMHRLGEPQARMREENXERIWEEVRQLMEKLR

SEQ ID NO: 4887 - protein, 122 aa, Homo sapiens
  UNSURE 103: Xaa = Asp,His,Asn
  UNSURE 102: Xaa = Lys,Asn,Arg,Ser,Thr
MESKEKRAVNSLSMENANQENEEKEQVANKGEPLALPLDAGEYCVPRGNRRRFRVRQPILQYRWDMMHRLGEPQARMREENMERIGEEVRQLMEKLREKQLXXSLRAVSTDPPHHDHHDEFC

SEQ ID NO: 4888 - protein, 57 aa, Homo sapiens
  UNSURE 8: Xaa = Asp,Asn
  UNSURE 18: Xaa = Gly,Arg,Trp
  UNSURE 13: Xaa = His,Gln
MENANQEXEEKEXVANKXEPLALPLDAGEYCVPRGNRRRFRVRQPILQYRWDMMHRL

SEQ ID NO: 4889 - protein, 102 aa, Homo sapiens
MESKEKRAVNSLSMENANQENEEKEQVANKGDPLALPLDAGEYCVPRGNRRRFRVRQPILQYRWDMMHRLGEPQARMREENIGKDSGGGETADGKAEGKAVE

SEQ ID NO: 4890 - protein, 115 aa, Homo sapiens
  UNSURE 61: Xaa = Pro,Gln
MSGFENLNTDFYQTSYSIDDQSQQSYDYGGSGGPYSKQYAGYDYSQQGRFVPPDMMQPQQXYTGQIYQPTQAYTPASPQPFYGNNFEDEPPLLEELGINFDHIWQKTLTVFNIRL

SEQ ID NO: 4891 - protein, 142 aa, Homo sapiens
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAGPMVFCLAFGAHCY

SEQ ID NO: 4892 - protein, 54 aa, Homo sapiens
MAEVKSMFREVLPKQGPLFVEDIMTMVLCKPKLLPLKSLTLEKLEKMHQAAQNT

SEQ ID NO: 4893 - protein, 95 aa, Homo sapiens
  UNSURE 89: Xaa = Lys,Thr
MEALLEGIQNRGHGGGFLTSCEAELQELMKQIDIMVAHKKSEWEGRTHALETCLKIREQELKSLRSQLDVTHKEVGMLHQQVEEHEKIXQEMTMG

SEQ ID NO: 4894 - protein, 109 aa, Homo sapiens
MKQIDIMVAHKKSEWEGRTHALETCLKIREQELKSLRSQLDVTHKEVGMLHQQVEEHEKIKQEMTMEYKQELKKLHEELCILKRSYEKLQKKQMRDFRGNTKNHREDRS

SEQ ID NO: 4895 - protein, 119 aa, Homo sapiens
MTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHT

SEQ ID NO: 4896 - protein, 62 aa, Homo sapiens
  UNSURE 48: Xaa = Lys,Arg,Thr
MQEEGEVPASAFQKAPEPLGPADQSELGPEQPEAEVGESSDEEPVESXAQRLRRTGLQKVQS

SEQ ID NO: 4897 - protein, 54 aa, Homo sapiens [sequence omitted]

SEQ ID NO: 4898 - protein, 92 aa, Homo sapiens
  UNSURE 79: Xaa = Ala,Gly
MHFPRSSLQPITTLGKSEFGEVFLAKAQGLEEGVAETLVLVKSLQSKDEQQQLDFRRRLEMFGKLNHANVCGSWGCAGXEPTTWCWNMWIWE

SEQ ID NO: 4899 - protein, 53 aa, Homo sapiens
  UNSURE 47: Xaa =  * ,Tyr
  UNSURE 38: Xaa = Ala,Pro
  UNSURE 53: Xaa = Asp,Glu
  UNSURE 45: Xaa = Glu,Lys
  UNSURE 39: Xaa = Gly,Ser
  UNSURE 42: Xaa = His,Gln
  UNSURE 46: Xaa = Leu,Val
MEVQKEAQRIMTLSVWKMYHSRMQRGGLRLHRSLQLVXXHAXARXXXLSAKVX

SEQ ID NO: 4900 - protein, 156 aa, Homo sapiens
MAAVPELLQQQEEDRSKLRSVSVDLNVDPSLQIDIPDALSERDKVKFTVHTKTTLPTFQSPEFSVTRQHEDFVWLHDTLIETTHYAGLIIPPAPTKPDFDGPREKMQKLGEGEGSMTKEEFAKMKQELEAEYLAVFKKTVSSHEVFLQRLSSHPVL

SEQ ID NO: 4901 - protein, 68 aa, Homo sapiens
  UNSURE 52: Xaa =  * ,Glu
MNQTSQKKDSLSMSSFQSVKSISNSGKARPQPGSFNKQDSKADVSQKADLEXEPLLHNSKLDKVPGVQ

SEQ ID NO: 4902 - protein, 145 aa, Homo sapiens
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKIG

SEQ ID NO: 4903 - protein, 56 aa, Homo sapiens
MDPYKASYGVEDPEYAVTQLAQTTMRSELGKLSLDKVFRGTESLNASIVDAITKLL

SEQ ID NO: 4904 - protein, 63 aa, Homo sapiens
MVRSLFQAGGRLAIGQREQDLQTLGSPADLDNLPDSFLTSCHFGLKATNSGSAVCTKSNNEFL

SEQ ID NO: 4905 - protein, 130 aa, Homo sapiens
MFPAPALPPHQSLPRYQPPGGELCCCLDQVLLPSPRDVGKGGPALELTHPPQQACVLRSGHLASRLHHLPAWCGPLPSFSAVHEAASGLAVRQPLLGADDPELQPTLARGARPPAPLVGMVPPAVHHLWD

SEQ ID NO: 4906 - protein, 91 aa, Homo sapiens
MFPAPALPPHQSLPRYQPPGGELCCCLDQVLLPSPRDVGKGGPALELTHPPQQACVLRSGHLASRLHHLPAWCGPLPSFSAVHEAASGLVC

SEQ ID NO: 4907 - protein, 51 aa, Homo sapiens
MLWWLCSFPLCNKYCCCSKKKKKKKKKKKKKKKKKKKKKKKKKKKKKKKKK

SEQ ID NO: 4908 - protein, 139 aa, Homo sapiens
  UNSURE 104: Xaa = Gly,Val
MAQHFSLAACDVVGFDLDHTLCRYNLPESAPLIYNSFAQFLVKEKGYDKELLNVTPEDWDFCCKGLALDLEDGNFLKLANNGTVLRASHGTKMMTPEVLAEAYXKKEWKHFLSDTGMACRSGKYYFYDNYFDLPGALLC

SEQ ID NO: 4909 - protein, 125 aa, Homo sapiens
METEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENL

SEQ ID NO: 4910 - protein, 101 aa, Homo sapiens
MAGKKDYPALLSLDENELEEQFVKGHGPGGQATNKTSNCVVLKHIPSGIVVKCHQTRSVDQNRKLARKILQEKVDVFYNGENSCSQRKTRSGEEKTKKKKK

SEQ ID NO: 4911 - protein, 51 aa, Homo sapiens
MLTETHRRNNNNTCSLLEREHCLYAPWINKHCASVRWWWPGCCKYTIKHHL

SEQ ID NO: 4912 - protein, 87 aa, Homo sapiens
  UNSURE 63: Xaa = Ala,Thr
  UNSURE 73: Xaa = Cys,Tyr
  UNSURE 62: Xaa = Gln,Arg
MASHLRTLSGRYHPSSGVQPTTLNQPQWLRWDGSHEWCRPWPRRSRPGPSPGPGPGLAAVLXXACAGGRRGLXAQVLPFPAGQPSLR

SEQ ID NO: 4913 - protein, 115 aa, Homo sapiens
MACWQNKQHSITKNTAKLDRETEELHHDRVTLEVGKVIQQGRQSKGLTQKDLATKINEKPQVIADYETGRAIPNNQVLGKIERAIGSSSGERTLESPSRRGLGRNEHKASKSVRS

SEQ ID NO: 4914 - protein, 63 aa, Homo sapiens
  UNSURE 12: Xaa = Leu,Val
MLQHISLLVKQXQELELKLSGQNAMGSQDSLLEITFRSGALPVLCDPTTPKPEDLHSPPLGRA

SEQ ID NO: 4915 - protein, 74 aa, Homo sapiens
MAAAAGLGLQREAAEGKWSAWRMTEETRIVYWIKDRQLTNRDSTILELQKVLKTCWFVCWSIFQLKFLFLFFFF

SEQ ID NO: 4916 - protein, 129 aa, Homo sapiens
MDRSGFGEISSPVIREAEVTRTARKQSAQKRVLLQASQDENFGNTTPRNQVIPRTPSSFRQPFTPTSRSLLRQPDISCILGTGGKSPRLTQSSGFFGNLSMVTNLDDSNWAAAFSSQRSGLFTNTEPTV

SEQ ID NO: 4917 - protein, 68 aa, Homo sapiens
MGQSKSKHSAYLHFIKLLLKRAGIKASTENLITLFPTVEQYCPWFPEHGTMDFKDWEQVGIALKQVCK

SEQ ID NO: 4918 - protein, 130 aa, Homo sapiens
MSPLECSECFGDQLLHRTYTWQLTLHSRPNYTRKRDTRSESLEIPISVVLPQRGTAEPFPRLHNLYSTPRCAQQAALPRLSRRMASQHSYPLNRFSSVPLDPMERPMSQADLELDYNPPRVQLSDEMFVF

SEQ ID NO: 4919 - protein, 67 aa, Homo sapiens [sequence omitted]

SEQ ID NO: 4920 - protein, 146 aa, Homo sapiens
  UNSURE 3: Xaa = Ala,Asp,Glu,Gly,Val
MAXLVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEI

SEQ ID NO: 4921 - protein, 108 aa, Homo sapiens
MAQSQGWVKRYIKAFCKGFFVAVPVPVTFLDRVACVARVEGASMQPSLNPGGSQSSDVVLLNHWKVRNFEVHRGDIVSLVSPKNPEQKIIKRVIALEGDIVRTIGHKN

SEQ ID NO: 4922 - protein, 101 aa, Homo sapiens
MSDLRITEAFLYMDYLCFRALCCKGPPPARPEYDLVCIGLTGSGKTSLLSKLCSESPDNVVSTTGADNIRKYWSRYYQGSQGVIFVLDSASSEDDLEAARN

SEQ ID NO: 4923 - protein, 123 aa, Homo sapiens
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEDDLEAARNEA

SEQ ID NO: 4924 - protein, 152 aa, Homo sapiens
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEDDLEAARNELHSALQHPQLCTLPFLILANHQDKPAARSV

SEQ ID NO: 4925 - protein, 114 aa, Homo sapiens
MTKETQHIHKHLKPTARHPSLSEKSRKVPIQMAELLRLGPDLYHHRVTEMEPSPSHLLMAVSCDPLNPGHHAFQFHLREHFQVRLKPSGSSRGLNPFGMLSGRQNQGPMIHDLV

SEQ ID NO: 4926 - protein, 73 aa, Homo sapiens
MSDLRITEAFLYMDYLCFRALCCKGPPPARPEYDLVCIGLTGSGKTSLLSKLCSESPDNVVSTTGFSIKAVPF

SEQ ID NO: 4927 - protein, 128 aa, Homo sapiens
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEDDLEAARNELHSAPS

SEQ ID NO: 4928 - protein, 94 aa, Homo sapiens
  UNSURE 13: Xaa = Gly,Met,Arg,Val
  UNSURE 52: Xaa = Leu,Val
  UNSURE 51: Xaa = Lys,Asn
MSDLRITEAFLYXDYLCFRALCCKGPPPARPEYDLVCIGLTGSGKTSLLSXXCSESPDNVVSTTGFSIKAVPFQNAILNVKELGGADNIRKYWS

SEQ ID NO: 4929 - protein, 136 aa, Homo sapiens
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEDDLEAARNELHSALQHPQLWQLY

SEQ ID NO: 4930 - protein, 132 aa, Homo sapiens
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEDDLEAARNELHSALQHPTV

SEQ ID NO: 4931 - protein, 56 aa, Homo sapiens
MPQGMFVKKDDWMGSKLKKKKERKREISKSPHKRWRRGLINIVSMTFENKCFTPCQ

SEQ ID NO: 4932 - protein, 72 aa, Homo sapiens
MWRQRSMASSSSGRGMGTLWAIRASVIVPLSFQPLTNPVGGRLEECSLGTRAWNWGSYRLCGLGQSLNLPAC

SEQ ID NO: 4933 - protein, 70 aa, Homo sapiens
MMFPLARNALSSLKIQSILQSMARHSHVKHSPDFHDKYGNAVLASGTAFCVATWVFTATQIGIEWNLSPV

SEQ ID NO: 4934 - protein, 141 aa, Homo sapiens
MSSSMWYIMQSIQSKYSLSERLIRTIAAIRSFPHDNVEDLIRGGADVNCTHGTLKPLHCACMVSDADCVELLLEKGAEVNALDGYNRTALHYAAEKDEACVEVLLEYGANPNALDGNRDTPLHWAAFKNNAECVRALLESG

SEQ ID NO: 4935 - protein, 84 aa, Homo sapiens
MVARGLVREAREDLEVHQAKLKEVRDRLDRVSREDSQYLELATLEHRMLQEEKRLRTAYLRAEDSEREKFSLFSAAVRESHEKE

SEQ ID NO: 4936 - protein, 128 aa, Homo sapiens
MEAHNILSKRGFSVRSFGTGTHVKLPGPAPDKPNVYDFKTTYDQMYNDLLRKDKELYTQNGILHMLDRNKRIKPRPERFQNCKDLFDLILTCEERVYDQVVEDLNSREQETCQPVHVVNVDIQDNHEE

SEQ ID NO: 4937 - protein, 58 aa, Homo sapiens
  UNSURE 9: Xaa = Glu,Gly,Lys,Arg
MIRCHLQGXEDNLSLDIAKLEKHVFETSKVHLTLLPGDDILAGAADGLSNTNPLKWIK

SEQ ID NO: 4938 - protein, 77 aa, Homo sapiens
  UNSURE 20: Xaa = Met,Arg
MPRSQPYWRCCCNFLCKRRXKFSASGELGNGNIKLSQTSNVDKEEEAVTIEMNEPVQLTFALRYLNFFYKSHSTLFN

SEQ ID NO: 4939 - protein, 77 aa, Homo sapiens
MLRIVEPYVTWGFPNLKSVRELILKRGQAKVKNKTIPLTDNTVIEEHLGKFGVICLEDLIHEIAFPGKHFPGDLMVL

SEQ ID NO: 4940 - protein, 74 aa, Homo sapiens
MRKKKALATTEEEKHEFRRRCATSLFNIWTKYAPRLPADYYNEKLLKVGDSLCQMKEYKLALLQCYGRYLQQFN

SEQ ID NO: 4941 - protein, 61 aa, Homo sapiens
MSTIQNLQSFGKIPSPPPPSLARRASRPFARLATAPRGPLSALPAPLVGALSRRPENGDGA

SEQ ID NO: 4942 - protein, 116 aa, Homo sapiens
MALSKSMHARNRYKDKPPDFAYLASKYPDFKQHVQINLNGRVSLNFKDPEAVRALTCTLLREDFGLSIDIPLERLIPTVPLRLNYIHWVEDLIGHQDSDKSTLRRGIDIGTGASCI

SEQ ID NO: 4943 - protein, 91 aa, Homo sapiens
  UNSURE 50: Xaa = Ala,Asp
  UNSURE 38: Xaa = Ala,Val
  UNSURE 49,63: Xaa = Glu,Lys
MEKPYNKNEGNLENEGKPEDEVEPDDEGKSDEEEKPDXEGKTECEGKRXXEGEPGDEGQLEDXGSQEKQGRSEVRASHKARASQPPRQSRE

SEQ ID NO: 4944 - protein, 75 aa, Homo sapiens
MEKLFNENEGMPSNQGKIDNEEQPPHEGKPEVACILEDKKLENEGNTENTGKRVEEPLKDKEKPESAGKAKKKKK

SEQ ID NO: 4945 - protein, 101 aa, Homo sapiens
  UNSURE 71: Xaa = Lys,Arg
MEKPYNKNEGNLENEGKPEDEVEPDDEGKSDEEEKPDAEGKTECEGKRKAEGEPGDEGQLEDKGSQEKQGXSEVRASHKARASQPPRQSRGPAAGRRKAPG

SEQ ID NO: 4946 - protein, 74 aa, Homo sapiens
MEKLFNENEGMPSNQGKIDNEEQPPHEGKPEVACILEDKKLENEGNTENTGKRVEEPLKDKEKPESAAKAKGEG

SEQ ID NO: 4947 - protein, 90 aa, Homo sapiens
MEKLYSENEGMASNQGKMENEEQPQDERKPEVTCTLEDKKLENEGKTENKGKTGDEEMLKDKGKPESEGEAKEGKSEREGESEMEGGSER

SEQ ID NO: 4948 - protein, 62 aa, Homo sapiens
  UNSURE 29: Xaa = Ala,Gly
  UNSURE 47: Xaa = Ala,Ser
  UNSURE 39: Xaa = Gly,Val
  UNSURE 32: Xaa = Leu,Trp
MGRVIRGQRKGAGSVFRAHVKHRKGAAPXARXDFAERHXYILKAGRXYHKYKAKRNCWPRVR

SEQ ID NO: 4949 - protein, 143 aa, Homo sapiens
MTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKGEGDIHENVDTDLPGSLGQSEEKPVPAAPVPSPVAPAPVPSRRI

SEQ ID NO: 4950 - protein, 83 aa, Homo sapiens
MAVSEPEASAAEWKQLDPAQSNLYNDVMLENYCNQASMGCQAPKPDMISKLEKGEAPWLGKGKRPSQGCPSKIARPKQKKKKK

SEQ ID NO: 4951 - protein, 94 aa, Homo sapiens
MVPAERALYRDVMLENYEAVAFVVPPTSKPALVSHLEQGKESCFTQPQGVLSRNDWRAGWIGYLELRRYTYLAKAVLRRIVSKIFRNRQCWEDR

SEQ ID NO: 4952 - protein, 77 aa, Homo sapiens
MCLITLNNSYRMFESCSGFSGFCASPIEESHGALISSCNSRTMTDGLVTFRDVAIDFSQEEWECLDPAQRDLYVDVM

SEQ ID NO: 4953 - protein, 91 aa, Homo sapiens
  UNSURE 41: Xaa = Glu,Lys
  UNSURE 56: Xaa = Leu,Trp
  UNSURE 10: Xaa = Lys,Arg
MVPAERALYXDVMLENYEAVAFVVPPTSKPALVSHLEQGKXSCFTQPQGVLSRNDXRAGWIGYLELRRYTYLAKAVLRRIVSKIFRNRQCW

SEQ ID NO: 4954 - protein, 124 aa, Homo sapiens
MMTAVSLTTRPQESVAFEDVAVYFTTKEWAIMVPAERALYRDVMLENYEAVAFVVPPTSKPALVSHLEQGKESCFTQPQGVLSRNDWRAGWIGYLELRRYTYLAKAVLRRIVSKIFRNRQCWGR

SEQ ID NO: 4955 - protein, 61 aa, Homo sapiens
MIKRSKVLVFCSKIMEEAVTFKDVAVVFTEEELGLLDPAQRKLYRDVMLENFRNLLSVGHQ

SEQ ID NO: 4956 - protein, 128 aa, Homo sapiens
  UNSURE 121: Xaa =  * ,Tyr
  UNSURE 73: Xaa = Ala,Ser
  UNSURE 75: Xaa = Arg,Ser
  UNSURE 52: Xaa = Cys,Arg
  UNSURE 62: Xaa = Cys,Ser
  UNSURE 54: Xaa = Gly,Arg,Ser
  UNSURE 68: Xaa = His,Gln
  UNSURE 49: Xaa = Ile,Leu,Arg,Ser
  UNSURE 56: Xaa = Ile,Lys,Met,Asn
  UNSURE 60: Xaa = Leu,Val
  UNSURE 51: Xaa = Pro,Gln
  UNSURE 55: Xaa = Pro,Ser
  UNSURE 48,58: Xaa = Pro,Thr
MAPSRNGMVLKPHFHKDWQRRVATWFNQPARKIRRRKARQAKARRIAXXTXXQXXXRXIXRXPTVRYXTKVRXGXGFSLEELRVAGIHKKVARTIGISVDPRRRNKSTESLQANVQRLKEXRSKLILF

SEQ ID NO: 4957 - protein, 120 aa, Homo sapiens
MEEELAIQQGQLETTLKELQTLRNMQKEAIAAHKENKLHLQQHVSMEFLKLHQFLHSKEKDILTELREEGKALNEEMELNLSQLQEQCLLAKDMLVSIQAKTEQQNSFDFLKDITTLLHS

SEQ ID NO: 4958 - protein, 82 aa, Homo sapiens
MNPPEGKNSEHIPTSEGTNSGHAAFKNCNNARVRGFILEVSKTKNPIPDTFGPRWKGSSTSEKPVLLPAGNSCFQKTALLLH

SEQ ID NO: 4959 - protein, 127 aa, Homo sapiens
MSKKKGLSAEEKRTRMMEIFSETKDVFQLKDLEKIAPKEKGITAMSVKEVLQSLVDDGMVDCERIGTSNYYWAFPSKALHARKHKLEVLESQLSEGSQKHASLQKSIEKAKIGRCETIKLSGMQEER

SEQ ID NO: 4960 - protein, 91 aa, Homo sapiens
  UNSURE 47: Xaa = Gly,Arg
MLTYLPLLCVNRFSSVLCGHCHPMQQQGSSLSGFDVVDAGSGSFAHXDTISHEHPWEVMPQLCFYRDPEEIEKEEQAAAEKAVTKEEFQGE

SEQ ID NO: 4961 - protein, 60 aa, Homo sapiens
MPAREVLRMRDTISHEHPWEVMPQLCFYRDPEEIEKEEQAAAEKAVTKEEFQGEWTAPAP

SEQ ID NO: 4962 - protein, 75 aa, Homo sapiens
  UNSURE 29: Xaa =  * ,Tyr
MLPFFNHICVSGVERRESEQGAGLLSVYXPELFVWVSQEPFPNKDMEGRLPKGRLPVPKEVNRKKNDETNAASLT

SEQ ID NO: 4963 - protein, 56 aa, Homo sapiens
MSGALDVLQMKEEDVLKFLAAGTHLGGTNLDFQMEQYIYKRKSDGIYIINLKRTWE

SEQ ID NO: 4964 - protein, 139 aa, Homo sapiens
  UNSURE 102: Xaa =  * ,Glu,Lys,Gln
  UNSURE 130: Xaa = Ala,Pro,Ser,Thr
MILGSLSRAGPCSATAAPDHAAPTGPQADPALPTRASPYPWPLQQLQHHGPCAEGCALPHFWGTLLKTKRPVISCNICQIRFNSQSQAEAHYKGNRHARRVXGIEAAKTRGREPGVREPGDPAPPGSTPXNGDGVAPRP

SEQ ID NO: 4965 - protein, 108 aa, Homo sapiens
  UNSURE 11: Xaa = Asp,His
  UNSURE 25: Xaa = Gln,Arg
  UNSURE 58: Xaa = Lys,Met,Arg,Thr
  UNSURE 65: Xaa = Phe,Val
MLTYLPLLCVXRFSSVLCGHCHPMXQQGSSLSGFDVVDAGSGSFCACVTPFPMNTPGXSCLSSAXYRDPEEIEKEEQAAAEKAVTKEEFQGEWTAPAPEFTATQPEVT

SEQ ID NO: 4966 - protein, 63 aa, Homo sapiens
MPAREVLRMRDTISHEHPWEVMPQLCFYRDPEEIEKEEQAAAEKAVTKEEFQGEWTAPAPEVH

SEQ ID NO: 4967 - protein, 125 aa, Homo sapiens
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQK

SEQ ID NO: 4968 - protein, 62 aa, Homo sapiens
MGRINIVKMTILRKAIHRFNAIPTKTPPSFFTELEKTILKFMWNQKRVCIAKTRLSKKKKNW

SEQ ID NO: 4969 - protein, 92 aa, Homo sapiens
  UNSURE 64: Xaa = Ile,Met,Arg,Ser
MPTSSSFKHRIKEQEDYIRDWTAHREEIARISQDLALIAREINDVAGEIDSVTSSGTAPSTTVXTAATTPWLCIDTRKSWLIVFLMKASTSE

SEQ ID NO: 4970 - protein, 61 aa, Homo sapiens
  UNSURE 61: Xaa = Lys,Asn
MGRINIVKMTILRKAIHRFNAIPTKTPPSFFTELEKTILKFMWNQKRVCIAKTRLSKKKKX

SEQ ID NO: 4971 - protein, 71 aa, Homo sapiens
  UNSURE 62: Xaa =  * ,Leu
MHLLQVSINTHESKTWNYLRLALDQPVGPALDQPCFLSLGLWYNLKFSTYHPFLSHLFSFLXHKPQKPGAN

SEQ ID NO: 4972 - protein, 54 aa, Homo sapiens
  UNSURE 6: Xaa = Arg,Ser
  UNSURE 7: Xaa = His,Asn,Tyr
  UNSURE 48: Xaa = Phe,Ser
MPIIPXXFRSPRQEDHLSAEDQDQPGKYGKTLSLQKNLEIGWAWWHPXVVLTAQ

SEQ ID NO: 4973 - protein, 129 aa, Homo sapiens
MKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCN

SEQ ID NO: 4974 - protein, 72 aa, Homo sapiens
  UNSURE 10: Xaa = Ala,Asp,Gly,His,Leu,Pro,Arg,Val
  UNSURE 67: Xaa = Cys,Ser
  UNSURE 32: Xaa = Ile,Leu
  UNSURE 70: Xaa = Ile,Lys,Arg,Thr
  UNSURE 68: Xaa = Ile,Met
  UNSURE 12: Xaa = Lys,Asn
MSHPSPQAKXSXPSNPRVFFDVDIGGERVGRXVLEFVCRYRTQNCGKFSCTVYRRKRHWTHDWGNLXXFXRM

SEQ ID NO: 4975 - protein, 84 aa, Homo sapiens
  UNSURE 3: Xaa = Gly,Arg
  UNSURE 2: Xaa = Gly,Leu,Arg,Val
  UNSURE 71: Xaa = Lys,Arg
MXXALSRLGAGTPCRPRAPLVLPARGRKTRHDPLAKSKIERVNMPPAVDPAEFFVLMERYQHYRQTVRALXMEFVSEVQRKVHE

SEQ ID NO: 4976 - protein, 54 aa, Homo sapiens
MDNSNIVAMFEMMDSSGRGTISFVQYKEALKTLGLCTEDEDLQDDGHKITLDKF

SEQ ID NO: 4977 - protein, 61 aa, Homo sapiens
  UNSURE 19: Xaa = Cys,Phe,Tyr
  UNSURE 61: Xaa = Lys,Asn
MGRINIVKMTILRKAIHRXNAIPTKTPPSFFTELEKTILKFMWNQKRFCIAKTRLSKKKKX

SEQ ID NO: 4978 - protein, 63 aa, Homo sapiens [sequence omitted]

SEQ ID NO: 4979 - protein, 70 aa, Homo sapiens
MSHGPKQPGAAAAPAGGKAPGQHGGFVVTVKQERGEGPRAGEKGSHEEEPVKKRGWPKGKKRKKILPNGP

SEQ ID NO: 4980 - protein, 151 aa, Homo sapiens
MAAQDAMVLWEACQQKTGEHKTMLQMILCNKSYQQLRLVFQEFQNISGQDMVDAINECYDGYFQELLVAIVLCVRDKPAYFAYRLYSAIHDFGFHNKTVIRILIARSEIDLLTIRKRYKERYGKSLFHDIRNFASGHYKKALLAICAGDAE

SEQ ID NO: 4981 - protein, 56 aa, Homo sapiens
  UNSURE 35: Xaa =  * ,Glu,Lys,Leu,Met,Gln,Val
  UNSURE 8: Xaa =  * ,Tyr
  UNSURE 28: Xaa = Ala,Asp
  UNSURE 48: Xaa = Ala,Glu
  UNSURE 36: Xaa = Ala,Pro,Thr
  UNSURE 14: Xaa = Asp,Asn
  UNSURE 7: Xaa = Ile,Met
  UNSURE 9: Xaa = Leu,Ser
MGAAPGXXXVLVQXGSERRSGFPLLGAXGHSPAGXXSRPDFPGAGDPXGSGQGLTC

SEQ ID NO: 4982 - protein, 58 aa, Homo sapiens
  UNSURE 4,11,21: Xaa = Ala,Thr
  UNSURE 50: Xaa = Gly,Ser
  UNSURE 30: Xaa = His,Arg
  UNSURE 31: Xaa = His,Gln
MTRXPSTSSSXTAHQHLHLRXQGEQHAQLXXFTAGIVEAVLTHSGFPCQXHGALAQGH

SEQ ID NO: 4983 - protein, 110 aa, Homo sapiens
MAHVSSETQDVSPKDELTASEASTRSPLCEHTFPGDSDLRSMIEEHAFQVLSQGSLLESPSYTVCVSEPDKDDDFLSLNFPRKLWKIVESDQFKSISWDENGTCIVINEE

SEQ ID NO: 4984 - protein, 76 aa, Homo sapiens
MIESFWFRSVPLAATSMLITQGLISKGILSSHPKYGSIPKLILACIMGYFAGKLSYVKTCQEKFKKLENSPLGEAL

SEQ ID NO: 4985 - protein, 102 aa, Homo sapiens
MNTSRFADHHDLLTETKRPIDTVISQQAFYSDESVSAMEKQYLRNSNLTPQQKIDELHHGFTGLDLEEQWMYPSRSFILTVTIFRQMIQLRQHSKNIHLSKT

SEQ ID NO: 4986 - protein, 51 aa, Homo sapiens
MDDIILYLENPIDSAKSLQELINDINKVSGYKIHVQKPVAFLYVNNIQDES

SEQ ID NO: 4987 - protein, 53 aa, Homo sapiens
MSTAQSLKSVDYEVFGRVQGVCFRMYTEDEARKIGVVGWVKNTSKGTVTGGGE

SEQ ID NO: 4988 - protein, 62 aa, Homo sapiens
MVSALEPVLGRSSLHSSARASWWGSESCQCWRLLWAVRVHCLSHAYLKRGLLVPLLPCCCIF

SEQ ID NO: 4989 - protein, 71 aa, Homo sapiens
  UNSURE 41: Xaa = Asp,Glu,Gly,Val
MVATGSLSSKNPASISELLDCGYHPESLLSDFDYWDYVVPXPNLNEVIFEESTCQNLVKMLENCLSKSKQT

SEQ ID NO: 4990 - protein, 69 aa, Homo sapiens
  UNSURE 61: Xaa = Cys,Trp
MAPSRNGMVLKPHFHKDWQRRVATWFNQPARKIRRRKARQAKARRIAPRPASGPIRPIVRXPTVRYHTK

SEQ ID NO: 4991 - protein, 124 aa, Homo sapiens
MAFFTGLWGPFTCVSRVLSHHCFSTTGSLSAIQKMTRVRVVDNSALGNSPYHRAPRCIHVYKKNGVGKVGDQILLAIKGQKKKALIVGHCMPGPRMTPRFDSNNVVLIEDNGNPVGTRIKTPIP

SEQ ID NO: 4992 - protein, 86 aa, Homo sapiens
MDPVYTTQLELVEPSGWIHVPLTDNHKKPTRTFMIQIAVLANHQNGRDTHMRQIKIYTPVEESSIGKFPRCTTIDFMMYRSNKVTL

SEQ ID NO: 4993 - protein, 57 aa, Homo sapiens
  UNSURE 54: Xaa = Asp,Glu
MVEDELALFDKSINEFWNKFKSTDTSCQMAGLRDTYKDSIKAFAEKLSVKLKEXERM

SEQ ID NO: 4994 - protein, 105 aa, Homo sapiens
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIK

SEQ ID NO: 4995 - protein, 136 aa, Homo sapiens
  UNSURE 115: Xaa =  * ,Glu
MLGSRVDRPKLSVAPSVVLEEDQVLVSPAVDLEEGCRLRDFTEKIMNVKGKVILSMLVVSTVIIVFWEFINSTEGSFLWIYHSKNPEVDDSSAQKGWWFLSWFNNGIHNYQQGEXDIDKEKVREETKGRKMTQQSF

SEQ ID NO: 4996 - protein, 75 aa, Homo sapiens
  UNSURE 75: Xaa = Ala,Gly
MQGAARPTSSCSDRQTGNQSPYLSSLCLSHSPPASHVDLCLFLLGWWKLLQMSRLAVNKVLRGGHVSKLKKKKNX

SEQ ID NO: 4997 - protein, 144 aa, Homo sapiens
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSRKVIHMFSTAEGLLTQGDKITADGLQEVFETNVF

SEQ ID NO: 4998 - protein, 105 aa, Homo sapiens
  UNSURE 80: Xaa = Asp,Glu
  UNSURE 6: Xaa = Asp,His
MRALPXETHRARMFARHDIVALGQRSATCPRSAAVKALQTATREAIALLQAMVEEVRHSAAEEEDAIHALFGSMQDRLAXRKALLLQAVQSQYEEKDKAFKEQLS

SEQ ID NO: 4999 - protein, 96 aa, Homo sapiens
  UNSURE 10: Xaa = Asp,Asn
  UNSURE 9: Xaa = His,Leu,Pro,Gln
MTYYAQCYXXMLDLQKQLGSFPSNYLSNNNQTSVTPVPSVLPNAIGSSAMASTSGLVITSPSNLSDLKECSGSRKARVLYDYDAANSTELSLLADE

SEQ ID NO: 5000 - protein, 92 aa, Homo sapiens
MTTEVILHYRPCESDPTQLPKIAEKAIQDFPTRPLSRFIPWFPYDGSKLPLRPKRSPPVISEEAAEDVKQYLTISEHDAKSHSYDCTVDLLE

SEQ ID NO: 5001 - protein, 70 aa, Homo sapiens
MICTFLRAVQYTEKLHRSSAKRLLLPYIVLNKACLKTEPSLRCGLQYQKKTLRPRCILGVTQKTIWTQGP

SEQ ID NO: 5002 - protein, 119 aa, Homo sapiens
  UNSURE 62: Xaa =  * ,Gly,Leu,Val
  UNSURE 108: Xaa = Ala,Glu
MEPDGTYEPGFVGIRFCQECNNMLYPKEDKENRILLYACRNCDYQQEADNSCIYVNKITHEXRTDPDYRRRVPGPHVAADRGPPVPKVRPQGGCVLPVTQCAGRGRHXHIYYVCTAPHC

SEQ ID NO: 5003 - protein, 148 aa, Homo sapiens
  UNSURE 33: Xaa = Cys,Tyr
  UNSURE 22: Xaa = Glu,Lys
  UNSURE 130: Xaa = Gly,Arg
  UNSURE 132: Xaa = Ile,Arg
  UNSURE 67: Xaa = Lys,Met,Thr
MEPLASNIQVLLQAAEFLERRXREAEHGYASLXPHRSPGPIHRRKKRPPQAPGAQDSGRSVHNELEXRRRAQLKRCLERLKQQMPLGADCARYTTLSLLRRARMHIQASCYGQSILVPPGRQLQGQEGKXLXRRQSLGPPRAPAAAGA

SEQ ID NO: 5004 - protein, 125 aa, Homo sapiens [sequence omitted]

SEQ ID NO: 5005 - protein, 56 aa, Homo sapiens
MGILNFNIECVLGNSIEYSNGVVVTKNALVLKSDILKYLGVRCYDICGLLSSFFFF

SEQ ID NO: 5006 - protein, 105 aa, Homo sapiens
MVHPRILYRDGQALGSWLRPLGQPCAKDLLTTDQPDHLPPSKSSKSSKLVTCPLMFPGNQERGPLHFIFPSRVAGSLPGKQASFSTAVVALTKQSGKVLCPLQSP

SEQ ID NO: 5007 - protein, 88 aa, Homo sapiens
MSLGAVQMPGGDLIPLAFFGFLANILLFFPGGKVIDDNDHLSQEIWFFGGILGSGVLMIFPALVFLGLKNNDCCGCCGNEGCGKRFAM

SEQ ID NO: 5008 - protein, 132 aa, Homo sapiens
MSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPGGVGFDINCGVRLLRTNLD

SEQ ID NO: 5009 - protein, 155 aa, Homo sapiens
  UNSURE 16: Xaa = Glu,Gly
  UNSURE 17: Xaa = Leu,Val
MKSRFSTIDLRAVLAXXNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPL

SEQ ID NO: 5010 - protein, 100 aa, Homo sapiens
MASTEEQYDLKIVKVEEDPIWDQETHLRGNNFSGQEASRQLFRQFCYQESPGPREALSRLRELCHQWLRPEIHTKEQILELLVLEQFLTILPEELRPGCG

SEQ ID NO: 5011 - protein, 131 aa, Homo sapiens
MGTVHARSLEPLPSSGPDFGGLGEEAEFVEVEPEAKQEILENKDVVVQHVHFDGLGRTKDDIIICEIGDVFKAKNLIEVMRKSHEAREKLLRLGIFRQVDVLIDTCQGDDALPNGLDVTFEVTELRRLTGS

SEQ ID NO: 5012 - protein, 60 aa, Homo sapiens
  UNSURE 58: Xaa =  * ,Glu,Lys,Gln
MRFQRHRKGRHQSHIRGPTQGERCVATRFQPIFLILWLVNREYPPNHLSLFLRVVGLXIC

SEQ ID NO: 5013 - protein, 105 aa, Homo sapiens
MVFFTCNACGESVKKIQVEKHVSVCRNCECLSCIDCGKDFWGDDYKNHVKCISEDQKYGGKGYEGKTHKGDIKQQAWIQKISELIKRPNVSPKVRELLEQISAFD

SEQ ID NO: 5014 - protein, 128 aa, Homo sapiens
  UNSURE 17: Xaa =  * ,Lys,Leu,Met,Pro,Gln,Ser,Thr
  UNSURE 16: Xaa = Arg,Ser
  UNSURE 115: Xaa = Asp,Glu
  UNSURE 25: Xaa = Glu,Gly
MQAARPREAAAASSEXXPGCPTLLXVLQGWGWRLQSPQPCSPGHSPLQNPQVSCQEQIRLKKLKRQEEEQAHATSLPPRASSPPQILPQLSPEQLGMIEKLVAAQQQCNRRSFSXRLRVTVMLLETSR

SEQ ID NO: 5015 - protein, 69 aa, Homo sapiens
MSVSRTMEDSCELDLVYVTERIIAISFPSTANEENFRSNLREWRRCSSPNMEALLLFNLSERRPDITKL

SEQ ID NO: 5016 - protein, 116 aa, Homo sapiens
  UNSURE 27: Xaa = Met,Arg
MKDERGTASSFNWFCPVRSDQAWADKXLSEPHVLSLFYLPIKLLQDNTLIWHGHRGSKPVAPNRIISAADNKQKRSQATAILKKKTINSEIQLRNKCFIQDKARGLGDCDLACIIL

SEQ ID NO: 5017 - protein, 95 aa, Homo sapiens
MGYYNKASECFQQAFDTTVELMSMPLMDETKVHYGIAKAHQMMLTVNNYIESADLTSLNYLLSWKESRGNIEPDPVTEEFRGSQWKLYLKTQNVW

SEQ ID NO: 5018 - protein, 92 aa, Homo sapiens
  UNSURE 84: Xaa =  * ,Glu
  UNSURE 56: Xaa =  * ,Lys
  UNSURE 32: Xaa = Arg,Ser
  UNSURE 42,60: Xaa = Ile,Met
MEEGNNNEEVIHLNNFHCHRGQDFVIFFWKPXLSKERSRIIXNPSSSLLASQDETXHCFXQAADLLMADFKVLSSQDIMWALHXLKGHYAIT

SEQ ID NO: 5019 - protein, 67 aa, Homo sapiens
MRRRNRGSASEVAYPRSPSKQYSNPILHPKLSAAFRKQRQAPWRSRSAAGCGAGRGLRFPSLPQSCW

SEQ ID NO: 5020 - protein, 71 aa, Homo sapiens
  UNSURE 60: Xaa =  * ,Leu
MLLPQPSRAAGTTTTATCHHAWLIFVCFVEMGFHHVAQAPQHLKEHGAQSWEAWDQVLDXVSSWLCDSGQD

SEQ ID NO: 5021 - protein, 56 aa, Homo sapiens
MEYERSPLERKGQTLCFHESEDLAEPVPQGYCIHSLSLKGCATSRMSLFRLLKFLT

SEQ ID NO: 5022 - protein, 54 aa, Homo sapiens
MEYERSPLERKGQTLCFHESEDLAEPVPQGYCIHSLSLKGCATSRMSLLDFEIS

SEQ ID NO: 5023 - protein, 50 aa, Homo sapiens
MEYERSPLERKGQTLCFHESEDLAEPVPQGYCIHSLSLKRLCHFKNVIVR

SEQ ID NO: 5024 - protein, 50 aa, Homo sapiens
MEYERSPLERKGQTLCFHESEDLAEPVPQGYCIHSLSLKGCATSRMSLLD

SEQ ID NO: 5025 - protein, 59 aa, Homo sapiens
MEYERSPLERKGQTLCFHESEDLAEPVPQGYCIHSLSLKGCATSRMSLLDFEISNCLPA

SEQ ID NO: 5026 - protein, 50 aa, Homo sapiens; identical to SEQ ID NO: 5024

SEQ ID NO: 5027 - protein, 52 aa, Homo sapiens
MEYERSPLERKGQTLCFHESEDLAEPVPQGYCIHSLSLKGCATSRMSLLDFE

SEQ ID NO: 5028 - protein, 68 aa, Homo sapiens
MAALGSPSHTFSRTSAGVALPERGHRRPYRDTAAYRYLVKAFRAHRVTSEKLCRAQHELHFQAATYLC

SEQ ID NO: 5029 - protein, 148 aa, Homo sapiens
  UNSURE 20: Xaa = Phe,Leu
MATSLGSNTYNRQNWEDADXPILCQTCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMEREISNSDGTRPVGMLGKATSTSDMLL

SEQ ID NO: 5030 - protein, 55 aa, Homo sapiens
MPFDFEPRRSPLTLCQELSKAGELTWDSWLGPNREPPSHHPSASSPPHPSAKAAF

SEQ ID NO: 5031 - protein, 84 aa, Homo sapiens
MGWRWIPHQQLLDSLRMQMLITENDLCKFKILLLSVGENLVPLPLWSEVNESLFPFPKPNLNQFFLETDYTETTSCHQQKIDNM

SEQ ID NO: 5032 - protein, 138 aa, Homo sapiens
MVKTKLKTVVIDITVIPFADDFFCPGAPAGVEISPAADGPSPEGPIAEPDGESDGEEEVEPPGANDGETVGEFETGDEDLGAIDPGGEVIGAEDGGIVEDDLGAIGAGGEVIGAEDGETGDVDLGGAGGEVVGETGEL

SEQ ID NO: 5033 - protein, 149 aa, Homo sapiens
MNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQM

SEQ ID NO: 5034 - protein, 75 aa, Homo sapiens
  UNSURE 68: Xaa = Glu,Gly
MEEAIQKAEENKRLKELQLKQEEKLAMELAKLKHESLKDEKMRQQVRENSIELRELEKKLKAAYMNKXRAAQIAE

SEQ ID NO: 5035 - protein, 105 aa, Homo sapiens
MEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCA

SEQ ID NO: 5036 - protein, 50 aa, Homo sapiens
  UNSURE 2: Xaa = Ala,Pro
  UNSURE 6: Xaa = His,Leu,Pro,Arg
  UNSURE 14: Xaa = Leu,Val
MXRYYXTEDVPRKXLSHGKKPFSQHVRKTASQHYPRDHSDHPHWTPQGAR

SEQ ID NO: 5037 - protein, 60 aa, Homo sapiens
  UNSURE 58: Xaa = Lys,Arg
MEFQKDVQLKVKTYLLGTDLSIFKYDDFIFVLDIISRLMQVGEEFCGNKSEVLQESIXKQ

SEQ ID NO: 5038 - protein, 139 aa, Homo sapiens
MSVQSERPGGNKKISVFTSKMQSRQMGISGKNMTKSTSISGDMCSLEKNDGSQSDTAVGTLGTSGKKRRSSLGAKMVAIVGLSRKSRRASQLSQTEAGGKKLRSTVQRSTETGLAVEMRNWMTRQASRESTDGSMNSYS

SEQ ID NO: 5039 - protein, 188 aa, Homo sapiens
MSSKKKQDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRVKNVLKSHQAHQRHLYDERNLEKDDELELKRSLLCRDSAYDSDPEYSSCQ

SEQ ID NO: 5040 - protein, 121 aa, Homo sapiens
MERHTSHPNRKVPAKEEANAVPLCRAKPSPSYINLQASSPPATFLNIQTTKLPSVDHKPKECLGLLECMYANLQLQTQLAQQQMAVLEHLQASVTQLAPGRGSNNSSLPALSPNPLLNHLH

SEQ ID NO: 5041 - protein, 196 aa, Homo sapiens
MLRVAWRTLSLIRTRAVTQVLVPGLPGGGSAKFPFNQWGLQPRSLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEHLEKHRKDKAHKRYLLMSIDQRKKMLKNLRNTNYDVFEKICWGLGIEYTFPPLYY

SEQ ID NO: 5042 - protein, 153 aa, Homo sapiens
MNEVKESLRSIEQKYKLFQQQQLTFTAALEHCRENAHDKIRPISSIGQVQSYMEHYCNSSTDRRVLLMFLDICSELNKLCQHFEAVHSGTPVTNNLLEKCKTLVSQSNDLSSLRAKYPHDVVNHLSCDEARNHYGGVVSLIPLILDLMKEWIA

SEQ ID NO: 5043 - protein, 135 aa, Homo sapiens
  UNSURE 122: Xaa = Ser,Thr
MGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGXPLGVQDEKRDAEL

SEQ ID NO: 5044 - protein, 51 aa, Homo sapiens
  UNSURE 49: Xaa =  * ,Glu
  UNSURE 22: Xaa = Asp,Glu
MIKTTILLSSIQVLMSILKRRXLKKFCRNCFLHHISKDLLRISEVPRVXRS

SEQ ID NO: 5045 - protein, 175 aa, Homo sapiens
MLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKFEAFEHENKFYINPGSATGAYNALETNIIPSFVLMDIQASTVVTYVYQLIGDDVKVE

SEQ ID NO: 5046 - protein, 90 aa, Homo sapiens
  UNSURE 9: Xaa =  * ,Ser
  UNSURE 56: Xaa = Ala,Thr
MMRKAIRGXPGKQPQLWRNWLPHIRGNVGFVFTKEDLTEIRDMLLANKVRSCCPVXGAIAPCEVTVPAPEHWVSGPRERPPFFQALGITT

SEQ ID NO: 5047 - protein, 158 aa, Homo sapiens
  UNSURE 19,140: Xaa =  * ,Glu
MAGKKNVLSSLAVYAEDSXPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSNHLQDKIQKLYXRKIKEGMDMNYIIQKEER

SEQ ID NO: 5048 - protein, 65 aa, Homo sapiens
  UNSURE 32: Xaa = Asn,Thr
  UNSURE 15: Xaa = Glu,Gln
  UNSURE 19: Xaa = Ser,Thr
MPASLKTPATEEGNXHENXASSSRCPMTSPCXLQPINDLHTWDHSKTLKNLRLKVLLETNLRVPP

SEQ ID NO: 5049 - protein, 61 aa, Homo sapiens
MREAETEPHEGKRKVESLWPIFRIHHQKTRYIFDLFYKRKAISRELYEYCIKEGYAGQKPW

SEQ ID NO: 5050 - protein, 168 aa, Homo sapiens
  UNSURE 154: Xaa = Ser,Thr
MASSASARTPAGKRVINQEELRRLMKEKQRLSTSRKRIESPFAKYNRLGQLSCALCNTPVKSELLWQTHVLGKQHREKVAELKGAKEASQGSSASSAPQSVKRKAPDADDQDVKRAKATLVPQVQPSTSAWTTNFDKIGKEFIRATPSKPSGLXLLPIMKMRRRRKRR

SEQ ID NO: 5051 - protein, 61 aa, Homo sapiens
MLTVRVCSFIFVSQTKNLIVAVGELCVLCSYWCECKFSVEGQQCLLTLRECGVAEPGLHTR

SEQ ID NO: 5052 - protein, 74 aa, Homo sapiens
  UNSURE 70: Xaa = Cys,Phe
MDRRQNTYIMDKGFKDYMKESVCSSSTCSLNSSENPYATIKDPPILTCKLPESSYVEMKSPVHMGSRTQXASLS

SEQ ID NO: 5053 - protein, 95 aa, Homo sapiens
MALDILAMAPLYQAPAINRIGPKTDPSKRPADPLKPLVLSRTKLTTIEAKRIMSILDEAIYKVELVTLLSYVASNREDMEGMLGEDVMRAVREHE

SEQ ID NO: 5054 - protein, 135 aa, Homo sapiens
MPYKWNNTASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTSSDSISRMAS

SEQ ID NO: 5055 - protein, 117 aa, Homo sapiens
  UNSURE 95: Xaa = Glu,Gly
  UNSURE 106: Xaa = Glu,Lys
MDLGKDQSHLKHHQTPDPHQEENHSPEVIGTWSLRNRELLRKRKAEVHEKETSQWLFGEQKKRKQQRTGKGNRRGRKRQQNTELKVEPQPQIEKXIVEKALAPIEXKTEPPGSITKV

SEQ ID NO: 5056 - protein, 156 aa, Homo sapiens
  UNSURE 130: Xaa = Asp,Gly
  UNSURE 146: Xaa = Glu,Gly
MPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDXDITHVEGSVDPIRDIXIIHEELHLKM

SEQ ID NO: 5057 - protein, 144 aa, Homo sapiens
  UNSURE 135: Xaa = Leu,Arg
MSVAGGEIRGDTGGEDTAAPGRFSFSPEPTLEDIRRLHAEFAAERDWEQFHQPRNLLLALVGEVGELAELFQWKTDGEPGPQGWSPRERAALQEELSDVLIYLVALAARCRVDLPLAVLSKMDINRRRYPAHLAXSSSRKYTEL

SEQ ID NO: 5058 - protein, 123 aa, Homo sapiens
  UNSURE 40: Xaa = Phe,Leu
MASVLNVKESKAPERTVVVAGLPVDLFSDQLLAVLVKSHXQDIKNEGGDVEDVIYPTRTKGVAYVIFKEKKVAENVIRQKKHWLARKTRHAELTVSLRVSHFGDKIFSSVNAILDLSVFGKEV

SEQ ID NO: 5059 - protein, 110 aa, Homo sapiens
MRHLTAENNQERALKAKLLSMQQARETAVQQYKKLEEEIQTLRVYYSLHKSLSQEENLKDQFNYTLSTYEEALKNRENIVSITQQQNEELATQLQQALTERANMELQLQQ

SEQ ID NO: 5060 - protein, 105 aa, Homo sapiens
  UNSURE 9: Xaa = His,Gln
  UNSURE 101: Xaa = Lys,Asn
MPGDKLQRXPARDSLMRHAKGLDQDTFKTCKEYLRPLKKFLRKLHLPRDLPQKKKLKYMKQSLVVLGDNSTPFCSITAKPGKSNTGERCSGGSSPSSRSWXKAAS

SEQ ID NO: 5061 - protein, 61 aa, Homo sapiens
  UNSURE 44: Xaa =  * ,Glu,Gln
MPGAAGRRCPDRSPPFGPDFGSSGVLMLLKPESTCPDPSLYDAXLCPVPEPKPCRGVASDP

SEQ ID NO: 5062 - protein, 56 aa, Homo sapiens
  UNSURE 51: Xaa =  * ,Glu,Lys,Gln
  UNSURE 8: Xaa = Asp,Glu
  UNSURE 52,54: Xaa = Ile,Lys,Arg,Thr
  UNSURE 10: Xaa = Lys,Asn
MLLTLEQXAXRQRLPMPSPERLDKVVDSMDALDKVVQEREDALRLLQTGQXXAXPG

SEQ ID NO: 5063 - protein, 130 aa, Homo sapiens
  UNSURE 107,108,122: Xaa = Leu,Pro
  UNSURE 111: Xaa = Lys,Asn
MVLRPQQFQFYQPQGIPSSPSAVVVEMGSKPALTGEPALTCISRGSEARIHSAASSLIMEDKEIPIKSEPLPKPPASAPPSILVKPENSRNGIEKQVKTVRFQNYSXXPTXHYTSHPTSGKXEQPATLKA

SEQ ID NO: 5064 - protein, 53 aa, Homo sapiens
MVLRPQQFQFYQPQGIPSSPSAVVVEMGSKPALTGEPALTCISRGSEAGIHSA

SEQ ID NO: 5065 - protein, 55 aa, Homo sapiens
MDPCRDPSVRDPHSRGRLPQTQPHHGPSASAVPILPATGDPLLPLSRGGGDGVKP

SEQ ID NO: 5066 - protein, 92 aa, Homo sapiens
MANIAVQRIKREFKEVLKSEETSKNQIKVDLVDENFTELRGEIAGPPDTPYEGGRYQLEIKIPETYPFNPPKVRLSLKYGILILVPSQGLFV

SEQ ID NO: 5067 - protein, 164 aa, Homo sapiens
MASGSGTKNLDFRRKWDKDEYEKLAEKRLTEEREKKDGKPVQPVKRELLRHRDYKVDLESKLGKTIVITKTTPQSEMGGYYCNVCDCVVKDSINFLDHINGKKHQRNLGMSMRVERSTLDQVKKRFEVNKKKMEEKQKDYDFEERMKELREEEEKAKAYKKEKQ

SEQ ID NO: 5068 - protein, 100 aa, Homo sapiens
MLTLPFDESVVMPESQMCRKFSRECEDQKQIKKPESFSKQIVLRGKSIKRAPGEETEKEEEEEDREEEDENGLPRRRGLRKKKTTKLRLERVKFRRQESE

SEQ ID NO: 5069 - protein, 110 aa, Homo sapiens
MLTLPFDESVVMPESQMCRKFSRECEDQKQIKKPESFSKQIVLRGKSIKRAPGEETEKEEEEEDREEEDENGLPRRRGLRKKKTTKLRLERVKFRRQEANARERNRMHGL

SEQ ID NO: 5070 - protein, 109 aa, Homo sapiens
  UNSURE 65: Xaa =  * ,Glu
  UNSURE 92: Xaa = Phe,Ile
MGIVYTGSWKDDKMNGFGRLEHFSGAVYEGQFKDNMFHGLGDFTTFPKWGKVYWKISMKIGLKCXMGIYLISKGLENGVVTFIFTAAPDLKXKASHVDVMLNLKLKCSN

SEQ ID NO: 5071 - protein, 63 aa, Homo sapiens
MADSGLDKKSTKCPDCSSASQKDVLCVCSSKTRVPPVLVVEMSQTSSIGSAESLISLERKKKK

SEQ ID NO: 5072 - protein, 62 aa, Homo sapiens
MNGFGRLEHFSGAVYEGQFKDNMFHGLGTYTFPNGAKYTGNFNENRVKGEGEYTDIQGLEWS

SEQ ID NO: 5073 - protein, 86 aa, Homo sapiens
  UNSURE 61,62: Xaa = Ala,Pro
  UNSURE 32: Xaa = Asp,His,Tyr
  UNSURE 77: Xaa = Lys,Asn
  UNSURE 83: Xaa = Pro,Arg
MPLNQKAKRELCIGWGDPSGLPRRSYRLLLLXQEGHIEHSRYLSLLDAVDNSKMALNSGSXXAIGPYYENHGYQPEXPYPAQXTVV

SEQ ID NO: 5074 - protein, 59 aa, Homo sapiens
MIISTPQRLTSSGSVLIGSPYTPAPAMVTQTHIAEAYMAGSLVIENGLEKFIDSDFSES

SEQ ID NO: 5075 - protein, 167 aa, Homo sapiens
  UNSURE 103: Xaa = Gly,Val
MVPRSCLAVPAAGARNQFIPARPGAGAFEGARSLCCRSSPRDLRDGEREHEAAQRKAPGAESCPSLPLSISDIGTGCLSSLENLRLPTLREESSPRELEDSSXDQGRCGPTHQGSEDPSMLSQAQSATEVEERHVSPSCSTSRERPFQAGELILAETGEGRNKNLRN

SEQ ID NO: 5076 - protein, 134 aa, Homo sapiens
MVQYLKSVDIPENRVILITPTPLCETAWEEQCIIQGCKLNRLNSVVGEYANACLQVAQDCGTDVLDLWTLMQDSQDFSSYLSDGLHLSPKGNEFLFSHLWPLIEKKVSSLPLLLPYWRDVAEAKPELSLLGDGD

SEQ ID NO: 5077 - protein, 50 aa, Homo sapiens
MRRRLNKHEENLKTKKQQRRSGCTRCGSTRSRPEGRIVNKAQLADKKKKK

SEQ ID NO: 5078 - protein, 63 aa, Homo sapiens
MNGFGRLEHFSGAVYEGQFKDNMFHGLGTYTFPNGAKYTGNFNENRVKGEGEYTDIQGLEWSG

SEQ ID NO: 5079 - protein, 62 aa, Homo sapiens
  UNSURE 61: Xaa =  * ,Leu,Ser,Trp
MNGFGRLEHFSGAVYEGQFKDNMFHGLGTYTFPNGAKYTGNFNENRVKGEWEYTDIQGLEXS

SEQ ID NO: 5080 - protein, 62 aa, Homo sapiens
MNGFGRLEHFSGAVYEGQFKDNMFHGLGTYTFPNGAKYTGNFNENRVEGEGEYTDIQGLEWS

SEQ ID NO: 5081 - protein, 153 aa, Homo sapiens
MAAAEVADTQLMLGVGLIEKDTNGEVLWVWCYPSTTATLRNLLLRKCCLTDENKLLHPFVFGQYRRTWFYITTIEVPDSSILKKVTHFSIVLTAKDFNPEKYAAFTRILCRMYLKHGSPVKMMESYIAVLTKGICQSEENGSFLSKDFDAERP

SEQ ID NO: 5082 - protein, 62 aa, Homo sapiens
  UNSURE 50: Xaa =  * ,Glu,Lys,Gln
  UNSURE 58: Xaa =  * ,Gly,Arg
  UNSURE 51: Xaa = Gly,Arg,Trp
MNGFGRLEHFSGAVYEGQFKDNMFHGLGTYTFPNGAKYTGNFNENRVEGXXEYTDIQXLEWS

SEQ ID NO: 5083 - protein, 67 aa, Homo sapiens
  UNSURE 13: Xaa = Lys,Met,Arg,Thr
MEETPLLTGMLMXENGEQEADNEVDEEEEEGGEEEEEEEEGDGEEEDGDEDEEAESATGKRAAEDDE

SEQ ID NO: 5084 - protein, 66 aa, Homo sapiens
  UNSURE 63: Xaa = Leu,Val
MEETPLLTGMLMRENGEQEADNEVDEEEEEGGEEEEEEEEGDGEEEDGDEDEEAESATGKRAXKMM

SEQ ID NO: 5085 - protein, 55 aa, Homo sapiens
  UNSURE 29: Xaa = Ala,Gly,Pro,Arg
  UNSURE 44: Xaa = Asp,Glu
  UNSURE 49: Xaa = Ile,Asn,Ser,Thr
MSDAAVDTSSEITTKDLKEKKEVVEAENXRDAPANGNANEENGXQDADXEVDEEE

SEQ ID NO: 5086 - protein, 50 aa, Homo sapiens
  UNSURE 21: Xaa = Ala,Pro
  UNSURE 10: Xaa = His,Gln
  UNSURE 33: Xaa = Ile,Met
MAANLSRNGXRCKRPTCGWSXRSPRPTGLSLPXKATAMTSAWLAQGMVAW

SEQ ID NO: 5087 - protein, 65 aa, Homo sapiens
  UNSURE 13: Xaa = Lys,Met,Arg,Thr
MEETPLLTGMLMXENGEQEADNEVDEEEEEGGEEEEEEEEGDGEEEDGDEDEEAESATGKRAAED

SEQ ID NO: 5088 - protein, 139 aa, Homo sapiens
  UNSURE 104: Xaa = Ala,Asp
  UNSURE 114: Xaa = Ile,Ser
MNKKKVFEEPSISLFALEHCEGRELHLEEAVNSVLNKDLHFYTQSVWVKSGLWIAYEGSNFLGRQILLRPNEIPNWTAFSRWKTIGSLRPMKQPAVYIRIKNRXQGEYLTVTGXLADTRATSVCISPYSGKHTQIWYYC

SEQ ID NO: 5089 - protein, 157 aa, Homo sapiens
MAATKTASYDEHFRPEKLREWPEPESVSLMEVLAREDIDEAVCAILFKENSIVKRLDMYFQHVDTFKERRKEMLHKKWVENVAEPLQQRIMEKVISYKELKMKQENVEYYLQHRHKMVTVPPFVDPLFQRQQEVDEERRTGLQCETGKRHSIKELEE

SEQ ID NO: 5090 - protein, 134 aa, Homo sapiens
MSAQAQMRALLDQLMGTARDGDETRQRVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIG

SEQ ID NO: 5091 - protein, 152 aa, Homo sapiens
  UNSURE 141: Xaa = Glu,Lys
MAVLLETTLGDVVIDLYTEERPRACLNFLKLCKIKYYNYCLIHNVQRDFIIQTGDPTGTGRGGESIFGQLYGDQASFFEAEKVPRIKHKKKGTVSMVNNGSDQHGSQFLITTGENLDYLDGVHTVFGEVTEGMDIIKKINXTFVDKDFCTIS

SEQ ID NO: 5092 - protein, 54 aa, Homo sapiens
  UNSURE 52,53: Xaa =  * ,Lys
  UNSURE 23: Xaa = Ala,Asp
  UNSURE 43: Xaa = Glu,Gln
MDQEPVGGVERGEAVAASGAAAXAAFGESAGQMSNERGFENVXLGVIGKKKXXK

SEQ ID NO: 5093 - protein, 68 aa, Homo sapiens
MKGDTVNVRRSVRVKTKVPWMPPGKSSARPVGCKWENPPHCLEITPPSSEKLVSVMRLSDLSTEDDDS

SEQ ID NO: 5094 - protein, 144 aa, Homo sapiens
  UNSURE 9: Xaa = Ile,Ser
MPLQVSDYXWQQTKTAVFLSLPLKGVCVRDTDVFCTENYLKVNFPPFLFEAFLYAPIDDESSKAKIGNDTIVFTLYKKEAAMWETLSVTGVDKEMMQRIREKSILQAQERAKEATEAKAAAKREDQKYALSVMMKIEEEERKKI

SEQ ID NO: 5095 - protein, 59 aa, Homo sapiens
  UNSURE 14: Xaa = Cys,Gly,Arg,Ser
  UNSURE 10: Xaa = Leu,Val
MISSHCNLHXPDSXDSPLSASQVAGITGIHYHAWLIFVFLVETGFHHVGPGWSPTPELQ

SEQ ID NO: 5096 - protein, 124 aa, Homo sapiens
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYFDSDSEDEDRAVQVTKKK

SEQ ID NO: 5097 - protein, 127 aa, Homo sapiens
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYFDSDSEDEDRAVQVTKKKKKK

SEQ ID NO: 5098 - protein, 144 aa, Homo sapiens
  UNSURE 111: Xaa =  * ,Ile,Lys,Leu
  UNSURE 125: Xaa =  * ,Ile,Lys,Leu,Met
  UNSURE 120: Xaa =  * ,Phe,His,Leu,Gln,Tyr
  UNSURE 113: Xaa =  * ,Phe,Ile,Lys,Leu,Asn,Tyr
  UNSURE 119: Xaa =  * ,Phe,Leu,Tyr
  UNSURE 117: Xaa = Ala,Asp,Glu,His,Pro,Gln
  UNSURE 127: Xaa = Asp,Asn
  UNSURE 116: Xaa = Asp,Glu,Ile,Lys,Met,Asn,Val
  UNSURE 126: Xaa = Glu,Gly,Lys,Arg
  UNSURE 112: Xaa = His,Lys,Asn,Pro,Gln,Thr
  UNSURE 124: Xaa = Ile,Lys,Asn
  UNSURE 115: Xaa = Ile,Lys,Met,Asn
  UNSURE 121: Xaa = Lys,Gln
  UNSURE 118: Xaa = Phe,Ile,Asn,Tyr
  UNSURE 123: Xaa = Phe,Leu
MYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRXXXKXXXXXXXGXXXXXYIQRPLVSSLYDGSMTI

SEQ ID NO: 5099 - protein, 146 aa, Homo sapiens
MRQPYLSSREVSSSRKRWRTFPVDCVAMCGDCVEKEYPNRGNTCLENGSFLLNFTGCAVCSKRDFMLITNKSLKEEDGEEIVTYDHLCKNCHHVIARHEYTFSIMDEFQDKIKGTLRRRVCHFLGEKRSFQCLSSCQAEETKLCLS

SEQ ID NO: 5100 - protein, 87 aa, Homo sapiens
  UNSURE 77: Xaa = Gly,Arg
MRLSRCWENGEEESQNRWINLVDELHLPSSQTEIWSPRLFRAGLCWSPSHRRKCVEEVEAAVVPDAGRSPLMLSTRXRAVHRRTSAK

SEQ ID NO: 5101 - protein, 58 aa, Homo sapiens
  UNSURE 58: Xaa = Leu,Pro
MTEWETAAPAVAETPDIKLFGKWSTDDVQINDISLQDYIAVKEKYAKYLPHSAGRYAX

SEQ ID NO: 5102 - protein, 53 aa, Homo sapiens
MGDNPFQPKSNSKMAELFMECEEEELEPWQKKVKEVEDDDDDEPIFVGEISSS

SEQ ID NO: 5103 - protein, 93 aa, Homo sapiens
MQKPCKENEGKPKCSVPKREEKRPYGEFERQQTEGNFRQRLLQSLEEFKEDIDYRHFKDEEMTREGDEMERCLEEIRGLRKKFRALHSNHRHS

SEQ ID NO: 5104 - protein, 85 aa, Homo sapiens
MDLVLRPSFERCLPCTWRKETSLSLKTQGHREESEQTGFTNFPQLLPLDQTFVQSYPSTSCPLINPKHKNAQVSLFVWVFISKGS

SEQ ID NO: 5105 - protein, 84 aa, Homo sapiens
MCDKEFMWALKNGDLDEVKDYVAKGEDVNRTLEGGRKPLHYAADCGQLEILEFLLLKGADINAPDKHHITPLLSAVYEGHVSCV

SEQ ID NO: 5106 - protein, 134 aa, Homo sapiens
MSKLGRAARGLRKPEVGGVIRAIVRAGLAMPGPPLGPVLGQRGVSINQFCKEFNERTKDIKEGIPLPTKILVKPDRTFEIKIGQPTVSYFLKAAAGIEKGARQTGKEVAGLVTLKHVYEIARIKAQDEAFACRM

SEQ ID NO: 5107 - protein, 79 aa, Homo sapiens
MDKIFSHFCHIYIFKEKRFFSVRKFWLCCFKGDLSGVETSLPDSILKVNGLPSLFRFCVPIVRHFGVLEPLYICGKPGQ

SEQ ID NO: 5108 - protein, 157 aa, Homo sapiens
  UNSURE 146: Xaa = Glu,Gly
MRIEKCYFCSGPIYPGHGMMFVRNDCKVFRFCKSKCHKNFKKKRNPRKVRWTKAFRKAAGKELTVDNSFEFEKRRNEPIKYQRELWNKTIDAMKRVEEIKQKRQAKFIMNRLKKNKELQKVQDIKEVKQNIHLIRAPLAGKGKQLXEKMVQQLQEDV

SEQ ID NO: 5109 - protein, 82 aa, Homo sapiens
  UNSURE 75: Xaa = Ala,Pro
MVHAFLIHTLRAPNTEDTGLCRVLYSCVFGAEKSPDDPRPHDAERDRLLRKEQILAVARQVESMCRLQQQASGRXPMDLQPQ

SEQ ID NO: 5110 - protein, 168 aa, Homo sapiens
  UNSURE 85: Xaa = His,Arg
MSIAAALELTGRSQFLQTHGRITWHDGSGSLHDIQLSLPSSPEPEDGDKVYKNEDLLNEIKQLKDEIKKKDEKIQLLELQLATQXICHQKCKEEKCTYADKYTQTPWRRIPPQVLQPSSSLPRPTDHTQGKLIKPQRIEARSECSIQDMHQGGAHPEESFTHVLHQES

SEQ ID NO: 5111 - protein, 176 aa, Homo sapiens
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGLPWSRGLNPITTTAISSTTFLMPMVLLPL

SEQ ID NO: 5112 - protein, 150 aa, Homo sapiens
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILPKSVGDLPWSRGLNPITTT

SEQ ID NO: 5113 - protein, 163 aa, Homo sapiens
  UNSURE 148: Xaa = His,Pro
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENRCCLPDFIQRIILQAHICQSQWGTSLEQRFESYYNYCNLFNYILNADGPAXLELPNQWLWDIIDEF

SEQ ID NO: 5114 - protein, 161 aa, Homo sapiens
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGLPWSRGLNPITNLL

SEQ ID NO: 5115 - protein, 160 aa, Homo sapiens
MSYPADDYESVAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGPSLEQRFESYYTT

SEQ ID NO: 5116 - protein, 149 aa, Homo sapiens
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGLP

SEQ ID NO: 5117 - protein, 150 aa, Homo sapiens
  UNSURE 134: Xaa = Asp,Glu
  UNSURE 66: Xaa = Leu,Met
MSYPADDYESEAAYDPYAYPSDYDMHTGDPKQDLAYERQYEQQTYQVIPEVIKNFIQYFHKTVSDXIDQKVYELQASRVSSDVIDQKVYEIQDIYENSWTKLTERFFKNTPWPEAEAIAPQVGNDAVFLILYKXLYYRHIYAKVSGGLPF

SEQ ID NO: 5118 - protein, 122 aa, Homo sapiens
MSQFLNEMQETKKGVVTPKELFSQVCKKAVRFKGYQQQDSQELLRYLLDGMRAEEHQRVSKGILKAFGNSTEKLDEELKNKVKDYEKKKSMPSFVDRIFGGELTSMIMCDQCRTVSLVHESF

SEQ ID NO: 5119 - protein, 67 aa, Homo sapiens
MINAELSPWFMNLSLICPSPVLDDQSGKKSVNDKNLKKTVEDEDQDSEEEKDNDSYIKERSDIPSGT

SEQ ID NO: 5120 - protein, 144 aa, Homo sapiens
MTTAARPTFEPARGGRGKGEGDLSQLSKQYSSRDLPSHTKIKYRQTTQDAPEEVRNRDFRRELEERERAAAREKNRDRPTREHTTSSSVSKKPRLDQIPAANLDADDPLTDEEDEDFEEESDDDDTAALLAELEKIKKERAEEQ

SEQ ID NO: 5121 - protein, 135 aa, Homo sapiens
MAREWRAAQGKDPGPSEKQKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHT

SEQ ID NO: 5122 - protein, 117 aa, Homo sapiens
  UNSURE 97: Xaa = Ala,Gly
  UNSURE 98: Xaa = Arg,Thr
  UNSURE 99: Xaa = Glu,Gln
MIFTQSSEKTAVSCLSQNDWKLDVATDNFFQNPELYIRESVKGSLDRKKLEQLYNRYKDPQDENKIGIDGIQQFCDDLALDPASISVLIIAWKFRAXXXCEFSKQEFMDGMKELGCD

SEQ ID NO: 5123 - protein, 103 aa, Homo sapiens
  UNSURE 102: Xaa = Ala,Gly
MDGMTELGCDSIEKLKAQIPKMEQELKEPGRFKDFYQFTFNFAKNPGQKGLDLEMAIAYWNLVLNGRFKFLDLWNKFLLEHHKRSIPKDTWNLLLDFSTMIXD

SEQ ID NO: 5124 - protein, 141 aa, Homo sapiens
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPRTSNVRSTFFKDCLYEVFDDLESRWKIW

SEQ ID NO: 5125 - protein, 127 aa, Homo sapiens
  UNSURE 123: Xaa = Ala,Gly
MCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEXSGFC

SEQ ID NO: 5126 - protein, 50 aa, Homo sapiens
  UNSURE 37: Xaa = Ala,Asp,Gly
MCFLITMQLKLKLTTKGNLENSQILEIRQHTAKYLLXQRRNHNRFFFFFF

SEQ ID NO: 5127 - protein, 75 aa, Homo sapiens
  UNSURE 62: Xaa = Gly,Ser
  UNSURE 69: Xaa = Ile,Thr
MAEVGNDCYFFFNSTCIKGSQCRFRHCEEALGSDTVCSLWRERKCLDPLCRFRHMEMQQNCXISCFWEXQPLGCV

SEQ ID NO: 5128 - protein, 141 aa, Homo sapiens
  UNSURE 124: Xaa = Glu,Gly
  UNSURE 131: Xaa = His,Leu,Pro,Arg
MEMQQNCSISCFWETQPLGCVKISCIFYHSKPRNINGLFLPPSSNITLQKEIQEGIPLQSQSQEPLKPQENISRPIHHPLVLKTNFEEEEEVDEQNDASSLWTKTPEEIEEKRAIKEMCYKSGXYYRFHTXPDILSSKSMT

SEQ ID NO: 5129 - protein, 153 aa, Homo sapiens
MVDYYEVLGLQRYASPEDIKKAYHKVALKWHPDKNPENKEEAERKFKEVAEAYEVLSNDEKRDIYDKYGTEGLNGGGSHFDDECEYGFTFHKPDDVFKEIFHERDPFSFHFFEDSLEDLLNRPGSSYGNRNRDAGYFFSLPVNIQFLRNFLHM

SEQ ID NO: 5130 - protein, 114 aa, Homo sapiens
MESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCY

SEQ ID NO: 5131 - protein, 51 aa, Homo sapiens
MAKKLFHDMNVNYKVVELDLLEYGNQFQDALYKMTGERTVPRIFVNGTFIG

SEQ ID NO: 5132 - protein, 94 aa, Homo sapiens
MESNTSSSLENLATAPVNQIQETISDNCVVIFSKTSCSYCTMAKKLFHDMNVNYKVVELDLLEYGNQFQDALYKMTGERTVPRIFVNGTFIGGA

SEQ ID NO: 5133 - protein, 131 aa, Homo sapiens
MKCVFVTVGPPALTTSLRVCRRPTVCKYKDSLKEDIQKADLVISHAGAGSCLETLEKGKPLVVVINEKLMNNHQLELAKQLHKEGHLFYCTCRVLTCPGQAKSIASAPGKCQDSAALTSTAFSGLDFGLLS

SEQ ID NO: 5134 - protein, 65 aa, Homo sapiens
  UNSURE 38: Xaa = Cys,Phe,Ser,Tyr
  UNSURE 10: Xaa = Gly,Val
MMRPMLRCVXDLQTIQVIKILKYEKKLAKMCFLMIFTXLVCWMPYIVICFLVVNGHGHLVTPTIS

SEQ ID NO: 5135 - protein, 105 aa, Homo sapiens
  UNSURE 46: Xaa =  * ,Glu,Lys,Gln
MSTLFPSLFPRVTETLWFNLDRPCVEETELQQQEQQHQAWLQSIAXKDNNLVPIGKPASEHYDDEEEEDDEDDEDSEEDSEDDEDMQDMDEMNDYNESPDDGEVN

SEQ ID NO: 5136 - protein, 137 aa, Homo sapiens
MLDVDLPEDAPLENVECDNMNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDG

SEQ ID NO: 5137 - protein, 131 aa, Homo sapiens
  UNSURE 124: Xaa = His,Gln
MLDVDLPEDAPLENVECDNMNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTXLLKLKRL

SEQ ID NO: 5138 - protein, 118 aa, Homo sapiens
  UNSURE 93: Xaa = Gly,Arg,Trp
  UNSURE 95: Xaa = Ile,Met
MNRFDRPDRNVRQPQEGFWKRPPQRRSGQEHYHLSHPDHYHHHGKSDMSRGSPYRESPLGHFESYGGMPFFQAQKMFVDVPENTVILDEMTLXHXVQDCTAVKTQLLKLKRLLHQHDG

SEQ ID NO: 5139 - protein, 51 aa, Homo sapiens
MAPYFLQQRDTLRRHVQKQEAENQQLADAVLAGRRQVEELQLQVQAQQQAW

SEQ ID NO: 5140 - protein, 82 aa, Homo sapiens
MLGKGGGRAGLLRYRLLYFTLVVGEGEPGENKVTIPFFETGKKIIFCSVKMVENSNVPSHKGPVPLRSEQWELKISETLGDG

SEQ ID NO: 5141 - protein, 62 aa, Homo sapiens
MKQRLRQLDKHSQATAQQLVQLLSKQNQLLLERQSCRKRWTGCGPSYPACHNLIADLDGNRV

SEQ ID NO: 5142 - protein, 133 aa, Homo sapiens
MGKEIQLKPKANVSSYVHFLLNYRNKFKEQQPNTYVGFKEFSRKCSEKWRSISKHEKAKYEALAKLDKARYQEEMMNYVGKRKKRRKRDPQAPRRPPSSFLLFCQDHYAQLKRENPNWSVVQVAKATGEDVVN

SEQ ID NO: 5143 - protein, 81 aa, Homo sapiens
MELESENLNLKSKMKPLIFTTQSLIQKVETYEKQLKNLVEEKSTIQSKLSKTEEDSKECLKEFKKIISKYNVLQGQNKTLE

SEQ ID NO: 5144 - protein, 157 aa, Homo sapiens
  UNSURE 32: Xaa = Gln,Arg
MLATLARVAALRRTCLFSGRGGGRGLWTGRPXSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHITD

SEQ ID NO: 5145 - protein, 114 aa, Homo sapiens
  UNSURE 94: Xaa = Leu,Val
MGEKPVGSLAGIGEVLGKKLEERGFDKAYVVLGQFLVLKKDEDLFREWLKDTCGANASSPGTASDAFESGATPSCDALWEALNPQPSSRVCSRXGTPPLSSTKEKIAIVVLTFR

SEQ ID NO: 5146 - protein, 94 aa, Homo sapiens
MSSPTKEGSDTAGNAHKNSENEPPNDCSTDIESPSADPNMIYQVETNPINREPGTATSQEDVVPQAAENSELETEIQKDQREEDLKEELLLLQT

SEQ ID NO: 5147 - protein, 118 aa, Homo sapiens
MAAARPSLGRVLPGSSVLFLCDMQEKFRHNIAYFPQIVSVAARMLKNTTLDLLDRGLQVHVVVDACSSRSQVDRLVALARMRQSGAFLSTSEGLILQLVGDASTPSSRRSRNSSRSPP

SEQ ID NO: 5148 - protein, 119 aa, Homo sapiens
MGEKPVGSLAGIGEVLGKKLEERGFDKAYVVLGQFLVLKKDEDLFREWLKDTCGANASSPGTASDAFESGATPSCDALWEALNPQPSSRVCSRVGTPPLSSTKEKIAIVVLTSDVLRGS

SEQ ID NO: 5149 - protein, 110 aa, Homo sapiens
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHE

SEQ ID NO: 5150 - protein, 78 aa, Homo sapiens
MERYSLPTLNYSNYSKTSNLSPTGLKRRMRDKEKSCLAASAVYRLKKIHPAEPSLDQLTSPISLYEINAYCYVKKKKK

SEQ ID NO: 5151 - protein, 50 aa, Homo sapiens
  UNSURE 5: Xaa = Gly,Arg
MLERXKAKIKKHPPQKEKEQYIKPKQSRKKKIIKIRTEVNKIKNILTKER

SEQ ID NO: 5152 - protein, 99 aa, Homo sapiens
MTWRMPKRKARRMSRSSPLGATAANQKRITTPYMTKYERARVLGTRALQIAMCAPVMVELEGETDPLLIAMKELKARKIPIIIRRYLPDGSYEDWGVDE

SEQ ID NO: 5153 - protein, 77 aa, Homo sapiens
MEQHTCSLPAFIFLPCWILPALEHRTPSSSAFDSWTYTSGLPGALGAFDHSLKATLSASLFLRFEDSNWLPCPSACD

SEQ ID NO: 5154 - protein, 99 aa, Homo sapiens
  UNSURE 32: Xaa =  * ,Lys,Leu,Met
  UNSURE 26: Xaa = Asp,Glu
  UNSURE 70,78: Xaa = His,Gln
  UNSURE 27: Xaa = Leu,Val
MATVMAATAAERAVLEEEFRWLLHDXXHAVLXQLQDILKEASLRFTLPGSGTEGPAKQENFILGSCGTDXVKGVLTLXGDALSQADVNLKMPRNNQLLH

SEQ ID NO: 5155 - protein, 114 aa, Homo sapiens
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLML

SEQ ID NO: 5156 - protein, 84 aa, Homo sapiens
MEEEGKAQPMAAPEGKRSLANGPNAGEQPGQVAGADFESEDEGEEFDDWEDDYDYPEEEQLSGCRLQEYQPLLKKPTRMFLRNK

SEQ ID NO: 5157 - protein, 58 aa, Homo sapiens
MGSRVSREDFEWVYTDQPHADRRREILAKYPEIKSLMKPDPNLIWIIIMMVLTQLGAF

SEQ ID NO: 5158 - protein, 151 aa, Homo sapiens
  UNSURE 74: Xaa = Cys,Gly
  UNSURE 93: Xaa = Gly,Ser
MHKAGLLGLCARAWNSVRMASSGMTRRDPLANKVALVTASTDGIRLRHRPAFGPGRGPCGRQHPEAAECGPGGXHAAGGGAERDGHRVPCGEXGGPGAAGGHGCEASWRFDILVSNAAVNPFFGSIMDVTEEVWDKTLDINVKAQPDDKAV

SEQ ID NO: 5159 - protein, 65 aa, Homo sapiens
MADAFGDELFSVFEGDSTTAAGTKKDKEKDKGKWKGPPGSADKAGKRFDGKLQSESTNNGKKKKK

SEQ ID NO: 5160 - protein, 175 aa, Homo sapiens
MTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTPYCRVGLGICYDMRFAELAQIYAQRGCQLLVY

SEQ ID NO: 5161 - protein, 54 aa, Homo sapiens
MFEVCFESKGTGRIPDQLVILDMKHGVEAKNYEEIAKVEKLKPLEVELRRLRRP

SEQ ID NO: 5162 - protein, 120 aa, Homo sapiens
  UNSURE 107: Xaa =  * ,Glu
  UNSURE 35: Xaa = Asp,Glu
MAPEWLGPAQELPQGSHRPWRCGGSPHLPVLHHAXCPPPGGSWGSGRSSPLLGGNGKATMQNLNDRLASYLEKVRALEEANMKLESRILKWHQQRDPGSKKDYSQYXENITHLQEQIVDG

SEQ ID NO: 5163 - protein, 175 aa, Homo sapiens
MPSKSLVMEYLAHPSTLGLAVGVACGMCLGWSLRVCFGMLPKSKTSKTHTDTESEASILGDSGEYKMILVVRNDLKMGKGKVAAQCSHAAVSAYKQIQRRNPEMLKQWEYCGQPKVVVKAPDEETLIALLAHAKMLGLTVSLIQDAGRTQIAPGSQTVLGIGPGPADLIDKVTGH

SEQ ID NO: 5164 - protein, 69 aa, Homo sapiens
MLPENRTNLSSVHGILSFIQSSTRRAYQHIVDEMGENRRPVQYGRSAATTSNPHRDNIRYGTSNIDTSE

SEQ ID NO: 5165 - protein, 57 aa, Homo sapiens
MHQLMMTAESGRAEDPKSFPRLAENKLRSTMVDPAINLFFLKMKGELEQTKDKLEQA

SEQ ID NO: 5166 - protein, 126 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPV

SEQ ID NO: 5167 - protein, 86 aa, Homo sapiens
MDVEIQDTPGKISISKRSILSGTVENIDYPHYCDLLRKMNMSFVKGLENRHNYGRFEKKCNPAFLKFHPYPPSVLPDYHLHDPYPP

SEQ ID NO: 5168 - protein, 103 aa, Homo sapiens
  UNSURE 68: Xaa = Asp,Tyr
MAAAVAAAGAGEPQSPDELLPKGDAEKPEEELEEDDDEELDETLSERLWGLTEMFPERVRSAAGATFXLSLFVAQKMYRFSRAALWIGTTSFMILVLPRCLLR

SEQ ID NO: 5169 - protein, 96 aa, Homo sapiens
MISFQESVTFQDVAVDFTAEEWQLLDCAERTLYWDVMLENYRNLISVGCPITKTKVILKVEQGQEPWMVEGANPHESSPESRSVARLECSGAISAR

SEQ ID NO: 5170 - protein, 141 aa, Homo sapiens
MASPAASSVRPPRPKKEPQTLVIPKNAAEEQKLKLERLMKNPDKAVPIPEKMSEWAPRPPPEFVRDVMGSSAGAGSGEFHVYRHLRRREYQRQDYMDAMAEKQKLDAEFQKRLEKNKIAAEEQTAKRRKKRQKLKEKKLLA

SEQ ID NO: 5171 - protein, 158 aa, Homo sapiens
  UNSURE 152: Xaa = Ala,Thr
MAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGKKSRTQKEKKAARARSKGKTRMKXPPRLPR

SEQ ID NO: 5172 - protein, 83 aa, Homo sapiens
MGQGLWRVVRNQQLQQEGYSEQGYLTREQSRRMAASNISNTNHRKQVQGGIDIYHLLKARKSKEQEGFINLEMLPPELSFTIL

SEQ ID NO: 5173 - protein, 67 aa, Homo sapiens
MQLRQKLLVSRLCSGSFKSGYVSSQLEAQEPKSSESTLTSMEDSGCDLSNEQRTESSDLSQHFVESC

SEQ ID NO: 5174 - protein, 133 aa, Homo sapiens
  UNSURE 63: Xaa = Ile,Asn
MVFYFTSSSVNSSAYTIYMGKDKYENEDLIKHGWPEDIWFHVDKLSSAHVYLRLHKGENIEDXPKEVLMDCAHLVKANSIQGCKMNNVNVVYTPWSNLKKTADMDVGQIGFHRQKDVKIVTVEKKVNEILNRL

SEQ ID NO: 5175 - protein, 131 aa, Homo sapiens
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRVIISHVDFRENVFSSLLAILRHFVGTIDLFK

SEQ ID NO: 5176 - protein, 107 aa, Homo sapiens
MAAAAAETPEVLRECGCKGIRTCLICERQRGSDPPWELPPAKTYRFIYCSDTGWAVGTEESDFEGWAFPFPGVMLIEDFVTREEEAELVRLMDRDPWKLSQSGRRKQ

SEQ ID NO: 5177 - protein, 134 aa, Homo sapiens
  UNSURE 121: Xaa = Ala,Pro,Ser,Thr
  UNSURE 46: Xaa = Glu,Gln
MLAAVGRPKPRSPLSSLSTLQLYLFCSSTRRADMDPNTSGRPGAPXLRLRERQKFFEDILQPETEFVFPLSHLHLESQRPPIGSISSMEVNVDTLEQVELIDLGDPDAADVFLPCEDPPPXPQSSGNGQPFGGA

SEQ ID NO: 5178 - protein, 99 aa, Homo sapiens
  UNSURE 97: Xaa = Ile,Leu
MKTGLLMEEKLECSLWCCLSDPSIPGRCCVLERHIVPWMQQLHQQWKWLICGLCRLYNLPKHPNVEIPDQPLPMGQNGTTEEVTSKEEEEEEMDEDXED

SEQ ID NO: 5179 - protein, 153 aa, Homo sapiens
MDSAFVGIKVNQVSAAVGKDFTVIPSKLIQFDPGMSTKMWNIAITYDGLEEDDEVFEVILNSPVNAVLGTKTKAAVKILDSKGGQCHPSYSSNQSKHSTWEKGIWHLLPPGSSSSTTSGSFHLERRPLPSSMQLAVIRGDTLRALILQIFLKG

SEQ ID NO: 5180 - protein, 75 aa, Homo sapiens
MAALSCLLDSVRRDIKKVDRELRQLRCIDEFSTRCLCDLYMHPYCCCDLHPYPYCLCYSKRSRSCGLCDLYPCCL

SEQ ID NO: 5181 - protein, 78 aa, Homo sapiens
MVVEVPRWSNAKMEIATKDPLNPIKQDVKKGKLRYVANLFPYKGYIWELWCHPSDLGRPRHNDKHTGCCGDNDPIDVC

SEQ ID NO: 5182 - protein, 74 aa, Homo sapiens
MSKLRPKAVKQLAPDSVIFSPYLVRISVSILKIEKGEKKKKKKKKKKKKKKKKKKKKKKKKKKKKKKKKKKKKK

SEQ ID NO: 5183 - protein, 59 aa, Homo sapiens
  UNSURE 58: Xaa = Lys,Gln
MSKLRPKAVKQLAPDSVIFSPYLVRISVSILKIEKGEKKKKKKKKKKKKKKKKKKKKXK

SEQ ID NO: 5184 - protein, 71 aa, Homo sapiens
  UNSURE 70: Xaa = Asn,Thr
MSKLRPKAVKQLAPDSVIFSPYLVRISVSILKIEKGEKKKKKKKKKKKKKKKKKKKKKKKKKKKKKKKKXP

SEQ ID NO: 5185 - protein, 61 aa, Homo sapiens
  UNSURE 45: Xaa =  * ,Lys
  UNSURE 44: Xaa =  * ,Phe,Ile,Lys,Leu,Asn,Tyr
  UNSURE 43: Xaa = Lys,Asn
MSKLRPKAVKQLAPDSVIFSPYLVRISVSILKIEKGEKKKKKXXXKKKKKKKKKNKKKKKK

SEQ ID NO: 5186 - protein, 119 aa, Homo sapiens
MELKQSLSTHLEAEKPLRRYGAVEETAWKTERLGRNQLDIISMAETTMMPEEIELEMAKIQRLREVLVRRESELRFMMDDIQLCKDIMDLKQELQNLVAIPEKEKTKLQKQREDELSRR

SEQ ID NO: 5187 - protein, 91 aa, Homo sapiens
  UNSURE 62: Xaa = Arg,Ser
MDKSGIDSLDHVTSDAVELANRSDNSSDSSLFKTQCIPYSPKGEKRNPIRKFVRTPESVHAXISSSDSSFEPIPLTIKAIFERFKNRKKKK

SEQ ID NO: 5188 - protein, 59 aa, Homo sapiens
MELKNKVQDLENQLRITQVSAPPAGSMTPKSPSTDIFDMIPFSPISHQSSMPTRNGTQP

SEQ ID NO: 5189 - protein, 82 aa, Homo sapiens
MEKVEKCISDAMSWLNSKMNAQNKLSLTQDPVVKVSEIVAKSKELDNFCNPIIYKPKPKAEVPEDNPKANSEHNGPMDGQSG

SEQ ID NO: 5190 - protein, 124 aa, Homo sapiens
METETSFKNENKDNMDKMQVDQEEGHQKCHAEHTPEEEIDHTVAKTKSAVSDKQDRLNQTLKKGKVKSIDLPIQSSLCRQLGQDLLNSYIENEGKMIMQDKLEKERNDAKNAVEEYVYDFRDRL

SEQ ID NO: 5191 - protein, 164 aa, Homo sapiens
MATPMHRLIARRQAEANKQHVRCQKCLEFGHWTYECTGKRKYLHRPSRTAELKKALKEKENRLLLQQSIGETNVERKAKKKRSKSVTSSSSSSSDSSASDSSSESEETSTSSSSEDSDTDESSSSSSSSASSTTSSSSSDSDSDSSSSSSSSTSTDSSSDDEPP

SEQ ID NO: 5192 - protein, 155 aa, Homo sapiens
  UNSURE 147: Xaa = Asp,Glu
  UNSURE 27,30: Xaa = Cys,Ser
MMAAAAAAAAGSSSSGGGGGGGSGSGXSSXDTSSTGEEERMRRLFQTCDGDGDGYISRNDLLMVCRQLNMEESVAEIMNQLGADENGKISFQDFTRCRMQLVREIRKEEVDLSAKSDNSCTKKLRDRIASWPTSSDNSLGALSAARXSWEYDSGA

SEQ ID NO: 5193 - protein, 115 aa, Homo sapiens
  UNSURE 105: Xaa =  * ,Ala,Glu,Pro,Gln,Ser
  UNSURE 97: Xaa = Ala,Asp,Gly
  UNSURE 78: Xaa = Arg,Trp
MAARGRRAEPQGREAPGPAGGGGGGSRWAESGSGTSPESGDEEVSGAGSSPVSGGVNLFANDGSFLELFKRKMEEEQXQRQEEPPPGPQRPDQSAAXAGPRGSQXEGPVRAPHLA

SEQ ID NO: 5194 - protein, 58 aa, Homo sapiens
  UNSURE 57: Xaa = Asp,Glu
MAAQRLGKRVLSKLQSPSRARGPGGSPGGLQKRHARVTVKYDRRELQRRLDVEKWIXG

SEQ ID NO: 5195 - protein, 83 aa, Homo sapiens
  UNSURE 39: Xaa =  * ,Arg
  UNSURE 77: Xaa =  * ,Cys
  UNSURE 31: Xaa =  * ,Ile,Leu,Arg
  UNSURE 6: Xaa = Ala,Val
  UNSURE 76: Xaa = Arg,Ser
  UNSURE 25: Xaa = Ile,Lys
  UNSURE 65: Xaa = Phe,Ile
  UNSURE 29: Xaa = Phe,Ser
MYIYNXCVYIYTHIYINIFLRQSLXKIYXIXFIIIIISXDGVLLCHQTGVQWRDLGSLQPLTSWXKRFSCLSLPSXXDYRHVP

SEQ ID NO: 5196 - protein, 93 aa, Homo sapiens
MEEMSGESVVSSAVPAAATRTTSFKGTSPSSKYVKLNVGGALYYTTMQTLTKQDTMLKAMFSGRMEVLTDSEGWILIDRCGKHFGTILNYLRD

SEQ ID NO: 5197 - protein, 114 aa, Homo sapiens
MKDNKIMNNQDAIEKAVSRGQCLYKISSYTSYPMHDFYRCHTCNTTDRNAICVNCIKKCHQGHDVEFIRHDRFFCDCGAGTLSNPCTLAGEPTHDTDTLYDSAPPIDLIHCSTT

SEQ ID NO: 5198 - protein, 51 aa, Homo sapiens
MEEGRAQWLTPVMPALWEAEAGGSPEVRNSRPALTNMVKPRLYYKKKKKKA

SEQ ID NO: 5199 - protein, 88 aa, Homo sapiens
  SIGNAL -29..-1
  UNSURE 47: Xaa = Gly,Arg
  UNSURE -3: Xaa = Ser,Thr
MWLWEDQGGLLGPFSFLLLVLLLVTRXRSMPASSPAASSFYCASSALSRCPLAGPCRCSSPGTAFLPSPTVAAASXAREHAGGHSAGS

SEQ ID NO: 5200 - protein, 77 aa, Homo sapiens
  SIGNAL -20..-1
MQPRVLLVVALLALLASARASEAEDASLLSFMQGYMKHATKTAKDALSSVQECPGGPAGQGLGDRWLQFPERLLEHR

SEQ ID NO: 5201 - protein, 97 aa, Homo sapiens
  SIGNAL -19..-1
  UNSURE 7: Xaa = Ala,Asp,Gly,Val
MAPLRPLLILALLAWVALADQESCKXRCTEGFNVDKKCQCDELCSYYQSCCTDYTAECKPQVTRGDVFTMPEMSTRSMTMARRKTMPLSMNRWGAPP

SEQ ID NO: 5202 - protein, 107 aa, Homo sapiens
  SIGNAL -23..-1
MLLQSGLSFRRLLLLSLVSGALGLGGAVLGVGLSLGPVPLTPWVFGVTAGVFLYVALVDMLPALLRPPEPLPTPHVLLQGLGLLLGGGLMLAITLLEERLLPVTTEG

SEQ ID NO: 5203 - protein, 130 aa, Homo sapiens
  SIGNAL -20..-1
METLGALLVLEFLLLSPVEAQQATEHRLKPWLVGLAAVVGFLFIVYLVLLANRLWCSKARAEDEEETTFRMESNLYQDQSEDKREKKEAKEKEEKRKKEKKTAKEGESNLGLDLEEKEPGDHERAKSTVM

SEQ ID NO: 5204 - protein, 77 aa, Homo sapiens
  SIGNAL -22..-1
MWHLKLCAVLMIFLLLLGQIDGSPIPEVSSAKRRPRRMTPFWRGVSLRPIGASCRDDSECITRLCRKRRCSLSVAQE

SEQ ID NO: 5205 - protein, 146 aa, Homo sapiens
  SIGNAL -21..-1
  UNSURE 35: Xaa = Ala,Pro
MAFAWWPCLILALLSSLAASGFPRSPFGCLGNGASRKGGQWHRGLQYQNQLQGDLXFCSQCCHHESRQPCRHAKEVSFDVELQTSMPLASPSATAVSGEQQPWPYATLWPWAPTRATKVTKNVSKAQGTADRRGRLTQTHQVRAGQ

SEQ ID NO: 5206 - protein, 161 aa, Homo sapiens
  SIGNAL -21..-1
  UNSURE 35: Xaa = Ala,Pro
MAFAWWPCLILALLSSLAASGFPRSPFGCLGNGASRKGGQWHRGLQYQNQLQGDLXFCSQCCHHESRQPCRHAKEVSFDVELQTSMPLASPSATAVSGEQQPWPYATLWPWAQQGPQSDQEREQAQAQPTPRASDQTHKFVRDMIREVCGFARTSGAPWSY

SEQ ID NO: 5207 - protein, 92 aa, Homo sapiens
  SIGNAL -24..-1
MVMGLGVLLLVFVLGLGLTPPTLAQDNSRYTHFLTQHYDAKPQGRDDRYCESIMRRRGLTSPCKDINTFIHGNKRRSRPSVKTRMETLTEKT

SEQ ID NO: 5208 - protein, 92 aa, Homo sapiens
  SIGNAL -24..-1
  UNSURE 52: Xaa = Arg,Thr
MVMGLGVLLLVFVLGLGLTPPTLAQDNSRYTHFLTQHYDAKPQGRDDRYCESIMRRRGLTSPCKDINTFIHGNKRXSRPSVKTRMETLTEKT

SEQ ID NO: 5209 - protein, 53 aa, Homo sapiens
  SIGNAL -18..-1
MIPAVVLLLLLLVEQAAALGEPQLCYILDAILFLYGIVLTLLYCRLKIQVLWA

SEQ ID NO: 5210 - protein, 104 aa, Homo sapiens
  SIGNAL -38..-1
  UNSURE 45: Xaa = Ile,Met,Arg,Ser
MEFSSPSREECPKPLKGKHHGWQLTGLLLLQAVSWASGARPCIPKSFGYSSVVCVCNATYCDSFDPPTFPALGTFSRYESTRXGRRMELSMGPIQANQRAQACY

SEQ ID NO: 5211 - protein, 50 aa, Homo sapiens
  SIGNAL -30..-1
MSASPTPEPFLGFPMPEILLLPLWLSGLLASFGNFTLGLKLPVAARHAAP

SEQ ID NO: 5212 - protein, 53 aa, Homo sapiens
  SIGNAL -14..-1
MSLFGLLLLTSALAGQRQGTQAESNLSSKFQFSSNKEQNDDLPLFLRSTRSSA

SEQ ID NO: 5213 - protein, 85 aa, Homo sapiens
  SIGNAL -28..-1
  UNSURE 57: Xaa = Ala,Pro
  UNSURE 52: Xaa = Leu,Val
MDSDETGFEHSGLWVSVLAGLLLGACQAHPIPDSSPLLQFGGQVRQRYLYTDDAQQTEAHLEIREDGTVGGAADQSPESXLQLKX

SEQ ID NO: 5214 - protein, 72 aa, Homo sapiens
  SIGNAL -23..-1
MSVDLIIIELLFLLLLFLRRSLTLSPRLECSGEILAHCNLRLPGSSNSPASASRLAGIIGTCHHAWLIFVFL

SEQ ID NO: 5215 - protein, 95 aa, Homo sapiens
  SIGNAL -27..-1
MTDQDRIINLVVGSLTSLLILVTLISAFVFPQLPPKPLNIFFAVCISLSSITACIIYWYRQGDLEPKFRKLIYYIIFSIIMLCICANLYFHDVGR

SEQ ID NO: 5216 - protein, 199 aa, Homo sapiens
  SIGNAL -16..-1
  UNSURE 30: Xaa = Lys,Asn
METFPLLLLSLGLVLAEASESTMKIIKEEFTDEEMQYDMAKSGQEXQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 5217 - protein, 58 aa, Homo sapiens
  SIGNAL -45..-1
MRSGGRGRPRLRLGERGLMEPLLPPKRRLLPRVRLLPLLLALAWARRSTPFGAAGTAD

SEQ ID NO: 5218 - protein, 82 aa, Homo sapiens [sequence omitted]

SEQ ID NO: 5219 - protein, 95 aa, Homo sapiens
  SIGNAL -16..-1
  UNSURE 50: Xaa = Ile,Met
MKLPLLLALLFGAVSALHLRSETSTFETPLVLRRCLRMRRHQSRRWRRPLAGSWRKRRSGALEVKXPPRKMGLLSLSQCQIWWTKTLRVLRKRTQ

SEQ ID NO: 5220 - protein, 128 aa, Homo sapiens
  SIGNAL -23..-1
  UNSURE 104: Xaa = His,Gln
MASMAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRXN

SEQ ID NO: 5221 - protein, 146 aa, Homo sapiens
  SIGNAL -18..-1
  UNSURE 10: Xaa = Ile,Arg
  UNSURE 24: Xaa = Ile,Ser
MLLALVCLLSCLLPSSEAKLYGRCELAXVLHDFGLDGYRGYXLADWVCLAYFTSGFNAAALDYEADGSTNNGIFQINSRRWCSNLTPNVPNVCRMYCSDLLNPNLKDTVICAMKITQEPQGLGYWEAWRHHCQGKDLTEWVDGCDF

SEQ ID NO: 5222 - protein, 158 aa, Homo sapiens
  SIGNAL -17..-1
MALEVLMLLAVLIWTGAENLHVKISCSLDWLMVSVIPVAESRNLYIFADELHLGMGCPANRIHTYVYEFIYLVRDCGIRTRVVSEETLLFQTELYFTPRNIDHDPQEIHLECSTSRKSVWLTPVSTENEIKLDPSPFIADFQTTAEELGLLSSSPNLL

SEQ ID NO: 5223 - protein, 106 aa, Homo sapiens
  SIGNAL -17..-1
MALEVLMLLAVLIWTGAENLHVKISCSLDWLMVSVIPVAESRNLYIFADELHLGMGCPANRIHTYVYEFIYLVRDCGIRTRVRTVIVCKKYCMFCQTFMPSIKIVF

SEQ ID NO: 5224 - protein, 51 aa, Homo sapiens
  SIGNAL -40..-1
MTEPVKNKRNSRMFIKSFKLREKEFGLLLLYLSAVGYCFAQKSFSIKAVVY

SEQ ID NO: 5225 - protein, 57 aa, Homo sapiens
  SIGNAL -37..-1
MWKRWKNFIASTLCPITETLPAHLLLLALFSAHLSTCSRDHHCGSGFSKENLPTFPH

SEQ ID NO: 5226 - protein, 143 aa, Homo sapiens
  SIGNAL -15..-1
  UNSURE 111: Xaa = Ala,Pro
MKLLLWACIVCVAFARKRRFPFIGEDDNDDGHPLHPSLNIPYGIRNLPPPLYYRPVNTVPSYPGNTYTDTGLPSYPWILTSPGFPYVYHIRGFPLATQLNVPPLPPRGFPFVPPSRFFSAAAAPAXHLLQLSLLQLHLLQPHL

SEQ ID NO: 5227 - protein, 69 aa, Homo sapiens
  SIGNAL -20..-1
  UNSURE 9: Xaa =  * ,Phe,Leu,Ser,Tyr
  UNSURE 6: Xaa = Leu,Val
MGIQGGSVLFGLLLVLAVFCHSGHSXQCXTVLTQLLTAKQPSIVHLILMRVSLPKLGYKCIRHNPLEGK

SEQ ID NO: 5228 - protein, 94 aa, Homo sapiens
  SIGNAL -82..-1
MASNEVIADINCKGRSKSNLGWTPLHLACYFGHRQVVQDLLKAGAEVNVLNDMGDTPLHRAAFTGRKVKIILCSMFVSEVFGGVVTIVFSVITI

SEQ ID NO: 5229 - protein, 81 aa, Homo sapiens
  SIGNAL -16..-1
MAPLLLQLAVLGAALAAAALVLISIVAFTTATKMPALHRHEEEKFFLNAKARKKLYPAYGTHLPNNFLSLCLHTMKKNGCL

SEQ ID NO: 5230 - protein, 61 aa, Homo sapiens
  SIGNAL -19..-1
  UNSURE 24: Xaa = Leu,Val
MVGSGLLWLALVSCILTQASAVQRGYGNPIEASSYGLDLDCGXLAPQRLMSVLTPVRITPS

SEQ ID NO: 5231 - protein, 74 aa, Homo sapiens
  SIGNAL -34..-1
  UNSURE 5: Xaa = Lys,Asn
MESERSKRMGNACIPLKRIAYFLCLLSALLLTEGKKPAXQNALPCVLVPKIMLYVRMPDPFHAPFLLMLSHYPL

SEQ ID NO: 5232 - protein, 60 aa, Homo sapiens [sequence omitted]

SEQ ID NO: 5233 - protein, 82 aa, Homo sapiens
  SIGNAL -30..-1
MPACRLGPLAAALLLSLLLFGFTLVSGTGAEKTGVCPELQADQNCTQECVSDSECADNLKCCSAGCAPSALCPMIRRVPAPR

SEQ ID NO: 5234 - protein, 86 aa, Homo sapiens
  SIGNAL -23..-1
MMLPQWLLLLFLLFFFLFLLTRGSLSPTKYNLLELKESCIRNQDCETGCCQRAPDNCESHCRRRGPRAVCVKRSCQLLHASCLRIR

SEQ ID NO: 5235 - protein, 81 aa, Homo sapiens
  SIGNAL -33..-1
MQGTPGGGTRPGPSPVDRRTLLVFSFILAAALGQMNFTGDQVLRVLAKDEKQLSLLGDLEGLKPQKVDFWRGQPGPASLWI

SEQ ID NO: 5236 - protein, 100 aa, Homo sapiens [sequence omitted]

SEQ ID NO: 5237 - protein, 65 aa, Homo sapiens
  SIGNAL -18..-1
  UNSURE 44: Xaa = Cys,Phe
  UNSURE 1: Xaa = Lys,Arg
MKWVTFISLLFLFSSAYSXGCVSSEMHTRVRLLIGLKIWEKKIFKALVFDCLCSVSSAVSIXKIM

SEQ ID NO: 5238 - protein, 97 aa, Homo sapiens [sequence omitted]

SEQ ID NO: 5239 - protein, 88 aa, Homo sapiens
  SIGNAL -23..-1
  UNSURE 11: Xaa = Ile,Met
MGTPRIQHLLILLVLGASLLTSGLELYCQKGLSXTVEADPANMFNWTTEEVETCDKGALCQETILIIKAGTETAILATKGCIPEGRRP

SEQ ID NO: 5240 - protein, 78 aa, Homo sapiens
  SIGNAL -30..-1
MTVLHWRATEGSLLNPSGLCLCLLSHPLHSSVLPRDPRFSQRLVIQQTRSCLPLWHIRFALLECPFLPPHSTGSQHLN

SEQ ID NO: 5241 - protein, 84 aa, Homo sapiens
  SIGNAL -22..-1
MDTSPLCFSILLVLCIFIQSSALGQSLKPGWLQRKEESHQGQFEDVQKPRSEDRECFEGRERLGLSTVCLQHMAYSGCWRNVDD

SEQ ID NO: 5242 - protein, 69 aa, Homo sapiens
  SIGNAL -17..-1
MFPGFVFLLFVISLAAAAHLWVLAAFMGRITVKVCSFTPEASKTVSPPEGANNSRRTAFKSCNTHHKGL

SEQ ID NO: 5243 - protein, 69 aa, Homo sapiens
  SIGNAL -17..-1
  UNSURE 21: Xaa = Ala,Thr
  UNSURE 27: Xaa = Cys,Phe,Ile,Asn,Ser,Thr,Tyr
MFPGFVFLLFVISLAAAAHLWVLAAFMGRITVKVCSFXPEASKXVSPPEGANNSRRTAFKSCNTHHKGL

SEQ ID NO: 5244 - protein, 80 aa, Homo sapiens
  SIGNAL -23..-1
MSNQRLPLIFSLLFICFFGESFCICDGTVWTKVGWEILPEEVHYWKVKGSPSHCLPYLLDKLCCDFANMDIFQGLFISHL

SEQ ID NO: 5245 - protein, 133 aa, Homo sapiens [sequence omitted]

SEQ ID NO: 5246 - protein, 61 aa, Homo sapiens
  SIGNAL -18..-1
  UNSURE 17: Xaa = Asn,Thr
MKVLWAALLVTFLAGCRPRWSKRWRQSRSPSCASXRVAERPALGTGTGSLLGLPALGADTV

SEQ ID NO: 5247 - protein, 131 aa, Homo sapiens
  SIGNAL -16..-1
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPSPDLNDAVSSLRSPIPLLLSCAFVQVGMYFM

SEQ ID NO: 5248 - protein, 146 aa, Homo sapiens
  SIGNAL -16..-1
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPSPDLNDAVSSLRSPIPLLLSCAFVQVEEGCYDSLDGSLARGNWKIK

SEQ ID NO: 5249 - protein, 182 aa, Homo sapiens
  SIGNAL -16..-1
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQVTVIILML

SEQ ID NO: 5250 - protein, 95 aa, Homo sapiens
  SIGNAL -18..-1
  UNSURE 11: Xaa = Ala,Asp,His,Pro
MELVLVFLCSLLAPMVLASAAEKEKEMDXFHYDYQTLRIGGLVFAVVLFSVGILLILSRRCKCSFNQKPRAPGDEEAQVENLITANATEPQKAEN

SEQ ID NO: 5251 - protein, 71 aa, Homo sapiens
  SIGNAL -21..-1
MRNLSSNLHGLCLLLLCQATGRIMEKTTHLFFTCKENLGWNSKSKKWTNLETIVALITKAPLSFIKYLKER

SEQ ID NO: 5252 - protein, 54 aa, Homo sapiens [sequence omitted]

SEQ ID NO: 5253 - protein, 95 aa, Homo sapiens
  SIGNAL -24..-1
MARFLTLCTWLLLLGPGLLATVRAECSQDCATCSYRLVRPADINFLACVMECEGKLPSLKIWETCKSSCSCPNQIFLKMAPAPSEKIANRKKAIC

SEQ ID NO: 5254 - protein, 52 aa, Homo sapiens
  SIGNAL -20..-1
MCLVCVSVCACVCLCACVCACVSVRVCLCVSVSVSVCACVCLCVCVSTCVCV

SEQ ID NO: 5255 - protein, 81 aa, Homo sapiens
  SIGNAL -15..-1
  UNSURE 62: Xaa =  * ,Gln
  UNSURE 54: Xaa = Asp,Phe,Ile,Asn,Val,Tyr
  UNSURE 10: Xaa = Asp,Tyr
  UNSURE 14: Xaa = Cys,Arg
  UNSURE 64: Xaa = Cys,Gly
  UNSURE 38: Xaa = His,Tyr
  UNSURE 52: Xaa = Lys,Gln
  UNSURE 11: Xaa = Phe,Ile
MKFTTLLFLAAVAGALVYAEDASSXXDGXLILPRKLGPLSLMKRSQVQQNQLXPQRQPQQPRRLRRXQXRGQPRSPXAXRN

SEQ ID NO: 5256 - protein, 79 aa, Homo sapiens
  SIGNAL -27..-1
MWSLRPFALPKKPCCLLLFGSVPSLRAVTLTVKVRGFIDEVSENHEVSQSTALEGIDCQFKESLSSSDSRIRNVETDRK

SEQ ID NO: 5257 - protein, 66 aa, Homo sapiens
  SIGNAL -16..-1
MPLFLLSLPTPPSASGHERRQRPEAKTSGSEKKYLRAMQANRSQLHSPPGTGSRRMPQPLSVSTQD

SEQ ID NO: 5258 - protein, 68 aa, Homo sapiens
  SIGNAL -44..-1
  UNSURE 17: Xaa =  * ,Cys
MDAVSQVPMEVVLPKHILDIWVIVLIILATIVIMTSLLLCPATAVIIYRMRTHPILSGAVXEPPKRAG

SEQ ID NO: 5259 - protein, 87 aa, Homo sapiens [sequence omitted]

SEQ ID NO: 5260 - protein, 50 aa, Homo sapiens
  SIGNAL -33..-1
MDSCSVTRLEYSGGISAHCNLCLLALSDSYASASRVAGITDMHHHTQLIF

SEQ ID NO: 5261 - protein, 75 aa, Homo sapiens
  SIGNAL -68..-1
  UNSURE -36: Xaa = Ala,Pro
  UNSURE -15: Xaa = Asp,Glu
MSAGSATHPGAGGRRSKWDQPAPAPLLFLPPAXQVGRSPAVGEVLGAPQLLLQXPWMLLLLWLPRLMPCSWQKGS

SEQ ID NO: 5262 - protein, 69 aa, Homo sapiens [sequence omitted]

SEQ ID NO: 5263 - protein, 165 aa, Homo sapiens
  SIGNAL -30..-1
MAPHGPGSLTTLVPWAAALLLALGVERALALPEICTQCPGSVQNLSKVAFYCKTTRELMLHARCCLNQKGTILGLDLQNCSLEDPGPNFHQAHTTVIIDLQANPLKGDLANTFRGFTQLQTLILPQHVNCPGGINAWNTITSYIDNQICQGKRTFAITLGTRNVS

SEQ ID NO: 5264 - protein, 114 aa, Homo sapiens
  SIGNAL -14..-1
  UNSURE 47: Xaa = Ala,Ser,Thr
  UNSURE 2,40: Xaa = Ala,Thr
  UNSURE 71: Xaa = Arg,Ser
  UNSURE 3: Xaa = Asp,Gly
  UNSURE 80: Xaa = Cys,Tyr
  UNSURE 4: Xaa = Gly,Ser
  UNSURE 8: Xaa = His,Gln
  UNSURE 70: Xaa = His,Gln,Arg
  UNSURE 62: Xaa = Pro,Gln
  UNSURE 61: Xaa = Pro,Thr
MLVALALALIVAVASXXXAAAXSAARRTGGVRPGDHQRVAAHGVVLLQPARAGXVLLPVRXQPGVQQLHQQPQRXXHAHLLRHXXPELLGRYSXLVVWVNKKMHVDLCLLLSYL

SEQ ID NO: 5265 - protein, 116 aa, Homo sapiens
  SIGNAL -21..-1
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGLRVR

SEQ ID NO: 5266 - protein, 62 aa, Homo sapiens
  SIGNAL -46..-1
MDQLVFKETIWNDAFWQNPWDQGGLAVIILFITAVLLLILFAIVFGLLTSTENTQCEAGEEE

SEQ ID NO: 5267 - protein, 166 aa, Homo sapiens
  SIGNAL -15..-1
  UNSURE 142: Xaa = Ser,Thr
MLPLLIICLLPAIEGKNCLRCWPELSALIDYDLQILWVTPGPPTELSQNRDHLEEETAKFFTQVHQAIKTLRDDKTVLLEEIYTHKNLFTERLNKISDGLKEKDIQSTLKVTSCADCRTHFLSCNDPTFCPARNRRTSLWAVSLSSALLLAIAGDVXFTGKGRRRQ

SEQ ID NO: 5268 - protein, 116 aa, Homo sapiens
  SIGNAL -27..-1
MLSCRLQCALAALSIVLALGCVTGAPSDPRLRQFLQKSLAAAAGKQELAKYFLAELLSEPNQTENDALEPEDLSQAAEQDEMRLELQRSANSNPAMAPRERKAGCKNFFWKTFTSC

SEQ ID NO: 5269 - protein, 71 aa, Homo sapiens
  SIGNAL -21..-1
  UNSURE 18: Xaa = Glu,Gln
MRTSYLLLFTLCLLLSEMASGGNFLTGLGTDLIITIASXWRAMSLFCLPDLYQNSRHLLQREGQVLQVSWE

SEQ ID NO: 5270 - protein, 61 aa, Homo sapiens [sequence omitted]

SEQ ID NO: 5271 - protein, 54 aa, Homo sapiens [sequence omitted]

SEQ ID NO: 5272 - protein, 96 aa, Homo sapiens
  SIGNAL -37..-1
  UNSURE -36: Xaa = Glu,Gln
  UNSURE 41: Xaa = Gly,Arg
MXLPSGPGPERLFDSHRLPGDCFLLLVLLLYAPVGFCLLVLRLFLGIHVFLVSCALPDSVLRRFVVRTMCAVLGLVAXQRTPDSGITVSGSSFPTM

SEQ ID NO: 5273 - protein, 80 aa, Homo sapiens
  SIGNAL -47..-1
  UNSURE 28: Xaa = Cys,Trp
  UNSURE 26: Xaa = Phe,Leu
MSKLKHEFHGMAHHPPLFIKQKYLLSPLCPPPPFLCLFFCLGCLVFALLVETLLILQAASKLLWKKVGNTYLXFXPAFLD

SEQ ID NO: 5274 - protein, 111 aa, Homo sapiens
  SIGNAL -24..-1
MKYDCPFSGTSFVVFSLFLICAMAGDVVYADIKTVRTSPLELAFPLQRSVSFNFSTVHKSCPAKDWKVHKGKCYWIAETKKSWNKSQNDCAINNSYLMVIQDITAMVRFNI

SEQ ID NO: 5275 - protein, 84 aa, Homo sapiens
  SIGNAL -15..-1
  UNSURE 56: Xaa =  * ,Gly
  UNSURE -8: Xaa = Ala,Pro,Thr
  UNSURE 20: Xaa = Gly,Arg,Trp
MSVLTPLXAAGLAQARPGGSQCRGAKIHSVGRRRXKLWDHGNWPLGCTSCFRDLSSCQRAGILSRPGDLQXGQSEGGPFVSLTL

SEQ ID NO: 5276 - protein, 108 aa, Homo sapiens
  SIGNAL -20..-1
  UNSURE 64: Xaa = Arg,Thr
MKLLSLVAVVGCLLVPPAEANKSSEDIRCKCICPPYRNISGHIYNQNVSQKDCNCLHVVEPMPVPGHDVEAYCLLCECRYEERXPPPSRSSLSSTCPWWVPCCSTWPS

SEQ ID NO: 5277 - protein, 54 aa, Homo sapiens
  SIGNAL -26..-1
MVKVMWVSVLALAAAILLLTVPVAEGVTCSPMQLASCAAAMTSSSPPSEGVAQS

SEQ ID NO: 5278 - protein, 50 aa, Homo sapiens
  SIGNAL -21..-1
MWSNLGIGLAISLSVVGAAWGIYITGSSIIGGGVKAPRIKTKEPGQHHLL

SEQ ID NO: 5279 - protein, 55 aa, Homo sapiens
  SIGNAL -26..-1
MKPVSRRTLDWIYSVLLLAIVLISWGCIIYASMVSARRQLRKKYPDKIFGTNENL

SEQ ID NO: 5280 - protein, 88 aa, Homo sapiens
  SIGNAL -65..-1
MAAGGRMEDGSLDITQSIEDDPLLDAQLLPHHSLQAHFRPRFHPLPTVIIVNLLWFIHLVFVVLAFLTGVLLILIQMRTSAQEITQTH

SEQ ID NO: 5281 - protein, 75 aa, Homo sapiens [sequence omitted]

SEQ ID NO: 5282 - protein, 89 aa, Homo sapiens
  SIGNAL -62..-1
MLALFHFHLPPWDDAVRRPSVDASPSTLNFPDAELYASIFLCCMAPGEILISFLTLVQIAHANGRGCNTPACGAAACVWHENSQEERKY

SEQ ID NO: 5283 - protein, 62 aa, Homo sapiens
  SIGNAL -60..-1
MEMASSAGSWLSGCLIPLVFLRLSVHVSGHAGDAGKFHVALLGGTAELLCPLSLWPGTYPRR

SEQ ID NO: 5284 - protein, 59 aa, Homo sapiens
  SIGNAL -19..-1
MTVFWSLCPSLFSVSLCLCLPRLCLWVSLWPSLSPVCLTLHLFACLSLWVSASALPHHY

SEQ ID NO: 5285 - protein, 92 aa, Homo sapiens
  SIGNAL -22..-1
MGIWIKFRHSPGLLLLWTVAFAAENLALVSWNSPQWWWARADLGQQVQFSLWVLRYVVSGGLFVLGLWAPGLRPQSYTLQVHEEDQDVERSQ

SEQ ID NO: 5286 - protein, 54 aa, Homo sapiens [sequence omitted]

SEQ ID NO: 5287 - protein, 61 aa, Homo sapiens
  SIGNAL -25..-1
  UNSURE 27: Xaa = Ala,Val
MRLLQLLFRASPATLLLVLCLQLGANKAQDNTRKIIIKNFDIPKSVRPNDEXLQCLQFKQN

SEQ ID NO: 5288 - protein, 99 aa, Homo sapiens
  SIGNAL -38..-1
  UNSURE 26: Xaa = Lys,Asn
MRMHSKRQTITRHSASLSFHALPRSAFLQLCLLRQIHQIPCLSIFSSTLRAQTHDSGIGCTTAXQAGDGRSSSGNQGKLACPRRCSRGAVEERRSGFRI

SEQ ID NO: 5289 - protein, 59 aa, Homo sapiens
  SIGNAL -40..-1
  UNSURE -14: Xaa = Cys,Asp,Gly,Tyr
  UNSURE -15: Xaa = Glu,Lys
MAGVAATYGTKPLSCRQHGHPGLGQXXHFFLLGLWAVIRGAAVKTSDMPWSHFPHCLGD

SEQ ID NO: 5290 - protein, 50 aa, Homo sapiens
  SIGNAL -17..-1
MSCDSLYLSLALRSCYSKYGPWISRISITWVLFKNVGFQAHPIPGGLYTN

SEQ ID NO: 5291 - protein, 88 aa, Homo sapiens
  SIGNAL -27..-1
MGSHLCQVLTPAFRLCRLFLCSPLASSWYSIWWFFSNSWCYKSWANWLYCSISPSFSLCTSGYVRSSSMKYSCTAIFLLFLFLKSILC

SEQ ID NO: 5292 - protein, 72 aa, Homo sapiens
  SIGNAL -22..-1
MSAIFNFQSLLTVILLLICTCAYIRSLAPSLLDRNKTGLLGIFWKCARIGERKSPYVAVCCIVMAFSILFIQ

SEQ ID NO: 5293 - protein, 79 aa, Homo sapiens
  SIGNAL -26..-1
  UNSURE 5: Xaa = His,Gln
MVIIVTVVSVLLSLFVTSVLLCFIFGQHLRXSGWAPTGCERLGGGCPRPSGHSNHEWHGHHHGVTGTQCDSSGLRSSPG

SEQ ID NO: 5294 - protein, 81 aa, Homo sapiens
  SIGNAL -32..-1
MSPGQPMTFPPEALWVTVGLSVCLIALLVALAFVCWRKIKQSCEEENAGAEDQDGEGEGSKTALQPLKHSDSKEDDGQEIA

SEQ ID NO: 5295 - protein, 67 aa, Homo sapiens
  SIGNAL -48..-1
MQVWHGFDPGAMFRKWFPALRGFKTLIIKVIIVIGICLLLPCLLPVLLQMIKSFIVTLVHQNASAQV

SEQ ID NO: 5296 - protein, 81 aa, Homo sapiens
  SIGNAL -27..-1
MSDEDESSDYLCLSILGLFCCLPLAIPAVIFSCLTKNYNKSSDYELAAKTSKQAYYWAIASITVGILGTILYTYLIYLLRL

SEQ ID NO: 5297 - protein, 67 aa, Homo sapiens
  SIGNAL -16..-1
MSSLLSFSVLWDYISGQRRKSQPETQKGYGENYYSAPTVSVTQMGSLGHPACSTIGIPGKVTESGNR

SEQ ID NO: 5298 - protein, 57 aa, Homo sapiens
  SIGNAL -21..-1
MVLLSSTMSVLIFCLLNLAISDRRVMKSPTIIVIHLFFPHSSTSICIENLVTLLLGT

SEQ ID NO: 5299 - protein, 59 aa, Homo sapiens
  SIGNAL -16..-1
MHGPLLISGLSILALAQLLGLVYMKFVASNQKTIQPPRKAVEEPLNAFKESKGMIMMNN

SEQ ID NO: 5300 - protein, 92 aa, Homo sapiens
  SIGNAL -55..-1
  UNSURE 10: Xaa = Ala,Pro
  UNSURE 11: Xaa = Glu,Gln
MSGHSLARTLLLYLRNMTFLFQRMMMMMTNRNYRKEKALTEEMVMLSVSLPSLSAERLGEGPQPXXSGEASCMVHDRIPPQALGGSLRCAVH

SEQ ID NO: 5301 - protein, 82 aa, Homo sapiens [sequence omitted]

SEQ ID NO: 5302 - protein, 95 aa, Homo sapiens
  SIGNAL -36..-1
  UNSURE 4: Xaa = Ala,Asp
  UNSURE 50: Xaa = Cys,Phe,Ser,Tyr
  UNSURE -19: Xaa = His,Asn
  UNSURE 1: Xaa = His,Lys,Asn,Gln
  UNSURE 9: Xaa = Lys,Pro,Gln,Thr
  UNSURE -21: Xaa = Pro,Arg
MDHTFGIISKNLSKTXCXGGVILCFVLLFFLRWSLTXCVXQAGVXWRGLGSLQPPPPGFGRFLCLSLQGSWDCRRAPRCSASFCFXVLARLVLSY

SEQ ID NO: 5303 - protein, 54 aa, Homo sapiens
  SIGNAL -39..-1
MRVRWGIQQNSDTKTLESSIVKHMKRFVLVIPALWEVRARGLLKPRTSGPAWAT

SEQ ID NO: 5304 - protein, 102 aa, Homo sapiens [sequence omitted]

SEQ ID NO: 5305 - protein, 53 aa, Homo sapiens
  SIGNAL -27..-1
MVLCNNNARIIMFFLFLFVCGFFFCFCFFETECPSVIQAEAGEWLEPGKQRLQ

SEQ ID NO: 5306 - protein, 60 aa, Homo sapiens
  SIGNAL -39..-1
MESTVKPLGVAGVCYQVQSLERNSAAIHCLSCSCHLVTAGDLVQMLSEGLWAPSMYWMTT

SEQ ID NO: 5307 - protein, 57 aa, Homo sapiens
  SIGNAL -18..-1
MVGCSWLLYLCNFPGIQCIAIFEKYSNSSVSICTSDSALRAFPGTGMELHPYSLFFL

SEQ ID NO: 5308 - protein, 85 aa, Homo sapiens
  SIGNAL -33..-1
MFKIPSIMPDIYLIFNKCHFLLFISLFFLSTYSLIPRTEQIVNTIFSCCSIKFKESYRRTNSDILSSKFLRFKKSKYPPGSIWNY

SEQ ID NO: 5309 - protein, 53 aa, Homo sapiens; identical to SEQ ID NO: 5305
  SIGNAL -27..-1

SEQ ID NO: 5310 - protein, 53 aa, Homo sapiens; identical to SEQ ID NO: 5305
  SIGNAL -27..-1

SEQ ID NO: 5311 - protein, 53 aa, Homo sapiens; identical to SEQ ID NO: 5305
  SIGNAL -27..-1

SEQ ID NO: 5312 - protein, 53 aa, Homo sapiens; identical to SEQ ID NO: 5305
  SIGNAL -27..-1

SEQ ID NO: 5313 - protein, 120 aa, Homo sapiens
  SIGNAL -32..-1
MASPKGFFNYLTYFLAAGAVTLGIGFFALASALWFLICKRREIFQNSKFKAIDERCRQRPSMAKIKSHSQCVFISRNFHTGRFQLQQLKIILKMNPNLQQKISFVIPQRPAPQQIAAVLH

SEQ ID NO: 5314 - protein, 56 aa, Homo sapiens
  SIGNAL -15..-1
MELCRSLALLGGSLGLMFCLIALSTDFWFEAVGPTHSAHSGLWQQGMGTSYQATST

SEQ ID NO: 5315 - protein, 82 aa, Homo sapiens
  SIGNAL -32..-1
MASPKGFFNYLTYFLAAGAVTLGIGFFALASALWFLICKRRPGAVAHTYNPSTLGGQSGRITWGQEFETSLAKMRNISKFQI

SEQ ID NO: 5316 - protein, 61 aa, Homo sapiens
  SIGNAL -17..-1
MPPSLFFLLRIVLAIWALFWFHMKLKVVFSRPDVVAHACNPSTLGGQGGQIMMSGDQDHPG

SEQ ID NO: 5317 - protein, 61 aa, Homo sapiens; identical to SEQ ID NO: 5316
  SIGNAL -17..-1

SEQ ID NO: 5318 - protein, 85 aa, Homo sapiens
  SIGNAL -15..-1
MELCRSLALLGGSLGLMFCLIALSTDFWFEAVGPTHSAHSGLWQQGMGTSYQATARLSQPPQPLLQVRTLDWTGASRASEFLPRS

SEQ ID NO: 5319 - protein, 61 aa, Homo sapiens; identical to SEQ ID NO: 5316
  SIGNAL -17..-1

SEQ ID NO: 5320 - protein, 57 aa, Homo sapiens
  SIGNAL -16..-1
  UNSURE 6: Xaa = Asp,Gly
  UNSURE 29: Xaa = Ile,Asn,Ser,Thr
  UNSURE 18: Xaa = Ile,Lys,Arg
  UNSURE 10: Xaa = Phe,Leu,Val
MFTIKLLLFIVPLVISSRIDQXNSSXGFSISRAXIKICYVRRCKXFSQWPPSVGTWS

SEQ ID NO: 5321 - protein, 82 aa, Homo sapiens; identical to SEQ ID NO: 5315
  SIGNAL -32..-1

SEQ ID NO: 5322 - protein, 68 aa, Homo sapiens
  SIGNAL -50..-1
MGCFAPLDTAGLSYTVVNAHRIQPHAPCSKTPESDSCFWLAFCMFSDCLGNVSLLPASSDCSTRKRLM

SEQ ID NO: 5323 - protein, 178 aa, Homo sapiens
  SIGNAL -93..-1
  UNSURE -1: Xaa =  * ,Gly
  UNSURE -2: Xaa = Lys,Asn
MRRDRGPKPALGGAGEVEPGGMAASPTGRPRRLQRYLQSGEFDQFRDFPIFESNFVQVTRLGEVANEVTMGVAASSPALELPDLLLLAGPAXXERTPATLRAVPLEVRPALCPRQKPVSARGQVEHQPHLLLAAAGPTQDPRPRVRPVGAAALPPALPLCFCCALHAGVRAPRRGSQT

SEQ ID NO: 5324 - protein, 60 aa, Homo sapiens
  SIGNAL -41..-1
MNTPDSGVVYTATSVFESVPRGEGNLLHLFCNISFLPFAVASPLTHLVLFYPTFEISILC

SEQ ID NO: 5325 - protein, 188 aa, Homo sapiens
  SIGNAL -48..-1
MAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYTVQG

SEQ ID NO: 5326 - protein, 50 aa, Homo sapiens
  SIGNAL -26..-1
MKNLYFCSCHSLSLAVHSLLAALVQSGSFFLWRPDFLHTTGVSTDLNQLL

SEQ ID NO: 5327 - protein, 53 aa, Homo sapiens [sequence omitted]

SEQ ID NO: 5328 - protein, 76 aa, Homo sapiens
  SIGNAL -18..-1
MKIHYLFFALFFLGQLSTSGTEDAYEVISIMDCKNQTLCNSQNTTRHCSHGKEIELCVLRLGKNAKRLTNHEETAN

SEQ ID NO: 5329 - protein, 114 aa, Homo sapiens
  SIGNAL -68..-1
MRLQDRIATFFFPKGMMLTTAALMLFFLHLGIFIRDVHNFCITYHYDHMSFHYTVVLMFSQVISICWAAMGSLYAEMTENNAQRSHVLQPPVLGVSGHRVPGGAPLRPGESEQG

SEQ ID NO: 5330 - protein, 95 aa, Homo sapiens
  SIGNAL -48..-1
MASSHWNETTTSVYQYLGFQVQKIYPFHDNWNTACFVILLLFIFTVVSLVVLAFLYEVLDCCCCVKNKTVKDLKSEPNPLRSMMDNIRKRETEVV

SEQ ID NO: 5331 - protein, 56 aa, Homo sapiens
  SIGNAL -54..-1
MKYKIHQPHLTAHGRFPVFHRPSAGHRHTEPSRGRLSRGPGLLTTATFLPQGQGKS

SEQ ID NO: 5332 - protein, 107 aa, Homo sapiens
  SIGNAL -20..-1
MASLGHILVFCVGLLTMAKAESPKEHDPFTYDYQSLQIGGLVIAGILFILGILIVLSRRCRCKFNQQQRTGEPMKRRELSAAPSAVCPPAAVETPGAMESGQDSPGT

SEQ ID NO: 5333 - protein, 107 aa, Homo sapiens
  SIGNAL -85..-1
  UNSURE 15: Xaa =  * ,Trp
  UNSURE -59: Xaa =  * ,Tyr
  UNSURE -63: Xaa = Arg,Ser
  UNSURE 22: Xaa = Gly,Val
  UNSURE 17: Xaa = His,Gln
  UNSURE -58: Xaa = Lys,Thr
MPQLKLTSVWTTTHSYYTETRTXSPGXXPGPPPMDIQMANNFTPPSATPQGNDCDLYAHHSTASIVMPLHYSLVFIIGLVGNLLALVVIVQNRKKIISPXAXPHPIX

SEQ ID NO: 5334 - protein, 80 aa, Homo sapiens
  SIGNAL -49..-1
MLAAVGAAVQHVDNLRAALSPLADLHALVLRVDPANFPLLIQCFHVVLASHLQDEFTVQMQAAWDKFLTGVAVVLTEKYR

SEQ ID NO: 5335 - protein, 55 aa, Homo sapiens
  SIGNAL -28..-1
MKPDNNGKNQCKCQCLFLLSLYINYVTSFPKYDNYISSKLSFFPYQRVSSSSLLY

SEQ ID NO: 5336 - protein, 78 aa, Homo sapiens
  SIGNAL -18..-1
MDPRYITLCIFLVLVLHGDTTLAETCRQFVKWDPFCFSAMCKASCFIEGKSSDGSYVKGHRCESNGYHAVCVCFLCKN

SEQ ID NO: 5337 - protein, 62 aa, Homo sapiens
  SIGNAL -27..-1
  UNSURE 7: Xaa = Arg,Trp
MKTCRPLTFCRVDFFIFLHLLHSGSAGFSLGACXRQWGREGWGGCAFYSTILVSSRGRVECI

SEQ ID NO: 5338 - protein, 106 aa, Homo sapiens
  SIGNAL -20..-1
  UNSURE 68: Xaa = Ala,Pro
MASLGHILVFCVGLLTMAKAESPKEHDPFTYDYQSLQIGGLVIAGILFILGILIVLSRRCRCKFNQQQRTGEPMKRRELSAAPSAVCXPAAVETPGAMESGQVLQL

SEQ ID NO: 5339 - protein, 51 aa, Homo sapiens [sequence omitted]

SEQ ID NO: 5340 - protein, 68 aa, Homo sapiens
  SIGNAL -35..-1
  UNSURE 1: Xaa = Ile,Met
MAVELGVLLVRPRPGTGLGRVMRTLLLVLWLATRGXLYFHIGETEKKCFIEEIPDETMVIGNYRDAAV

SEQ ID NO: 5341 - protein, 75 aa, Homo sapiens [sequence omitted]

SEQ ID NO: 5342 - protein, 64 aa, Homo sapiens
  SIGNAL -20..-1
  UNSURE 34: Xaa = Ala,Pro
  UNSURE 15: Xaa = Leu,Pro
  UNSURE 17: Xaa = Pro,Gln
MSSSRVGLRLAACLLNVSEAGRKYIVENIAKAALXGXKWKGNILQVSVLKYIFXIKTTRDQSLQ

SEQ ID NO: 5343 - protein, 55 aa, Homo sapiens
  SIGNAL -40..-1
MLFPQANATFSHKADFTYFITLENTIRLLFCFSFPRVCLSDLPFAQHILHTASTL

SEQ ID NO: 5344 - protein, 53 aa, Homo sapiens
  SIGNAL -33..-1
  UNSURE -14: Xaa = Asp,Glu
  UNSURE -13: Xaa = Asp,His
MGKVGFHGIVLFRLLVRLSXXFFMCLLLGMVSSCVKDMPVHVFCTFLKFLIYS

SEQ ID NO: 5345 - protein, 87 aa, Homo sapiens
  SIGNAL -23..-1
MLRPALPWLYLGLCSLLVGEAEAPSPVDPLERAGRTRCCEGRTWIKLFIEVLIRRDGCGVVCSSTFRGEVLLSQNSGESEMPNDVHK

SEQ ID NO: 5346 - protein, 89 aa, Homo sapiens
  SIGNAL -37..-1
  UNSURE 10: Xaa = Arg,Thr
MCHHAWLIFVFLVETEFRHVDQAGLELLGSSSPPTLASQNVGITGVXPHPANIFERHILKDCYQLEWWLVSVIPALWEAKMRGSLSSGV

SEQ ID NO: 5347 - protein, 155 aa, Homo sapiens
  SIGNAL -25..-1
  UNSURE 129: Xaa =  * ,Gly,Arg
  UNSURE 115: Xaa =  * ,Lys
  UNSURE 81: Xaa = Ala,Val
  UNSURE 130: Xaa = Cys,Gly,Arg,Ser
  UNSURE 117: Xaa = Cys,Pro,Arg,Ser
MADSKEGVLPLTLLPLPQFHSASLARPHGGGWPTRETARGHLRRKDFLKTVEGRELQSVKPQEAPKELVIPLIQNGHRRQPPARPPGHPQILGPWRWGGVPGCEGXHCGIQEVSGRERECGCRPHARYPHDPERMHPSGXGXRQRTPGRDSARXX

SEQ ID NO: 5348 - protein, 71 aa, Homo sapiens
  SIGNAL -15..-1
  UNSURE 55: Xaa = Asp,Glu
MLLVALLFTGIAVLGIVMLKRIHSLYRRTGASFQKAQQEFAAGVFSNPAVRTELPMQPLGLLKMPSGPRXP

SEQ ID NO: 5349 - protein, 62 aa, Homo sapiens
  SIGNAL -46..-1
MQFGNILAIRSLPLPPAVPGTRMGCLLWTHGSVSLLIFFSLRFIFGRFCFHVFKPTDLLSCC

SEQ ID NO: 5350 - protein, 105 aa, Homo sapiens
  SIGNAL -19..-1
  UNSURE 38: Xaa = Ala,Gly
MRGATRVSIMLLLVTVSDCAVITGACERDVQCGAGTCCAISLWLRGLRMCTPLGRKXEECHPGSHKIPFFRKRKHHTCPCLPNLLCSRFPDGRYRCSMDLKNINF

SEQ ID NO: 5351 - protein, 78 aa, Homo sapiens [sequence omitted]

SEQ ID NO: 5352 - protein, 71 aa, Homo sapiens
  SIGNAL -37..-1
MHPVQDGCGCGCTQMSGLLCCLRKILSLPLAWLPARGWCCGTYIFRKLCSLCHCHPRGIWHPPKDRGAWPR

SEQ ID NO: 5353 - protein, 61 aa, Homo sapiens
  SIGNAL -42..-1
MTDLDLMINFTFPIQWVNQNRMAYYSLKPLLPCSSVLTCGQASQDLLTSATSVTGMEKIEA

SEQ ID NO: 5354 - protein, 82 aa, Homo sapiens
  SIGNAL -15..-1
  UNSURE 34: Xaa = Ser,Tyr
MATWALLLLAAMLLGNPGLEVSVSPKGKNTSGRESGFGWAIWMEGLVFXRLSPEYYDLARAHLRDEEKSCPCLAQEGPRVTC

SEQ ID NO: 5355 - protein, 150 aa, Homo sapiens
  SIGNAL -53..-1
MAARGVIAPVGESLRYAEYLQPSAKRPDADVDQQGLVRSLIAVGLGVAALAFAGRYAFRIWKPLEQVITETAKKISTPSFSSYYKGGFEQKMSRREAGLILGVSPSAGKAKIRTAHRRVMILNHPDKGGSPYVAAKINEAKDLLETTTKH

SEQ ID NO: 5356 - protein, 70 aa, Homo sapiens
  SIGNAL -17..-1
  UNSURE 39: Xaa = Ala,Pro
MSLCHILFLLNLQFTHTQQPYWKDYTQFSCGSHLWSRHFGRPRRADPLRSGVRDRXGQHGGAPSLLKNTK

SEQ ID NO: 5357 - protein, 60 aa, Homo sapiens
  SIGNAL -18..-1
MNLLPTWMLLVLSPGSVTENVLYLAKAVSPQNSRNQILAHLFQRFFRPDLHFNLLEEHRI

SEQ ID NO: 5358 - protein, 109 aa, Homo sapiens
  SIGNAL -105..-1
MARVIIDNKDGPTQKYLLIFGAFVSVYIQEMFRFAYYKLLKKASEGLKSINPGETAPSMRLLAYAFMTLVIILLHVFWGIVFFDVCEKKKWGILLIVLLTHLLVSARPS

SEQ ID NO: 5359 - protein, 65 aa, Homo sapiens
  SIGNAL -49..-1
  UNSURE -15: Xaa =  * ,Ala,Cys,Gly,Ser,Trp
  UNSURE -38: Xaa = Asp,Glu
  UNSURE -16: Xaa = His,Leu,Pro,Arg
MHPCERSDKVPXNKNTHTLLLAGVFRGGHDILVXXRLLLLDTVTMQVTARSLEELPVDIILASVG

SEQ ID NO: 5360 - protein, 105 aa, Homo sapiens
  SIGNAL -44..-1
  UNSURE -7: Xaa = Ala,Asp,Gly,Ile,Asn,Ser,Thr,Val
  UNSURE -10: Xaa = Ala,Gly,Leu,Pro,Arg,Val
  UNSURE 51: Xaa = Ala,Thr
  UNSURE -4: Xaa = Gln,Arg
MPNRKPAGMLTISSCRRRSPNYGDEACLWLALLMXSLXAPXLGASEGGRKGEIRKMAREWRAAQGKDPGPSEKAETCFHTTEEARHACTKAECFXSRYVSFVFKR

SEQ ID NO: 5361 - protein, 94 aa, Homo sapiens
  SIGNAL -77..-1
  UNSURE -69: Xaa = Asn,Ser
  UNSURE -58: Xaa = Lys,Asn
MGCCYSSEXEDSDQDREERXCCWTLAAPLPKLSMEPSPTTTACLPLALMSRPCSLPSLPRQPATSLMCLLQTHRAWSSMSTWTVPGSTAPAWLC

SEQ ID NO: 5362 - protein, 50 aa, Homo sapiens
  SIGNAL -26..-1
MTSSVHLLVFKDHLLSMLSCCQGACCPSTPHEGTRSTVSWIPPTYKAATH

SEQ ID NO: 5363 - protein, 75 aa, Homo sapiens
  SIGNAL -19..-1
MGRAWWLTPVILALREARADGSVELRNVRPAWAMWQNPASTKNTKTRWAWWHAPVVPATGEAEVGGWLEPGRQRL

SEQ ID NO: 5364 - protein, 75 aa, Homo sapiens; identical to SEQ ID NO: 5363
  SIGNAL -19..-1

SEQ ID NO: 5365 - protein, 71 aa, Homo sapiens
  SIGNAL -33..-1
MESRSVAGLECSGVILAHCSLCLLGSSDSPSSASRVAGTIGACHHAPLIFVFLVEKEFHHVGQDGLDLLAS

SEQ ID NO: 5366 - protein, 53 aa, Homo sapiens [sequence omitted]

SEQ ID NO: 5367 - protein, 123 aa, Homo sapiens
  SIGNAL -20..-1
MACRCLSFLLMGTFLSVSQTVLAQLDALLVFPGQVAQLSCTLSPQHVTIRDYGVSWYQQRAGSAPRYLLYYRSEEDHHRPADIPDRFSAAKDEAHNACVLTISPVQPEDDADYYCSVGYGFSP

SEQ ID NO: 5368 - protein, 81 aa, Homo sapiens
  SIGNAL -52..-1
MVKIPGWNGSHEGFLLLLEGVGDILFWFFCRFHENSPFPSPLFLSWFPSVLSKSFLCYLAFRTSRPFKAPMFSALFGQHNL

SEQ ID NO: 5369 - protein, 88 aa, Homo sapiens
  SIGNAL -59..-1
MMVLSGPAALWGSMGWKEATCPNPKRLLGENFSNEANTSSGLWPSSLCLSLIAISPSFTLSNLRSSIKKLNLWPSTVAHACNPTTLGG

SEQ ID NO: 5370 - protein, 97 aa, Homo sapiens
  SIGNAL -83..-1
MQVPVSPQLHQCCKYMSNFWICAKPIDKKWKCGLVLISISLIKHLNMFSCLRVSCINFSGNYLLMFFDHYSVRLSCLFSRTFSCIKMINGGCSSSCP

SEQ ID NO: 5371 - protein, 67 aa, Homo sapiens [sequence omitted]

SEQ ID NO: 5372 - protein, 68 aa, Homo sapiens [sequence omitted]

SEQ ID NO: 5373 - protein, 127 aa, Homo sapiens
  SIGNAL -19..-1
  UNSURE 72: Xaa = Lys,Asn
MQQRGLAIVALAVCAALHASEAILPIASSCCTEVSHHISRRLLERVNMCRIQRADGDCDLAAVILHVKRRRICVSPHNHTVKQWMKVQAAXKNGKGNVCHRKKHHGKRNSNRAHQGKHETYGHKTPY

SEQ ID NO: 5374 - protein, 65 aa, Homo sapiens
  SIGNAL -33..-1
  UNSURE -7: Xaa = Leu,Trp
MMSSLFSPGTLSLQTIQKDPAAPMCLXFLVCQCHYTPNSPFDGENLSLWNYEIYMHSLQIKHHSL

SEQ ID NO: 5375 - protein, 84 aa, Homo sapiens
  SIGNAL -81..-1
MAGAAGLTAEVSWKVLERRARTKRSGLAGWGAAPTRVPWVVLRLKRLGGRQVGALGMNLCPEFLLRKQVAALALFLISSSTSKN

SEQ ID NO: 5376 - protein, 83 aa, Homo sapiens
  SIGNAL -23..-1
MCAMAPLWSPLCPSICMCSVSLACVRVRVSAYASTHWALGCSQGKFDLERLSSPWNQDFLSPPHPGPVPPWLSGYWGMETLGE

SEQ ID NO: 5377 - protein, 80 aa, Homo sapiens
  SIGNAL -52..-1
MVAKQRIRMANEKHSKNITQRGNVAKTSRNAPEEKASVGPWLLALFIFVVCGSAIFRLFKVSGWACEVTDLKMFPFSCEF

SEQ ID NO: 5378 - protein, 97 aa, Homo sapiens
  SIGNAL -26..-1
MVSRMVSTMLSGLLFWLASGWTPAFAYSPRTPDRVSEADIQRLLHGVMEQLGIAGPEWKYPAHQAMNLVGPRALKVELMKDFSIWVLLATSPTSCQS

SEQ ID NO: 5379 - protein, 93 aa, Homo sapiens
  SIGNAL -24..-1
MEEGGNLGGLIKMVHLLVLSGAWGMQMWVTFVSGFLLFRSLPRHTFGLVQSKLFPFYFHISMGCASSTSASWLHSMLGLSSHSGRPASFTCCS

SEQ ID NO: 5380 - protein, 94 aa, Homo sapiens [sequence omitted]

SEQ ID NO: 5381 - protein, 71 aa, Homo sapiens
  SIGNAL -24..-1
MDLELLGSSDPFTLASQVAGTTFAHQLAQDQTGQHDGVLFCHPGWSAVAQSQLITISAYWVQVILPPQPPK

SEQ ID NO: 5382 - protein, 165 aa, Homo sapiens
  SIGNAL -39..-1
  UNSURE -24: Xaa = Ala,Gly
  UNSURE -25: Xaa = Arg,Ser
MRAHAQRGRGCTRRXXAVLMARHGLPLLPLLSLLVGAWLKLGNGQATSMVQLQGGRFLMGTNSPDSRDGEGPVREATVKPFAIDIFPVTNKDFRDFVREKKYRTEAEMFGLSFVFEDFVSDELRNKATQPMKSVLWWLPVEKAFWRQPAGPGSGIRERLEHQCYT

SEQ ID NO: 5383 - protein, 95 aa, Homo sapiens [sequence omitted]

SEQ ID NO: 5384 - protein, 89 aa, Homo sapiens
  SIGNAL -44..-1
MGRHVFFVPSLSSDPLFSLTLFFSFVSFFLIFFLPLLTFFLLFSNPLGHTQDLFLCAVIGSCKSMGLQVGATKLDSFMSWDRELVAGLS

SEQ ID NO: 5385 - protein, 132 aa, Homo sapiens
  SIGNAL -51..-1
  UNSURE 3: Xaa = Glu,Lys
MISITEWQKIGVGITGFGIFFILFGTLLYFDSVLLAFGNLLFLTGLSLIIGLRXTFWFFFQRHKLKGTSFLLGGVVIVLLRWPLLGMFLETYGFFSLFKGFFPVAFGFLGNVCNIPFLGALFRRLQGTSSMV

SEQ ID NO: 5386 - protein, 150 aa, Homo sapiens [sequence omitted]

SEQ ID NO: 5387 - protein, 85 aa, Homo sapiens
  SIGNAL -29..-1
MANLMKCCMSMRAHRTRLSDCLLVPLGQASQSCFPVPWTPGGISEKLWQYLGTNKSLCISQQCLEAPGGIGAPAVLTCRSDSEGQ

SEQ ID NO: 5388 - protein, 64 aa, Homo sapiens
  SIGNAL -22..-1
MISRQLRSLSCLCPALFPGTSSFIVALSSPANLYIPQRQRSDELVFESQKGSAMELAVITVDGV

SEQ ID NO: 5389 - protein, 54 aa, Homo sapiens
  SIGNAL -47..-1
  UNSURE 5: Xaa = Phe,Leu
MKEYLDTRATAQQPRNFETCHYRTFLGLLTLRCHFILFVVVLCWVWLSCKFXSF

SEQ ID NO: 5390 - protein, 54 aa, Homo sapiens
  SIGNAL -47..-1
MKEYLDTRATAQQPRNFETCHYRTFLGLLTLRCHFILFVVVLCWVWLSCKFFSF

SEQ ID NO: 5391 - protein, 117 aa, Homo sapiens
  SIGNAL -75..-1
MDSLAAGELNASHQPWVPEFVAYWRKTHQDHLCSLHSRAFGLLDARVTWALRRAPEPVPGKDRLLLAAFPAEASPVDTASVSVYGRAPRYMHKGVKKCVCTPVSKNSTAWLLLGGIS

SEQ ID NO: 5392 - protein, 112 aa, Homo sapiens
  SIGNAL -69..-1
  UNSURE -34: Xaa = Cys,Arg
MFTMLCINGTTPRPLPVPSPFGCMIFFFFKNPWKQXLLQGWLGARPIHLLGYLPLSLLWCPFPLPCARCSVVYISSPRHGAHAPRDMILSLVLAHGALYKELGGRGRKWEPS

SEQ ID NO: 5393 - protein, 78 aa, Homo sapiens
  SIGNAL -72..-1
MEDSEALGFEHMGLDPRLLQAVTDLGWSRPTLIQEKAIPLALEGKDLLARARTVPGRRPLMLFRCCSCCSIGRRQVRW

SEQ ID NO: 5394 - protein, 76 aa, Homo sapiens [sequence omitted]

SEQ ID NO: 5395 - protein, 142 aa, Homo sapiens
  SIGNAL -19..-1
  UNSURE 9: Xaa = Phe,Leu
MATASPSVFLLMVNGQVESAQFPEYDDXYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTRSASCSTH

SEQ ID NO: 5396 - protein, 83 aa, Homo sapiens
  SIGNAL -45..-1
  UNSURE -42: Xaa = Glu,Gln
MAAXPSEGACSDGVSLLLPKLECNGAISAHCNLHLLGSSNSPASASQVASITGTCHHSRLIFVFSVETGFHHADQASLELLTG

SEQ ID NO: 5397 - protein, 54 aa, Homo sapiens
  SIGNAL -17..-1
MFRRLTFAQLLFATVLGIAGGVYIFQPVFEQYAKDQKELKEKMQLVQESEEKKS

SEQ ID NO: 5398 - protein, 50 aa, Homo sapiens
  SIGNAL -46..-1
MGQACLSLKRWPSWPSHPFGTFSRMPVIVALCCGIGLCSVLPLVLSAQFL

SEQ ID NO: 5399 - protein, 58 aa, Homo sapiens
  SIGNAL -44..-1
MLLLTIVCAIALKTPFLASPYYMSQGQPAVLLFFSFFFLRKSLALSPRLECSGSISAH

SEQ ID NO: 5400 - protein, 55 aa, Homo sapiens [sequence omitted]

SEQ ID NO: 5401 - protein, 52 aa, Homo sapiens
  SIGNAL -32..-1
MDVKCPGCYKITTVFSHAQTVVLCVGCSTVLCQPTGGKARLTEGCSFRRKQH

SEQ ID NO: 5402 - protein, 67 aa, Homo sapiens
  SIGNAL -64..-1
MPLARDLLHPSLEEEKKKHKKKRLVQSPNSYFMDVKCPGCYKITTVFSHAQTVVLCVGCSTVLCQPT

SEQ ID NO: 5403 - protein, 118 aa, Homo sapiens
  SIGNAL -56..-1
MQPSLLRSYRLKAQLSLSSTVPRRITDKPATKSWEGGRRELCPRVLFTQLLLWVWPGDPGPELQETGFPGPPRPAHLKTDRAIMVGVKGIEEKSGIGAGVCRVSVEKLASTQERTSSL

SEQ ID NO: 5404 - protein, 90 aa, Homo sapiens
  SIGNAL -62..-1
MEKLLENLGKLTECFGKTQSRLKKMCHKKVYRTYSNSKRNQRLNSQNWKLPTASTLFSLVLCDVYYEWSHRQYLYEHETMCGRCLVLCNI

SEQ ID NO: 5405 - protein, 84 aa, Homo sapiens
  SIGNAL -64..-1
  UNSURE -61: Xaa = Ala,Gly
MPLXRDLLHPSLEEEKKKHKKKRLVQSPNSYFMDVKCPGCYKITTVFSHAQTVVLCVGCSTVLCQPTGGKARLTEGCSFRRKQH

SEQ ID NO: 5406 - protein, 84 aa, Homo sapiens
  SIGNAL -64..-1
MPLARDLLHPSLEEEKKKHKKKRLVQSPNSYFMDVKCPGCYKITTVFSHAQTVVLCVGCSTVLCQPTGGKARLTEGCSFRRKQH

SEQ ID NO: 5407 - protein, 69 aa, Homo sapiens
  SIGNAL -53..-1
  UNSURE 5: Xaa = Cys,Gly
MYCKEVSEDMQVFRKTDFFRHETKFRKLRLLMIWILMLHNKILLILWSLLLDSQTVFXSYQVKPAYWGK

SEQ ID NO: 5408 - protein, 96 aa, Homo sapiens
  SIGNAL -19..-1
  UNSURE 73: Xaa = Gly,Val
MASSNTVLMRLVASAYSIAQKAGMIVRRVIAEGDLGIVEKTCATDLQTKADRLAQMSICSSLARKFPKLTIIGEELVVWVDPLDGTKEYTEXFLTM

SEQ ID NO: 5409 - protein, 81 aa, Homo sapiens
  SIGNAL -21..-1
MSRSSKVVLGLSVLLTAATVAGVHVKQQWDQQRLRDGVIRDIERQIRKKENIRLLGEQIILTEQLEAEREKMLLAKGSQKS

SEQ ID NO: 5410 - protein, 50 aa, Homo sapiens
  SIGNAL -34..-1
MELTAMAFLPCLYFHMWGFDLVISLIFFLQTTISFGLCVVISFGLHLTQT

SEQ ID NO: 5411 - protein, 106 aa, Homo sapiens
  SIGNAL -34..-1
MRSLSSPNDGKHPGAEGAEWRLCLWTGECAPVLGSPPAAHIWSLPGPERHLTLRPLCLSHWVLWNLPRNGCEIPLLLLLPLKGAYQNGSGSCKSNKSFTIISIYMK

SEQ ID NO: 5412 - protein, 70 aa, Homo sapiens
  SIGNAL -64..-1
MGFTAAGIASSSIAAKMMSAAAIANGGGVASGSLVATLQSLGATGLSGLTKFILGLHWVLTLRAVIARFY

SEQ ID NO: 5413 - protein, 68 aa, Homo sapiens
  SIGNAL -27..-1
MCRHSSHIAVLPALALLLLPFMLGVKPEALWAEAAHAGTRVLYSITWSARGPWPTLLLTLENTNFHKG

SEQ ID NO: 5414 - protein, 64 aa, Homo sapiens
  SIGNAL -22..-1
  UNSURE -5: Xaa = His,Pro,Gln
MISRQLRSLSCLCPALFXGTSSFIVALSSPANLYIPQRQRSDELVFESQKGSAMELAVITVDGV

SEQ ID NO: 5415 - protein, 103 aa, Homo sapiens [sequence omitted]

SEQ ID NO: 5416 - protein, 53 aa, Homo sapiens
  SIGNAL -17..-1
MDPSLVLILHCVSLSKCVHHHHNHNLGPFWHPRKLVPVFLKSIFPNPLAPGNY

SEQ ID NO: 5417 - protein, 71 aa, Homo sapiens
  SIGNAL -44..-1
  UNSURE -27: Xaa = Gly,Arg
  UNSURE -5: Xaa = Ile,Ser
  UNSURE -34: Xaa = Pro,Gln
MEILEKEVFYXNILVNMXTASKLRKSGLEKALMLLSLTRXFVQCLASTCRSRGNVLRASPLGRHFGCMNMD

SEQ ID NO: 5418 - protein, 157 aa, Homo sapiens
  SIGNAL -132..-1
  UNSURE -66: Xaa =  * ,Trp
  UNSURE -49: Xaa = Glu,Gly
  UNSURE -41: Xaa = Lys,Arg
MKCVFVTVGPPALTTSLRVCRRPTVCKKSRALVTTDLSCKLVEERWYLNPSVLSRLLWMFTGTRIPXKKTFRKQILLLVTQVQXAVWRLWKXEATRSGYKRKVDEQSSAGTGKAATQRGSSLLLYLQHASWAVTVNGLINTEMLSSWPARKIFCIFG

SEQ ID NO: 5419 - protein, 73 aa, Homo sapiens [sequence omitted]

SEQ ID NO: 5420 - protein, 74 aa, Homo sapiens [sequence omitted]

SEQ ID NO: 5421 - protein, 73 aa, Homo sapiens [sequence omitted]

SEQ ID NO: 5422 - protein, 73 aa, Homo sapiens [sequence omitted]

SEQ ID NO: 5423 - protein, 112 aa, Homo sapiens
  SIGNAL -96..-1
  UNSURE -57: Xaa = Asp,Glu
MAAALARLGLRPVKQVRVQFCPFEKNVESTRTFLQTVSSXKVRSTNLNCSVIADVRHDGSEPCVDVLFGDGHRLIMRGAHLTALEMLTAFASHIRARDAAGSGDKPGADTGR

SEQ ID NO: 5424 - protein, 112 aa, Homo sapiens; identical to SEQ ID NO: 5423
  SIGNAL -96..-1
  UNSURE -57: Xaa = Asp,Glu

SEQ ID NO: 5425 - protein, 56 aa, Homo sapiens
  SIGNAL -30..-1
  UNSURE -27: Xaa = Phe,Ile,Leu,Val
  UNSURE -28: Xaa = Phe,Leu
MIXXLSRLWQKYPSGIQILPLLWKFFACRGACRVPDLCQSTCVILPRLKERAELQF

SEQ ID NO: 5426 - protein, 112 aa, Homo sapiens
  SIGNAL -96..-1
MAAALARLGLRPVKQVRVQFCPFEKNVESTRTFLQTVSSDKVRSTNLNCSVIADVRHDGSEPCVDVLFGDGHRLIMRGAHLTALEMLTAFASHIRARDAAGSGDKPGADTGR

SEQ ID NO: 5427 - protein, 102 aa, Homo sapiens
  SIGNAL -22..-1
  UNSURE 1: Xaa = Ala,Pro
  UNSURE 20: Xaa = Glu,Gln
MRRLLLVTSLVVVLLWEAGAVPXPKVPIKMQVKHWPSEQDPXKAWGARVVEPPEKDDQLVVLFPVQKPKLLTTEEKPRGQGRGPSFQAPRPGWRPRTPWAVS

SEQ ID NO: 5428 - protein, 57 aa, Homo sapiens
  SIGNAL -43..-1
MMLLNIFPLGNCELVVALKHTYKQNQKHCGLSLKLVFLPQCKAILPTNNTNNKTLHL

SEQ ID NO: 5429 - protein, 126 aa, Homo sapiens
  SIGNAL -41..-1
  UNSURE 62: Xaa = Lys,Arg
MAEDTSPNMNDNILLPVRNNDQALGLTQCMLGCVSWFTCFACSLRTQAQQVLFNTCRCKLLCQKLMEKTGILLLCAFGVSQGPASPRWRYPWALALIIGHWAXHCTARDSVPHLPDGCCCENYEMK

SEQ ID NO: 5430 - protein, 91 aa, Homo sapiens
  SIGNAL -81..-1
  UNSURE -5: Xaa = Ala,Pro
MIDGVPARGKVRGGDSGGGDSTMGPIELGSSSVPAPGPEGASPWLHDGLTMEPKNTAATGLLLPSQEPLLNSCQMAXATWGEEVGSKWMWS

SEQ ID NO: 5431 - protein, 116 aa, Homo sapiens
  SIGNAL -69..-1
MGRPWMVMILESKSEEKMWYGVFLWALVSSLFFHVPAGLLALFTLRHHKYGRFMSVSILLMGIVGPITAGILTSAAIAGVYRAAGKEMIPFEALTLGTGQTFCVLVVSFLRILATL

SEQ ID NO: 5432 - protein, 75 aa, Homo sapiens
  SIGNAL -19..-1
  UNSURE -7: Xaa = Ala,Gly
MGRAWWLTPVILXLREARADGSVELRNVRPAWAMWQNPASTKNTKTRWAWWHAPVVPATGEAEVGGWLEPGRQRL

SEQ ID NO: 5433 - protein, 71 aa, Homo sapiens
  SIGNAL -36..-1
MITPDYIDFGIRLFEFQLCHLPTLTLWTTSHSVTQAGVQWHNYSSLQPQTPGLKQSFHLCLLSNWDYRDGE

SEQ ID NO: 5434 - protein, 88 aa, Homo sapiens
  SIGNAL -24..-1
MSSGELRLPSSAALVSLFAPAAPCSISFLTIYVVSLLAVIMATTLLSIHCTSISQQALISVWQFLATAGSPIILLPWKGFESLHNPVL

SEQ ID NO: 5435 - protein, 64 aa, Homo sapiens [sequence omitted]

SEQ ID NO: 5436 - protein, 73 aa, Homo sapiens [sequence omitted]

SEQ ID NO: 5437 - protein, 53 aa, Homo sapiens [sequence omitted]

SEQ ID NO: 5438 - protein, 68 aa, Homo sapiens
  SIGNAL -51..-1
  UNSURE -2: Xaa = Arg,Trp
  UNSURE -44,-41: Xaa = Glu,Lys
  UNSURE 16: Xaa = Leu,Val
MKAKEWGXSGXLCRGRWSKNGEGPWSQRGWWVPLPKEGRQSLLCLGPWCXGWGGLGGTLPTPIPLPXS

SEQ ID NO: 5439 - protein, 86 aa, Homo sapiens
  SIGNAL -47..-1
  UNSURE 1: Xaa = Asp,His
MTECTSLQFVSPFAFEAMQKVDVVCLASLSDPELRLLLPCLVRMALCXLLTRAKAGLRIRNSSFAFFLEWKLSTPLLHCCPWTFML

SEQ ID NO: 5440 - protein, 58 aa, Homo sapiens
  SIGNAL -23..-1
MSDHIVLKVRLPLLITLEISAWGHLNLKISEVPRKIQGTKVQRSEDWQTDNNSPNLLH

SEQ ID NO: 5441 - protein, 119 aa, Homo sapiens [sequence omitted]

SEQ ID NO: 5442 - protein, 70 aa, Homo sapiens
  SIGNAL -62..-1
  UNSURE -31: Xaa = Asp,His
  UNSURE -51,-26: Xaa = Glu,Gln
MPRGRNATQRGXEKSEHTGLVGIPLKLLSLHXAFFVXSYFYTAVHSSSNLSLRICTSPWVSGSSFLSAPM

SEQ ID NO: 5443 - protein, 97 aa, Homo sapiens
  SIGNAL -25..-1
MAGKGSSGRRPLLLGLLVAVATVHLVICPYTKVEESFNLQATHDLLYHWQDLEQYDHLEFPGVVPRTFLGPVVIAVFSSPAVYVLSLLEMSKFFTLS

SEQ ID NO: 5444 - protein, 78 aa, Homo sapiens [sequence omitted]

SEQ ID NO: 5445 - protein, 79 aa, Homo sapiens [sequence omitted]

SEQ ID NO: 5446 - protein, 125 aa, Homo sapiens
  SIGNAL -110..-1
MESPFSPGLFHRLDEDWDSALFAELGYFTDTDELQLEAANETYENNFDNLDFDLDLMPWESDIWDITTKSVQLKILRQNLSHFLQPPQVIQSRLLGQWTLILQLSMFLRSWICLLVLRCLPFLIW

SEQ ID NO: 5447 - protein, 64 aa, Homo sapiens [sequence omitted]

SEQ ID NO: 5448 - protein, 88 aa, Homo sapiens
  SIGNAL -44..-1
MEHFDASLSTYFKALLGPRGISSSVLRMGPPLHTVVGWLQQLQAAHSEEEEKMFHLCGFKHKEVVSQSSLPAVIPQNSLATIASHAPA

SEQ ID NO: 5449 - protein, 100 aa, Homo sapiens
  SIGNAL -27..-1
MVPAAGRRPPRVMRLLGWWQVLLWVLGLPVRGVEVAEESGRLWSEEQPAHPLQVGAVYLGEEELLHDPMGQDGSRRGQCGAGAGHPRRSHGDAVCDSWGS

SEQ ID NO: 5450 - protein, 75 aa, Homo sapiens
  SIGNAL -19..-1
  UNSURE -12: Xaa = Arg,Thr
MGRAWWLXPVILALREARADGSVELRNVRPAWAMWQNPASTKNTKTRWAWWHAPVVPATGEAEVGGWLEPGRQRL

SEQ ID NO: 5451 - protein, 96 aa, Homo sapiens
  SIGNAL -55..-1
MALCALTRALRPLNLAPPTVAAPAPSLFPAAQMMNNGLLQQPSALMLLPCRPVLTSVALNANFVSWKSRTKYTITPVKMRKSGGRDHTGGNKDRGI

SEQ ID NO: 5452 - protein, 64 aa, Homo sapiens [sequence omitted]

SEQ ID NO: 5453 - protein, 99 aa, Homo sapiens
  SIGNAL -73..-1
MKKKEETTLSEMEPVEPQYQLVNAESTSPFLHCLREVIGEYSVHEFSLLGKTESQGIGLWIALVVFLSFLIFSTSFYISNAEQPFFKEPPTEAAKELSL

SEQ ID NO: 5454 - protein, 115 aa, Homo sapiens
  SIGNAL -65..-1
MEDVEARFAHLLQPIRDLTKNWEVDVAAQLGEYLEELDQICISFDEGKTTMNFIEAALLIQGSAASTVRRWNTSTHSSTRPLISSLERGGPSSSLRCRRTGPMGLPAPGSPGGRE

SEQ ID NO: 5455 - protein, 105 aa, Homo sapiens [sequence omitted]

SEQ ID NO: 5456 - protein, 128 aa, Homo sapiens
  SIGNAL -62..-1
  UNSURE -10: Xaa = Leu,Val
  UNSURE 35: Xaa = Lys,Arg
  UNSURE -53: Xaa = Lys,Gln
MSASQDSRSXRQWPRWGWSPKASIESNWNEIVDSFDDMNLFGVPSPWHLRLWXLRSPLPIQAASHFYLVSKGYDVIAQAQSGTGKTANICRYHFCSXIELDLKAHPKALVLAPTREFGSADTEGGHGH

SEQ ID NO: 5457 - protein, 81 aa, Homo sapiens
  SIGNAL -35..-1
MVHLLVLSGAWGMQMWVTFVSGFLLFRSLPRHTFGLVQSKLFPFYFHISMGCASSTSASWLHSMLGLSSHSGRPASFTCCS

SEQ ID NO: 5458 - protein, 92 aa, Homo sapiens
  SIGNAL -60..-1
MKAIRLSSVQECLFPPLGGGSWANTAVEITTFAIMRDRPEDCYSFYRSCLFLCNWPGLHGLLLFMVGKLIIIILEIPQDYVFCFQGYVLVSR

SEQ ID NO: 5459 - protein, 95 aa, Homo sapiens
  SIGNAL -17..-1
  UNSURE 7: Xaa = Glu,Gln
MFFWCACCLMVAWRVSASDEHCPXLPPVDNSIFVAKEVEGQILGTYVCIKGYHLVGKKTLFCNASKEWDNTTTECRLGHCPDPVLVNGEFSSSGL

SEQ ID NO: 5460 - protein, 100 aa, Homo sapiens [sequence omitted]

SEQ ID NO: 5461 - protein, 71 aa, Homo sapiens [sequence omitted]

SEQ ID NO: 5462 - protein, 124 aa, Homo sapiens
  SIGNAL -75..-1
  UNSURE -16: Xaa = Asp,Glu
MSGEENPASKPTPVQDVQGDGRWMSLHHRFVADSKDKEPEVVFIGDSLVQLMHQCEIWRXSSLLCMHLTLALVVTAHSMYCGGWRMGSWNTSGPRLWWSGWAQQPRTHSRAGDWWHQGHCATGE

SEQ ID NO: 5463 - protein, 124 aa, Homo sapiens; identical to SEQ ID NO: 5462
  SIGNAL -75..-1
  UNSURE -16: Xaa = Asp,Glu

SEQ ID NO: 5464 - protein, 141 aa, Homo sapiens
  SIGNAL -113..-1
  UNSURE -106: Xaa = Ala,Asp,Gly,Val
  UNSURE -38: Xaa = Leu,Val
MDQEPVGXVERGEAVAASGAAAAAAFGESAGQMSNERGFENVELGVIGKKKKVPRRVIHFVSGETMEEYSTDEDEXMAWRRKMFCLLLIRQNLPGVPTYGFTCFGLLHQLSQCVTSLERRLHLFWVSAPQSTNMPLMNIIG

SEQ ID NO: 5465 - protein, 51 aa, Homo sapiens
  SIGNAL -25..-1
MVKGHQLRLFSLLLWIFSCFRPSGCIHAGHRGYDGLAWAQRPDTKDLKKTT

SEQ ID NO: 5466 - protein, 125 aa, Homo sapiens
  SIGNAL -21..-1
  UNSURE 21: Xaa =  * ,Gly
  UNSURE -16: Xaa = Ala,Val
  UNSURE 93: Xaa = Lys,Gln
MAKYLXQIIVMGVQVVGRAFARALRQEFAASRAAADARGRAXHRSAAASNLSGLSLQEAQQILNVSKLSPEEVQKNYEHLFKVNDKSVGGSFYLQSKVVRAKERLDEELKIQAXEDREKGQMPHT

SEQ ID NO: 5467 - protein, 61 aa, Homo sapiens
  SIGNAL -21..-1
MAKYLAQIIVMGVQVVGRAFARALRQEFAGVSHQLGRPRVKCGLLRTERSPTCPHSQPGRS

SEQ ID NO: 5468 - protein, 53 aa, Homo sapiens
  SIGNAL -48..-1
MSLNLSRHSLWQGCPGFLLLNPWSVSIWIVSQITFLPFLSFFFFFSISVPTPY

SEQ ID NO: 5469 - protein, 75 aa, Homo sapiens [sequence omitted]

SEQ ID NO: 5470 - protein, 65 aa, Homo sapiens
  SIGNAL -57..-1
  UNSURE -18: Xaa = Lys,Asn,Arg,Ser,Thr
MKANCSSPGETGEVPRGIDCLTAAKYTEAPFGIADFSYAXPGLRSHLCFLAFQVLLCHPGWSAVA

SEQ ID NO: 5471 - protein, 65 aa, Homo sapiens
  SIGNAL -48..-1
  UNSURE 7: Xaa = Ala,Glu,Gly,Val
MAGQDPALSTSHPFYDVARHGILQVAGDDRFGRRVVTFSCCRMPPSRAGPPAAAXVFEVHTGPIR

SEQ ID NO: 5472 - protein, 57 aa, Homo sapiens
  SIGNAL -40..-1
  UNSURE -18: Xaa = Leu,Trp
MDYSRVFQGVFFTFKHAFADGAXGSFISLCSLQFLPNLSCLWQTLQVLGILEIIPVS

SEQ ID NO: 5473 - protein, 53 aa, Homo sapiens
  SIGNAL -36..-1
MCPPSQRAPTHLLCPWVDPGPVVLGLSLWVLAGGMGEGGEQLPAPLLCGSSFF

SEQ ID NO: 5474 - protein, 57 aa, Homo sapiens
  SIGNAL -24..-1
  UNSURE 25: Xaa = Arg,Ser
  UNSURE 19: Xaa = Asn,Thr
MRLTDLHKLQKLIFLLHPLHSATSVACLMAVGSAPLQKRKKKXQQQQNXAHPCQPHQ

SEQ ID NO: 5475 - protein, 62 aa, Homo sapiens
  SIGNAL -23..-1
MGSCCVAQAALELLASSEPPTWTCQIAGIISMSHCAQPYSPFCMTLSVFLKCKEKGFCYHLM

SEQ ID NO: 5476 - protein, 165 aa, Homo sapiens [sequence omitted]

SEQ ID NO: 5477 - protein, 92 aa, Homo sapiens
  SIGNAL -64..-1
MKRQMCMQRKCHVTTKAENGVTLQKEHQRLPANHQKLGEPWNRFFLTAPQKISILLISFSRTSSLQNCETINFYGLSYLMQSCQREMIINLF

SEQ ID NO: 5478 - protein, 59 aa, Homo sapiens
  SIGNAL -27..-1
  UNSURE -20: Xaa = Asp,Glu,Lys,Asn
MQFLREKXPVKLSNLLGLLYLTNTSICQGSGLIYKDPVGRARWLTPVIPALWEVEVGGS

SEQ ID NO: 5479 - protein, 63 aa, Homo sapiens
  SIGNAL -57..-1
  UNSURE 5: Xaa =  * ,Glu
  UNSURE -10: Xaa =  * ,Tyr
  UNSURE -12: Xaa = Ile,Met
  UNSURE -27: Xaa = Leu,Val
MHFLKGPSGDSVSEMLKTSGLGAQSSTFRSXIMPLLNTVGYHIDFXLXLFFFPLLYQIKSSXL

SEQ ID NO: 5480 - protein, 56 aa, Homo sapiens [sequence omitted]

SEQ ID NO: 5481 - protein, 85 aa, Homo sapiens
  SIGNAL -43..-1
MLQMLALLGYGLFGHCIVLFITYNIHLHALFYLFWLLVGGLSTLRMVAVLVSRTVGPTQRLLLCGTLAALHMLFLLYLHFAYHKV

SEQ ID NO: 5482 - protein, 82 aa, Homo sapiens
  SIGNAL -43..-1
MAKYQGEVQSLKLDDDSVIEGVSDQVLVAVVVSFALIATLVYALFRNVHQNIHPENQELVRVLREQLQTEQDAPADSTAVLH

SEQ ID NO: 5483 - protein, 55 aa, Homo sapiens
  SIGNAL -18..-1
MSYKPALFGFLFLLLLLSNWLVKYEHKLTLPEPQQLKRRKRNQRLLKTTPRTARP

SEQ ID NO: 5484 - protein, 74 aa, Homo sapiens
  SIGNAL -18..-1
  UNSURE 10: Xaa = Asp,Tyr
MWCLVFCCCVSLLGMVASSSIHVPARHXSGSFLWLHSIPWCINICATISSSSLSLMGIWVDSMLQRFLKIPSFL

SEQ ID NO: 5485 - protein, 71 aa, Homo sapiens
  SIGNAL -56..-1
MSPKTKSKRNFLSFIPHMWQDKLALSYPEVFCVTASFSSVLHCVLSILSLVPILLGVFFTGIHKFKPLLPH

SEQ ID NO: 5486 - protein, 98 aa, Homo sapiens
  SIGNAL -43..-1
MCETLLTSKWASVSPIPALLQEGENRDSRRLGDALLFLRPAGSCALQVSWPAALAGPRSHTGQLTQHFCHLKNDTCIPPSLGPPRNSGSLESLRSKRY

SEQ ID NO: 5487 - protein, 75 aa, Homo sapiens [sequence omitted]

SEQ ID NO: 5488 - protein, 57 aa, Homo sapiens [sequence omitted]

SEQ ID NO: 5489 - protein, 70 aa, Homo sapiens
  SIGNAL -31..-1
MCEDSMSLNPSFILFLRQSLALLPRLECCGAISAHCNLHLPGSSDSPASACRVAGITGVHHHAQLVFLYF

SEQ ID NO: 5490 - protein, 50 aa, Homo sapiens [sequence omitted]

SEQ ID NO: 5491 - protein, 82 aa, Homo sapiens
  SIGNAL -22..-1
MVLLFTLDFSLLMWDLLELCHCLSLMASQLKFVCLFNGIVGQVQWFTPIIPSLWEAEAGGLLESSSLRPGWATWQDPNFIKN

SEQ ID NO: 5492 - protein, 135 aa, Homo sapiens
  SIGNAL -86..-1
MSEMAELSELYEESSDLQMDVMPGEGDLPQMEVGSGSRELSLRPSRSGAQQLEEEGPMEEEEAQPMAAQRGNGALLTGPTLGSSQARWRAQTSRARTRARNLMTGRTTTTIPKRSSSVVPATEYQPLLKKPTRCF

SEQ ID NO: 5493 - protein, 58 aa, Homo sapiens
  SIGNAL -21..-1
MFPGSIINFLLLCSPLAYVFLSRQCIKRHRRAFLESCTSGLRKLKTPACGQRLLLLLL

SEQ ID NO: 5494 - protein, 72 aa, Homo sapiens [sequence omitted]

SEQ ID NO: 5495 - protein, 138 aa, Homo sapiens
  SIGNAL -88..-1
  UNSURE -28: Xaa = Gly,Arg
MSEMAELSELYEESSDLQMDVMPGEGDLPQMEVGSGSRELSLRTLPQRGPTARGGRPNGGXRKGPANGGARRGNGALLTGPTLGSSQARWLGADFESEDEGEEFDDWEDDYDYPEEGAAQWVPATEYQPLLKKPTRCF

SEQ ID NO: 5496 - protein, 53 aa, Homo sapiens
  SIGNAL -40..-1
MSASPKTRVGCALKCRPAGACGRAGCACGLCLLPFLPVFCFFNLGIEKAVRFC

SEQ ID NO: 5497 - protein, 51 aa, Homo sapiens
  SIGNAL -16..-1
MVVCICGFGCLRGCGGRIALAPEFGTSLGNMAGSYLCKKCKSWLGMDGVHL

SEQ ID NO: 5498 - protein, 104 aa, Homo sapiens
  SIGNAL -15..-1
MNRVLCAPAAGAVRALRLIGWASRSLHPLPGSRDRAHPAAEEEDDPDRPIEFSSSKANPHRWSVGHTMGKGHQRPWWKVLPLSCFLVALIIWCYLREESEATSG

SEQ ID NO: 5499 - protein, 76 aa, Homo sapiens
  SIGNAL -26..-1
  UNSURE 35: Xaa =  * ,Arg
  UNSURE 34: Xaa =  * ,Tyr
MISVISPEICHNALLWAWLWPKCTLTCVPGLAIYHYSSFVQGPLQRESTSPKRWTQWLAXXMRPLLLLRAESRNES

SEQ ID NO: 5500 - protein, 53 aa, Homo sapiens [sequence omitted]

SEQ ID NO: 5501 - protein, 59 aa, Homo sapiens [sequence omitted]

SEQ ID NO: 5502 - protein, 53 aa, Homo sapiens
  SIGNAL -24..-1
MGQLSHARWLTPVILALWEAKVSGSPEVRDLRPAWPTWRNPISTKNTKISQAW

SEQ ID NO: 5503 - protein, 83 aa, Homo sapiens
  SIGNAL -13..-1
  UNSURE 58: Xaa = Ser,Thr
MLLFSLWYPLLLCKLLLTKINWRKKRKKKRKRKREKRSQKSRQNHLQLKSCRRKISNWSLKKVPALKKLRXHCGSFRTCLEKD

SEQ ID NO: 5504 - protein, 71 aa, Homo sapiens
  SIGNAL -19..-1
  UNSURE 19: Xaa = Leu,Pro,Gln
  UNSURE 20: Xaa = Phe,Ile
MKSIILFVLSLLLILEKQAAVMGQKGGSKGQLPSGSFXXSTWTKRASTILDKKTNNILNPKAVFLFNTHIM

SEQ ID NO: 5505 - protein, 67 aa, Homo sapiens [sequence omitted]

SEQ ID NO: 5506 - protein, 53 aa, Homo sapiens; identical to SEQ ID NO: 5502
  SIGNAL -24..-1

SEQ ID NO: 5507 - protein, 99 aa, Homo sapiens
  SIGNAL -19..-1
  UNSURE 12: Xaa = Gln,Arg
  UNSURE -16: Xaa = Ile,Asn
  UNSURE -14: Xaa = Ile,Leu
  UNSURE 17,30: Xaa = Phe,Ser
  UNSURE -17: Xaa = Pro,Ser
MKXXIXFVLSLLLILEKQAAVMGQKGGSKGXLPSEXSQFPHGQKGQHYXGQKGKQQTESKGSFSIQHTYHVDINDHDWTYSVMNKKADTNRNPVSHIIL

SEQ ID NO: 5508 - protein, 70 aa, Homo sapiens
  SIGNAL -43..-1
  UNSURE 20: Xaa = Asp,His,Asn,Tyr
  UNSURE -31: Xaa = Leu,Pro,Gln,Arg
MSLKGKARPFYGXLIEELCSDYWSRCVNPELILVLAQLHCVTLEKLLTFLGFFCCCCLFFKQXLMGGHDV

SEQ ID NO: 5509 - protein, 62 aa, Homo sapiens
  SIGNAL -19..-1
  UNSURE 38: Xaa = Ile,Thr
  UNSURE 12: Xaa = Pro,Thr
MAPFEPLASGILLLLWADSPQQGLHLCPTPXHRRPSAIPTSSSGPSSWGHQKVNQTXFIPAL

SEQ ID NO: 5510 - protein, 67 aa, Homo sapiens
  SIGNAL -23..-1
  UNSURE 26: Xaa =  * ,Gly
  UNSURE 20,23: Xaa = Cys,Gly
  UNSURE 27: Xaa = Glu,Lys
  UNSURE 24: Xaa = Leu,Pro
  UNSURE 18: Xaa = Lys,Arg
  UNSURE 22: Xaa = Lys,Met
  UNSURE 19: Xaa = Phe,Val
MFKSFAGHETVCWMISYIAGCLGSLVPFHYSHHVTPERPNXXXKXXXHXXALSLGWEGLGPDLVSGG

SEQ ID NO: 5511 - protein, 58 aa, Homo sapiens [sequence omitted]

SEQ ID NO: 5512 - protein, 117 aa, Homo sapiens
  SIGNAL -47..-1
  UNSURE -28: Xaa = Arg,Thr
MSSLWSRLGPLFPSPQCQRXKSLPLLPRLECGGVILAHSTSTSQVQAILLQPLPPRFKRFSCLGLLSSWDYKRVPPTLDDFCIFSRGRVSPCLSGWSRTPDLVILLPRPPKVLGLQA

SEQ ID NO: 5513 - protein, 64 aa, Homo sapiens [sequence omitted]

SEQ ID NO: 5514 - protein, 55 aa, Homo sapiens [sequence omitted]

SEQ ID NO: 5515 - protein, 86 aa, Homo sapiens
  SIGNAL -81..-1
  UNSURE -20: Xaa = His,Gln
MWPSLLLAIKTANFVAVDTELSGLGDRKSLLNQCIEERYKAVCHAARTRSILSLGLACFKRXQTRVNIPIWLKCSISLCCAWRSMS

SEQ ID NO: 5516 - protein, 94 aa, Homo sapiens
  SIGNAL -78..-1
  UNSURE -31: Xaa = Ala,Gly,Pro,Arg
  UNSURE -5: Xaa = Gly,Arg
MLSGDAQEAGAEAGRPSRTLRAHSLQAVESELPPPETPKQSPVSGAEXGDLRNCSPRGGRGSRFRPVCLACACXVSAAWAPRDCGLGGMSLAFP

SEQ ID NO: 5517 - protein, 115 aa, Homo sapiens
  SIGNAL -109..-1
MLEVSDALGGPGRVPGATAGMNGVDTSLLCDLLQALTFLTRNEILCIHDTFLKLCPPGKYYKEATLTMDQVSSLPALRSTLSETVSAECSPTKACSPLRMCWAWHLCSASRPAQA

SEQ ID NO: 5518 - protein, 102 aa, Homo sapiens
  SIGNAL -27..-1
  UNSURE -12: Xaa = Leu,Pro
MQRVSGLLSWTLSRVXWLSGLSEPGAARQPRIMEEKALEVYDLIRTIRDPEKPNTLEELEVVSESCVEVQEINEEEYLVIIRFTPTVPHCSLATLIVGNLHF

SEQ ID NO: 5519 - protein, 95 aa, Homo sapiens
  SIGNAL -25..-1
MASVVLALRTRTAVTSLLSPTPATALAVRYASKKSGGSSKNLGGKSSGRRQGIKKMEGHYVHAGNIIATQRHFRWHPGAMWVLGRINVCMPWKRG

SEQ ID NO: 5520 - protein, 77 aa, Homo sapiens
  SIGNAL -68..-1
MSFAPQKPAVARLSATSCRCFNGSWASQAWTPFLSPRPEAWSLFLPENWPNRCGLWPTLGPLLGPAGAGPGGRPRHA

SEQ ID NO: 5521 - protein, 74 aa, Homo sapiens
  SIGNAL -20..-1
MKGMVFLLYGLPTFPGQSWAQGRGGRGGKDVMEISSIGHRRQVCGLPFSSTGVQMSLPCEHNSGRNEDVIFLHF

SEQ ID NO: 5522 - protein, 118 aa, Homo sapiens
  SIGNAL -110..-1
MENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMLPCCSA

SEQ ID NO: 5523 - protein, 73 aa, Homo sapiens
  SIGNAL -36..-1
MAEDTSPNMNDNILLPVRNNDQALGLTQCMLGCVYASCCARSSWRRQAFCSSVLSVCPRALPVPGGGIPGPWH

SEQ ID NO: 5524 - protein, 200 aa, Homo sapiens
  SIGNAL -20..-1
MDSSTAHSPVFLVFPPEITASEYESTELSATTFSTQSPLQKLFARKMKILGTIQILFGIMTFSFGVIFLFTLLKPYPRFPFIFLSGYPFWGSVLFINSGAFLIAVKRKTTETLIILSRIMNFLSALGAIAGIILLTFGFILDQNYICGYSHQNSQCKAVTVLFLGILITLMTFSIIELFISLPFSILGCHSEDCDCEQCC

SEQ ID NO: 5525 - protein, 58 aa, Homo sapiens [sequence omitted]

SEQ ID NO: 5526 - protein, 83 aa, Homo sapiens
  SIGNAL -29..-1
MSFFQLLMKRKELIPLVVFMTVAAGGASSFAVYSLWKTDVILDRKKNPEPWETVDPTVPQKLITINQQWKPIEELQNVQRVTK

SEQ ID NO: 5527 - protein, 67 aa, Homo sapiens
  SIGNAL -20..-1
MDSSTAHSPVFLVFPPEITASEYESTELSATTFSTQSPLQKLFARKMKILGDIHSGALFCSLILEPS

SEQ ID NO: 5528 - protein, 58 aa, Homo sapiens
  SIGNAL -48..-1
  UNSURE -41: Xaa = Lys,Gln
MEFHHVGXAGFEFLTSSDLTALASQNAGITDTSHHAQLMLLFVEGSICTIQHSHPLWL

SEQ ID NO: 5529 - protein, 110 aa, Homo sapiens
  SIGNAL -83..-1
MVFGAMVLLVGLEELTNIRNVERLKKDLRASYCLIDSFLGDSELIGDLTQCVDCVIPPEGSLLQISSYLYLNTALVDLPGVAASQACDSQQVTWLLYVANGAYSACNRPG

SEQ ID NO: 5530 - protein, 63 aa, Homo sapiens
  SIGNAL -49..-1
MLANGFLVLRNDQSLGSNEFLKTKQQQQKKNRRSFALVTGAVCSGAILAHCNLHLLCSTDSPP

SEQ ID NO: 5531 - protein, 67 aa, Homo sapiens; identical to SEQ ID NO: 5527
  SIGNAL -20..-1

SEQ ID NO: 5532 - protein, 77 aa, Homo sapiens
  SIGNAL -38..-1
  UNSURE 23: Xaa = Arg,Ser
  UNSURE 29: Xaa = Lys,Thr
  UNSURE 25: Xaa = Pro,Gln
MSLIILTRDDEPRIFTPDSDAASPALHSTSPLPDPASASPLHREEKILPKVCNIVSCLSFXLXASPXDSGLASPTIM

SEQ ID NO: 5533 - protein, 62 aa, Homo sapiens
  SIGNAL -22..-1
MWATLPLLCAGAWLLGVPVCGAAELCVNSLEKFHFKSWMSKKTKAHCVLVAESVGEHQCMCF

SEQ ID NO: 5534 - protein, 70 aa, Homo sapiens
  SIGNAL -52..-1
  UNSURE -14: Xaa = Ala,Gly
MLSKGLKRKREEEEEKEPLAVDSWWLDPGHTAVAQAPPXVALAPSLTSQCSSSTTACSRVSRTCGTWCWS

SEQ ID NO: 5535 - protein, 50 aa, Homo sapiens
  SIGNAL -28..-1
  UNSURE 14: Xaa = Ala,Pro
  UNSURE 15: Xaa = Asn,Thr
MVSHPINVLVGRAWWLMPVILALWEAEAGGSFEVRSSRTTSXXMVKPHLY

SEQ ID NO: 5536 - protein, 50 aa, Homo sapiens
  SIGNAL -34..-1
MGGEEWSSETRDMILLQLRYFIIMLSNFPFSILGEMASSMCSVPIAFLGK

SEQ ID NO: 5537 - protein, 127 aa, Homo sapiens
  SIGNAL -14..-1
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQSI

SEQ ID NO: 5538 - protein, 99 aa, Homo sapiens
  SIGNAL -76..-1
MLARATFRAASAPTLVARRGFQSTRAQMASPYHYPEGPRSNLPFDPLKKGFAFKYWGFMGTGFALPFLLAVWQTEQAVNALRHGVDMRIGIPGNTAFVD

SEQ ID NO: 5539 - protein, 89 aa, Homo sapiens [sequence omitted]

SEQ ID NO: 5540 - protein, 134 aa, Homo sapiens
  SIGNAL -14..-1
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNGSTPNVPAFWTMLAKAINGQQWSWMIKINYFTQFQSLM

SEQ ID NO: 5541 - protein, 66 aa, Homo sapiens
  SIGNAL -20..-1
MLMAFGWGFSVCWSLLEVRSRPCLPGYYQQRLQNSKDCCLVLTMEALSQRAPARCQLELSCMRYEK

SEQ ID NO: 5542 - protein, 159 aa, Homo sapiens
  SIGNAL -20..-1
MGPLGGGSCCCWGTPHSCRCRPCCLMAAIGVHLGCTSACVAVYKDGRAGVVANDAGDRVTPAVVAYSENEEIVGLAAKQSRIRNISNTVMKVKQILGRSSSDPQAQKYIAESKCLVIEKNGKLRYEIDTGEETKFVNPEDVARLIFSKMKRSLFSMESV

SEQ ID NO: 5543 - protein, 88 aa, Homo sapiens
  SIGNAL -81..-1
MQIVASDGFTSQTDSTQKMSCRQSSNCISQFRTRQSNNWNCDSRDRPLDVTLLFKRKLCGGRCKNIFILVCSAVVLLFILGVACHGHR

SEQ ID NO: 5544 - protein, 78 aa, Homo sapiens
  SIGNAL -45..-1
MVGVIIEGPNLLDLLFPSLPPSGRKGWVLPPGCVFLIHFSFFLLSQDQESPSALSGASLAESEEENTPIVSPLPLICC

SEQ ID NO: 5545 - protein, 70 aa, Homo sapiens
  SIGNAL -33..-1
  UNSURE 16: Xaa = Cys,Phe
MPAVVSPCSPSGKVLGVKSTHLMTTMLSLSSHCEVVISRVISYITRHGXTFALPQFPHVLAIAALDLSSK

SEQ ID NO: 5546 - protein, 102 aa, Homo sapiens
  SIGNAL -43..-1
MLPLKPPGEDLFLPFHLPVATDCSLQSPPGPHMLSSLCTCVFTRYSPACVYVCVHMFFLEGHWSCYIKAHFNGSILNFMTTAKKSHSQALGLRSLTHLFEGT

SEQ ID NO: 5547 - protein, 111 aa, Homo sapiens
  SIGNAL -68..-1
  UNSURE 19: Xaa = Ala,Gly
MDFVAGAIGGVCGVAVGYPLDTVKVRIQTEPKYTGIWHCVRDTYHRERVWGFYRGLSLPVCTVSLVSSVSFGTYRHCLAHICRLRYXTLTPSPPRPTSRSRDAPPASSACS

SEQ ID NO: 5548 - protein, 56 aa, Homo sapiens
  SIGNAL -13..-1
  UNSURE -6: Xaa =  * ,Pro,Gln,Ser
  UNSURE -5: Xaa = Ala,Gly
  UNSURE -3: Xaa = Cys,Trp
  UNSURE -12: Xaa = Leu,Val
  UNSURE 1: Xaa = Phe,Leu
  UNSURE 5: Xaa = Pro,Ser
MXLYLLCXXLXLAXVRYXNKYFVEWMNAAYWNLSSLGTVAHTCNPSILGGQGRWIT

SEQ ID NO: 5549 - protein, 99 aa, Homo sapiens [sequence omitted]

SEQ ID NO: 5550 - protein, 71 aa, Homo sapiens
  SIGNAL -37..-1
  UNSURE 32: Xaa = Ala,Gly
MCHHAQLSFALSVETGFHHVGQASFELLTSSDPPASASESARITGVRHCAQPHPCEFLIVHKFFHYLCXVL

SEQ ID NO: 5551 - protein, 53 aa, Homo sapiens
  SIGNAL -28..-1
  UNSURE 7: Xaa = Gly,Val
MLFNNIFQVCSQNQAIFMVRLVCSLIFSGCKVRKXSTPCCSLKRALLPSSKKR

SEQ ID NO: 5552 - protein, 52 aa, Homo sapiens
  SIGNAL -28..-1
MFQLLVHSSPPIVSVSLFLLCFPSPHNQSQERRPHDHLILPSKQVFFSEARS

SEQ ID NO: 5553 - protein, 56 aa, Homo sapiens
  SIGNAL -45..-1
MSGHRLCCISHVQYEQRSLPILLQQVQRSLTEVLWFLLNCMLIMSGQEDVYMKRMF

SEQ ID NO: 5554 - protein, 58 aa, Homo sapiens [sequence omitted]

SEQ ID NO: 5555 - protein, 60 aa, Homo sapiens
  SIGNAL -26..-1
MCRDGVSLCCPGCLELLGSSNPLTLASQSAPRQPPRPAYICSFECLSYTWHVQGILYIFI

SEQ ID NO: 5556 - protein, 80 aa, Homo sapiens
  SIGNAL -20..-1
MMGSPVSHLLAGFCVWVVLGWVGGSVPNLGPAEQEQNHYLAQLFGLYGENGTLTAGGLARLLHSLGLGRVQGLRWDSMGL

SEQ ID NO: 5557 - protein, 56 aa, Homo sapiens; identical to SEQ ID NO: 5553
  SIGNAL -45..-1

SEQ ID NO: 5558 - protein, 106 aa, Homo sapiens
  SIGNAL -17..-1
  UNSURE -2: Xaa = Arg,Thr
  UNSURE 14: Xaa = Leu,Met,Val
MEVGLPAITLFLTSAXALWWRRRWTRSQWAXWNEEKPSQPRELRPPRHSGNLQGRQNLPGVPTYGFTCFGLLHQLSQCVTSLERRLHLFWVSAPQSTNMPLMNIIG

SEQ ID NO: 5559 - protein, 85 aa, Homo sapiens
  SIGNAL -15..-1
MKKVLLLITAILAVAVDFPVSQDQEREKRSISDSDELASGFFVFPYPYPFRPLPPIPFPRFPWFRRNFPIPIPESAPTTPLPSEK

SEQ ID NO: 5560 - protein, 164 aa, Homo sapiens
  SIGNAL -157..-1
MRLTEKSEGEQQLKPNNSNAPNEDQEEEIQQSEQHTPARQRTQRADTQPSRCRLPSRRTPTTSSDRTINLLEVLPWPTEWIFNPYRLPALFELYPEFLLVFKEAFHDISHCLKAQMEKIGLPSYSTSSHSPPSTSTSFSFLQFFPFLSLFFLYFCFCFLLLSSF

SEQ ID NO: 5561 - protein, 53 aa, Homo sapiens [sequence omitted]

SEQ ID NO: 5562 - protein, 92 aa, Homo sapiens
  SIGNAL -18..-1
MAPNSITLLGLAVNVVTTLVLISYCPTATEEAPYWTYLLCALGLFIYQSLDAIDGKQARRTNSCSPLGSSLTMAVTLFPQYLWQWELQLPLA

SEQ ID NO: 5563 - protein, 70 aa, Homo sapiens
  SIGNAL -67..-1
MLDRTQIMTPTPEYLEAEGQCGPVSSDCLGEAVLLLAKNHASEPFFLLHPLGLHSINLLFFFLSSTSIFL

SEQ ID NO: 5564 - protein, 128 aa, Homo sapiens
  SIGNAL -21..-1
MSCSLKFTLIVIFFYCWLSSSHEELEGGTSKSFDLHTVIMLVIAGGILAALLLLIVVVLCLYFKIHNALKAAKEPEAVAVKNHNPDKVWWAKNSQAKTIATESCPALQCCEGYRCVPVLIPCHLAVAT

SEQ ID NO: 5565 - protein, 164 aa, Homo sapiens
  SIGNAL -16..-1
MSGCGLFLRTTAAARACRGLVVSTANRRLLRTSPPVRAFAKELFLGKIKKKEVFPFPEVSQDELNEINQFLGPVEKFFTEEVDSRKIDQEGKIPDETLEKLKSLGLFGLQVPEEYGGLGFSNTMYSRLGEIISMDGSITVTLAAHQAIGLKGIILAGTEEQKAK

SEQ ID NO: 5566 - protein, 85 aa, Homo sapiens
  SIGNAL -19..-1
MASDSDVKMLLNFVNLASSDIKAALDKSAPYRRSVDHRKYLQKQLKRFSQKYSRLPRGLPGRAAEPYLKKGSEDRPRRAAPGFGP

SEQ ID NO: 5567 - protein, 139 aa, Homo sapiens
  SIGNAL -15..-1
  UNSURE 104: Xaa = Gly,Arg
MEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLXFHLLCFFMYLYSMILALIND

SEQ ID NO: 5568 - protein, 58 aa, Homo sapiens
  SIGNAL -46..-1
MKHVVRTLLDTMLNYSPIGCEELCYIQAYPLNSVYIFFSFLSFVWQDTILVALLCNEV

SEQ ID NO: 5569 - protein, 58 aa, Homo sapiens
  SIGNAL -16..-1
MVEAGLLIYFPQPSYGGFRHLVPHDSKCSLLFSIGINYHLARNTGPTPKRVESGSAFE

SEQ ID NO: 5570 - protein, 50 aa, Homo sapiens
  SIGNAL -41..-1
  UNSURE -39: Xaa = Cys,Ser
MFXLCTETSLFFKYLGRSTLVHASYTTFFCCLALVGLQILCAFLNLPYFM

SEQ ID NO: 5571 - protein, 118 aa, Homo sapiens
  SIGNAL -102..-1
MVARVWSLMRFLIKGSVAGGAVYLVYDQELLGPSDKSQAALQKAGEVVPPAMYQFSQYVCQQTGLQIPQLPAPPKIYFPIRDSWNAGIMTVMSALSVAPSKAREYSKEGWEYVKARTK

SEQ ID NO: 5572 - protein, 110 aa, Homo sapiens
  SIGNAL -49..-1
  UNSURE 49: Xaa = Asn,Ser
  UNSURE 57: Xaa = Gly,Trp
MEKPLFPLVPLHWFGFGYTALVVSGGIVGYVKTGSVPSLAAGLLFGSLAGLGAYQLYQDPRNVWGFLAATSVTFVGVMGMRSYYYGKFMPVGLIAGAXLLMAAKVXKFVC

SEQ ID NO: 5573 - protein, 56 aa, Homo sapiens
  SIGNAL -37..-1
MHHHVQLIFSFFVETKFYHISQAGLELLTSSHLPISASQSAGITGISNCTWPKINF

SEQ ID NO: 5574 - protein, 90 aa, Homo sapiens
  SIGNAL -15..-1
MMSSMALSSTSLCSSFISQHPKLSITASPPLFHTQTTKPISVKRKIITLAAPETLTAETVTGIDTSDNTPQQTTKVVKPDEKSRVVLKFV

SEQ ID NO: 5575 - protein, 60 aa, Homo sapiens
  SIGNAL -31..-1
MISCFPVIPHRHYLLLPSYLAFLLFLEHVRSGLPLWPLHLFLCLEFFPQRYPHDSITSFW

SEQ ID NO: 5576 - protein, 50 aa, Homo sapiens
  SIGNAL -36..-1
  UNSURE -18: Xaa = Ala,Pro
MVALAYVGTAFFYMMLAAXVRSATSMVLLLVNCGNSDPESGGATAGIVSV

SEQ ID NO: 5577 - protein, 81 aa, Homo sapiens [sequence omitted]

SEQ ID NO: 5578 - protein, 73 aa, Homo sapiens
  SIGNAL -14..-1
MGVFVCICVGRAFGGKVTGSSRPLGNRDPGDKDGDISSVFHLETSTPASGSLDTFWGPTEAVAIQSVPSLSGE

SEQ ID NO: 5579 - protein, 62 aa, Homo sapiens
  SIGNAL -39..-1
MWTEIFIFCLRIYEVYHIRGLKQGVYFVILKLFCIWTNTKYPSGLFFFFLKPVYPSHPLAHS

SEQ ID NO: 5580 - protein, 50 aa, Homo sapiens [sequence omitted]

SEQ ID NO: 5581 - protein, 72 aa, Homo sapiens
  SIGNAL -53..-1
MGTIHLFRKPQRSFFGKLLREFRLVAADRTWKILLFGVINLICTGFLLMWCSSTNSIALTAYTYLTIFDLFR

SEQ ID NO: 5582 - protein, 58 aa, Homo sapiens
  SIGNAL -18..-1
  UNSURE 1: Xaa = Leu,Met,Val
MPLTHSFLWLSSIPSCVCXYVCVYVYLYISHSFFIHSLIDGMGILVGSTVLQLQIVLL

SEQ ID NO: 5583 - protein, 69 aa, Homo sapiens [sequence omitted]

SEQ ID NO: 5584 - protein, 62 aa, Homo sapiens
  SIGNAL -43..-1
MIVRPPRQLISSVIHIFRIIVKFGKASIKILFLACNFMLQCLSLALLPRLECSGSDRSLLQP

SEQ ID NO: 5585 - protein, 63 aa, Homo sapiens [sequence omitted]

SEQ ID NO: 5586 - protein, 56 aa, Homo sapiens; identical to SEQ ID NO: 5573
  SIGNAL -37..-1

SEQ ID NO: 5587 - protein, 58 aa, Homo sapiens
  SIGNAL -45..-1
MSFQHFHLNCSCNIFAQKGLRKRILWLKEKNSIIWSLILMSPVETLGMNFVGTVIQDI

SEQ ID NO: 5588 - protein, 64 aa, Homo sapiens
  SIGNAL -14..-1
MFCCCWFLFFETESRSVAQAGVHWCHLGSLQAPCPEFTPFSCLSMPSRWEYRHAPPRPANFLCF

SEQ ID NO: 5589 - protein, 57 aa, Homo sapiens
  SIGNAL -27..-1
MTLCSLQRLGSSSVAELIYLFSPPALGSFLGPSLTTCYSSSKFGFLPLSCPQTHCHF

SEQ ID NO: 5590 - protein, 60 aa, Homo sapiens
  SIGNAL -31..-1
  UNSURE 3: Xaa = Cys,Phe,Ser,Tyr
MKLSLDKVEDKAGFGHHRLIVPSGWSTRSCAVPXRPATTRPAVVIPESMGTGAIAMQRGT

SEQ ID NO: 5591 - protein, 64 aa, Homo sapiens
  SIGNAL -34..-1
MMFRSMTTYRKVVPQDYNTVFLLCLFYVWLCLETQILTMLQPATVFSTLRAIQFCSLSATRYTI

SEQ ID NO: 5592 - protein, 120 aa, Homo sapiens
  SIGNAL -105..-1
MMAAALGPPEVIAQLENAAKVLMAGVQWHDLGSLPPPPPGFKRFSCLSLPSSWDYRHHLPWSIMNNASMQSTYSYHLGNQNHHLQFASIFWKLVKWTMSLSSCHSHNGSSCPRVDSLGKR

SEQ ID NO: 5593 - protein, 106 aa, Homo sapiens [sequence omitted]

SEQ ID NO: 5594 - protein, 97 aa, Homo sapiens
  SIGNAL -74..-1
MVQLHQDTDPQIPKGQPCTLNSSEGGARPAVPHTLFSSALDRWLHNDSFIMAVGEPLVHIRVTLLLLWFGMFLSISGHSQARPSQYFTSPEVVIPLK

SEQ ID NO: 5595 - protein, 107 aa, Homo sapiens
  SIGNAL -41..-1
  UNSURE 54: Xaa = Asp,Asn
  UNSURE -14,50,56: Xaa = Gly,Val
  UNSURE 33: Xaa = Phe,Ser
MACVTEYAVTGGGCRHKFHALGVNTASXFFFLSFFPSFLRQSLALWPRLECSGAISAHCNLRLPSSSDSLASAXRVAGTTGTRQHARLIFXFSRXGXSLLARMVSNS

SEQ ID NO: 5596 - protein, 106 aa, Homo sapiens
  SIGNAL -97..-1
METGLFPGSNATFRILEVGCGAGNSVFPILNTLENSPESFLYCCDFASGAVELVKSHSSYRATQCFAFVHDVCDDGLPYPFPDGILDVILLVFVLSSIHPDGCKVL

SEQ ID NO: 5597 - protein, 53 aa, Homo sapiens
  SIGNAL -46..-1
MFPDKLALAFSKPPFPLSSGLSQILLCTSGVPLGATFTTSLPLTQAGSQALGS

SEQ ID NO: 5598 - protein, 97 aa, Homo sapiens
  SIGNAL -60..-1
MSSAPEPPTFKKEPPKEKEFQSPGLRGVRTTTLFRAVNPELFIKPNKPVMAFGLVTLSLCVAYIGYLHAIQENKKDLYEAIDSEGHSYMRRKTSKWD

SEQ ID NO: 5599 - protein, 83 aa, Homo sapiens
  SIGNAL -41..-1
MWDQDYDKKVTRTANRPIAAGDISTFQSFVFLGGQLTLALGVLLCLNYYSSGSRILTSCHHLPTNEKNFILASTSLGTKEMMF

SEQ ID NO: 5600 - protein, 75 aa, Homo sapiens [sequence omitted]

SEQ ID NO: 5601 - protein, 51 aa, Homo sapiens
  SIGNAL -40..-1
MSQQHRRKRPSSERQVSKTATDGSYLLVFTSYVISSPVWAGPGDLLPVNRI

SEQ ID NO: 5602 - protein, 95 aa, Homo sapiens
  SIGNAL -42..-1
  UNSURE 44: Xaa = Ala,Pro,Ser,Thr
MTESGSVTQAGLRWHDLSSLQPPPPAFRGFSCLGPLSSCSTGVRYRAWLIFVFLIETGFCHVVQAGLELLTSGDPPALASQGAGVXGESHAAQPM

SEQ ID NO: 5603 - protein, 106 aa, Homo sapiens
  SIGNAL -91..-1
  UNSURE -6: Xaa = Gly,Arg
MAEPDPSHPLETQAGKVQEAQDSDSDSEGGAAGGEADMDFLRNLFSQTLSLGSQKERLLDELTLEGVARYMQSERCRRVICLVGAXISTSAASPTFALHPPASMTT

SEQ ID NO: 5604 - protein, 53 aa, Homo sapiens; identical to SEQ ID NO: 5597
  SIGNAL -46..-1

SEQ ID NO: 5605 - protein, 192 aa, Homo sapiens [sequence omitted]

SEQ ID NO: 5606 - protein, 66 aa, Homo sapiens
  SIGNAL -16..-1
  UNSURE 47,50: Xaa = Phe,Leu
MADSLFCFVVLFETESRSVAQAGVQWRDLGSLQAPPSGFTPFSCLSLPRSWDYRHPPPRLANXLYX

SEQ ID NO: 5607 - protein, 79 aa, Homo sapiens
  SIGNAL -14..-1
  UNSURE 33: Xaa =  * ,Cys,Phe,Leu,Ser,Trp,Tyr
  UNSURE 38: Xaa = Ala,Pro
  UNSURE 31,36: Xaa = Arg,Ser,Thr
  UNSURE 37: Xaa = Ile,Leu,Val
MSVLTPLLLRGLTGSARRLPVPRAKIHSLPPEGKLGIMELAVGLXSXFVXXXPASGLDPVTPGDLQEARVKGSVLSLTL

SEQ ID NO: 5608 - protein, 59 aa, Homo sapiens
  SIGNAL -16..-1
  UNSURE -3: Xaa = Ala,Thr
  UNSURE 3: Xaa = Asp,Gly
MSGCGLFLRTTAAXRACRXLVVSTANRRLLRTSPPVRAFAKELFLGKIKKCCVYFTDVL

SEQ ID NO: 5609 - protein, 100 aa, Homo sapiens
  SIGNAL -55..-1
  UNSURE 45: Xaa = Ala,Ser,Thr
  UNSURE 44: Xaa = Arg,Thr
  UNSURE -7: Xaa = Leu,Ser
  UNSURE 7: Xaa = Lys,Gln
  UNSURE -8: Xaa = Phe,Ile
  UNSURE 6: Xaa = Pro,Arg
  UNSURE -3: Xaa = Ser,Thr
MEELHRQEGTLTLLEGNPKAGPKRRGGTPGSRILGPYFPATGVHSLSXXLPSXQLAPDVPXXPCFSLGEVWRKPKSLSLFPLVQLTIGKSRGSRNGSGXX

SEQ ID NO: 5610 - protein, 83 aa, Homo sapiens
  SIGNAL -36..-1
  UNSURE -18: Xaa = Ile,Asn
MLAAVGRPKPRSPLSSLSXFAAVLVLLLYPQELTWTQIPRAALERQQLRLQGAAKILRGHFTARDRVCLSSVPSASSSRRDPP

SEQ ID NO: 5611 - protein, 74 aa, Homo sapiens [sequence omitted]

SEQ ID NO: 5612 - protein, 60 aa, Homo sapiens
  SIGNAL -30..-1
  UNSURE 10: Xaa = Asp,Glu,His,Gln
MAPPLLNWELPGTKVSRCAAAALGFGSARCWPVSRTQLCXLPKPQSLLLNQFLTIGFISS

SEQ ID NO: 5613 - protein, 80 aa, Homo sapiens
  SIGNAL -20..-1
  UNSURE 8: Xaa =  * ,Cys,Phe,Leu,Tyr
  UNSURE 51: Xaa = His,Gln
MALGSMYLVLTLIVAKVLRGAEPCCGPXKNRVLRPCPLPVHCPLPIPSPAEGIPWVAYLPIRWFISCCPGXCIQIPMCTS

SEQ ID NO: 5614 - protein, 68 aa, Homo sapiens
  SIGNAL -43..-1
MRLTFHMTCSESFRLGLTKGKRTLGQGTKPICPLFCFMPTSFSTFSLSPHTHTYHHSNCTPTLIDFRR

SEQ ID NO: 5615 - protein, 62 aa, Homo sapiens [sequence omitted]

SEQ ID NO: 5616 - protein, 50 aa, Homo sapiens
  SIGNAL -39..-1
MRYVCEVLIVERIFKSGVRVFVDMANFIFLLFCEPYCESWLLSWTLKSFT

SEQ ID NO: 5617 - protein, 115 aa, Homo sapiens
  SIGNAL -46..-1
MKTLFNPAPAIADLDPQFYTLSDVFCCNESEAEILTGLTVGSAADAGEAALVLLKRGCQVVIITLGAEGCVVLSQTEPEPKHIPTEKVKAVDTTCRPGSRPKSEAASVKKQKHYK

SEQ ID NO: 5618 - protein, 124 aa, Homo sapiens
  SIGNAL -32..-1
  UNSURE 18: Xaa = Ile,Val
  UNSURE 7: Xaa = Phe,Leu
MVVVEPGASLFPNGVPWLYAVFAVLFVFFLFAMLSPFLXEIDQHIKKFLXRCRYSLHNTVHKDKKNSEIKMDHLERPGCPLESPRRGVLGGKKNGMGNDPLLFVKVTKEPRDSEAEIYTPGPSV

SEQ ID NO: 5619 - protein, 108 aa, Homo sapiens
  SIGNAL -103..-1
MAVRASFENNCEIGCFAKLTNTYCLVAIGGSENFYSVFEGELSDTIPVVHASIAGCRIIGRMCVGDRRNSGRCAQGGSLQTDSGRPGASRKLLCLQQSGRAGASQDFN

SEQ ID NO: 5620 - protein, 78 aa, Homo sapiens
  SIGNAL -41..-1
MSASVVSVISRFLEEYLSSTPQRLKLLDAYLLYILLTGALQFGYCLLVGTFPFNSFLSGFISCVGSFILAGSLFEFPG

SEQ ID NO: 5621 - protein, 60 aa, Homo sapiens
  SIGNAL -15..-1
  UNSURE 6: Xaa = His,Gln
MPLFRVLFSCTCALLQDFRMXPCPPTPTSQGRPVLLGRQTSQEYILHNYTNRPLFKAFGL

SEQ ID NO: 5622 - protein, 90 aa, Homo sapiens
  SIGNAL -75..-1
MAEQTDSDSDSEGGAAGGEADMDFLRNLFSQTLSLGSQKERLLDELTLEGVARYMQSERCRRVICLVGARISTSAASPTFALHPPASMTT

SEQ ID NO: 5623 - protein, 72 aa, Homo sapiens
  SIGNAL -30..-1
MVPHAPGLQTSAAAGPGPSSFVGFPLGARSQPLQKKAGFGRAQWLAPVIPAFGRPRQVDHEVRRSRLSWPTW

SEQ ID NO: 5624 - protein, 69 aa, Homo sapiens
  SIGNAL -54..-1
MDFLRNLFSQTLSLGSQKERLLDELTLEGVARYMQSERCRRVICLVGARISTSAASPTFALHPPASMTT

SEQ ID NO: 5625 - protein, 76 aa, Homo sapiens
  SIGNAL -39..-1
  UNSURE -23: Xaa =  * ,Gly,Leu,Val,Trp
  UNSURE -16: Xaa =  * ,Leu,Arg,Trp
  UNSURE -18: Xaa = Ala,Cys,Gly,Ser
  UNSURE -25: Xaa = Ala,Gly
  UNSURE -27: Xaa = Ala,Phe,Leu,Ser,Val
  UNSURE -20: Xaa = Asp,Glu,Ile,Lys,Asn,Val
  UNSURE -31: Xaa = Cys,Trp
  UNSURE -29,-21: Xaa = Glu,Gly,Lys,Arg
  UNSURE -24: Xaa = Gly,Ile,Met,Arg,Ser,Val
  UNSURE -15: Xaa = Gly,Ile,Ser,Val
  UNSURE -17: Xaa = His,Lys,Asn,Gln
  UNSURE -28: Xaa = Ile,Leu,Met,Pro,Thr
  UNSURE -22: Xaa = Lys,Arg
  UNSURE -19: Xaa = Lys,Asn,Arg,Ser
  UNSURE -30: Xaa = Lys,Gln,Arg
MFNNVGEPXXXXXGXXXXXXXXXXXLHAVLSSLTGPASTIYSHKSGAPWPHCSNREATEVSLTALWWLLAQSTALT

SEQ ID NO: 5626 - protein, 90 aa, Homo sapiens; identical to SEQ ID NO: 5622
  SIGNAL -75..-1

SEQ ID NO: 5627 - protein, 69 aa, Homo sapiens; identical to SEQ ID NO: 5624
  SIGNAL -54..-1

SEQ ID NO: 5628 - protein, 87 aa, Homo sapiens [sequence omitted]

SEQ ID NO: 5629 - protein, 102 aa, Homo sapiens
  SIGNAL -35..-1
MLAPLEGRQLETGAGCPWPTPGPLCFTSLPLCLRCGPCLLDEVALFKPLVGSCVWGLLGDPAALGHCRGLGRTFPSKGWRSCRAFSLNRMSEPASGASPSWG

SEQ ID NO: 5630 - protein, 62 aa, Homo sapiens [sequence omitted]

SEQ ID NO: 5631 - protein, 74 aa, Homo sapiens
  SIGNAL -21..-1
  UNSURE -1: Xaa = Ala,Ser
MFNGGCLKLLSLSIICYTALXNSYTSRFCSRIPWTWGELEIITQYHPVHGKVITDRLRNVKKMLKRNGLMSLLC

SEQ ID NO: 5632 - protein, 61 aa, Homo sapiens
  SIGNAL -40..-1
MSRRQVTRGYSPFLVTVPSFCFLLIFPSFFLSPFLPSAFPPFLIPSFHLSLLLYFFSSFSF

SEQ ID NO: 5633 - protein, 77 aa, Homo sapiens [sequence omitted]

SEQ ID NO: 5634 - protein, 82 aa, Homo sapiens
  SIGNAL -39..-1
  UNSURE -33: Xaa = Ala,Gly
  UNSURE -28: Xaa = Ala,Pro
  UNSURE -31: Xaa = Glu,Lys
  UNSURE -29: Xaa = Ile,Ser
  UNSURE -34,-32: Xaa = Leu,Trp
METPSXXXXEXXADAIHEEPEWRRVEQGLCPLLCLGSRGADEGDGTGAPGSPGHGRVVHPGQGPCRLCPWGAGFVGRHRDLL

SEQ ID NO: 5635 - protein, 108 aa, Homo sapiens
  SIGNAL -71..-1
MVNLGLSRVDDAVAAKHPGLGEYAACQSHAFMKGVFTFVTGTGMAFGLQMFIQRKFPYPLQWSLLVAVVAGSVVSYGVTRVESEKCNNLWLFLETGQLPKDRSTDQRS

SEQ ID NO: 5636 - protein, 108 aa, Homo sapiens; identical to SEQ ID NO: 5635
  SIGNAL -71..-1

SEQ ID NO: 5637 - protein, 67 aa, Homo sapiens
  SIGNAL -31..-1
MRLIPVWIFVLTCIIKLAFGLFLSTSPVTFPSLRSVNSFGPSPVPHCPLSLDQNPGVRPISCSCPSH

SEQ ID NO: 5638 - protein, 127 aa, Homo sapiens
  SIGNAL -40..-1
MDILFPLHSVIGTELCPSPIPQIIHFVLFIVFSLVILIILCPYIPREPSSVPPREEDSENDQAEVGEWLRIGNKYITLKGSHTQAGVQWHITAHCSLELLGSNDPPASVSRVAGTNSKDICSSSLLR

SEQ ID NO: 5639 - protein, 108 aa, Homo sapiens; identical to SEQ ID NO: 5635
  SIGNAL -71..-1

SEQ ID NO: 5640 - protein, 63 aa, Homo sapiens [sequence omitted]

SEQ ID NO: 5641 - protein, 79 aa, Homo sapiens
  SIGNAL -70..-1
  UNSURE -58: Xaa = Asp,Gly,Val
MTHPEFYWYVDEXLSADNLKSSLLRSEILFGAPLPNYYSVDDRWEEQRAKFQSFVVTYVAMLASSLPGRAQWLTPVIPL

SEQ ID NO: 5642 - protein, 50 aa, Homo sapiens
  SIGNAL -25..-1
MLALLGLSQALNILLGLKGLAQLRSLQCVKKGISTWPMGWHGHITSDICG

SEQ ID NO: 5643 - protein, 75 aa, Homo sapiens
  SIGNAL -15..-1
MAVLAGSLLGPTSRSAALLGGRWLQPRAWLGFPDAWGLPTPQQARGKARGNEYQPSNIKRKNKHGWVRRLSTPAG

SEQ ID NO: 5644 - protein, 61 aa, Homo sapiens [sequence omitted]

SEQ ID NO: 5645 - protein, 76 aa, Homo sapiens
  SIGNAL -65..-1
MRRHRWSWRWEEDDVAKVFISARVPAGRWHLPQDKWAKFKDEMIYTGNSIDHWGLILQISFKVSGSESITSSDCSL

SEQ ID NO: 5646 - protein, 76 aa, Homo sapiens
  SIGNAL -45..-1
MNEDWGVAQCNPCHRCFIHVSSFNLQNNSIRKKTMFLFLVKEVEAQTLKRTAMEKDTSNKLRKLLSPVSGQNHYSI

SEQ ID NO: 5647 - protein, 54 aa, Homo sapiens
  SIGNAL -39..-1
MQAEKFPSEPNRLLLLHGFLDENVHFAHTSILLSFLVRAGKHMIYRSILRRDTA

SEQ ID NO: 5648 - protein, 70 aa, Homo sapiens [sequence omitted]

SEQ ID NO: 5649 - protein, 62 aa, Homo sapiens
  SIGNAL -24..-1
  UNSURE -3: Xaa = Ser,Thr
MATSAHSWPQGFLLLAGGVERXAGRLLDRRGVTAAEEEVLRDTRGWTRQGKSKAQDDLSSFH

SEQ ID NO: 5650 - protein, 104 aa, Homo sapiens
  SIGNAL -47..-1
MFSPRQALTPDPLHSPAYSPVLGGWSRFRSVDFRFLYLTLNQSCIFANYKEAHANRYCTEGRYTREIQRLTSPAAWPTRDKNRMISNGMALNSPAEGLAFQCRF

SEQ ID NO: 5651 - protein, 94 aa, Homo sapiens
  SIGNAL -81..-1
MSDEASAITSYEKFLTPEEPFPLLGPPRGVGTCPSEEPGCLDISDFGCQLSSCHRTDPLHRFHTNRWNLTSCGTSVASSEGSEELFSSVCWRSR

SEQ ID NO: 5652 - protein, 85 aa, Homo sapiens
  SIGNAL -57..-1
MSLFKSPSEDRQDERRTMPSRPQNNSVFNFLPLNLFEQFQRLANAYFLILLFLQLIPQISSLTWYTTITPLMVVLSINSCERCHR

SEQ ID NO: 5653 - protein, 77 aa, Homo sapiens
  SIGNAL -58..-1
MAAGTSPADALCDGKKAAGPTSGAFYNELRALESLPGNYSSASTVVLLWIASRQKSQSSRNSQCSRKDKGGKQEEHE

SEQ ID NO: 5654 - protein, 75 aa, Homo sapiens
  SIGNAL -68..-1
  UNSURE -22: Xaa = Phe,Val
MEVEEREVLQDSLDRCYSTPSMYFELPDSFQHYRSVFYSFEEQHISXALYVDNRFFTLTVTSLHLVFQMGVIFPQ

SEQ ID NO: 5655 - protein, 135 aa, Homo sapiens
  SIGNAL -59..-1
MLPSNVINFSQAEKPEPTNQGQDSLKKRLQAKVKVIGVHSSLAGSILSALSALVGFILLSVNPAALNPASLQCKLDEKDIPTRLLLSYDYHSPYTMDCHRAKASLAGTLSLMLVSTVLEFCLAVLTAVLQWKQTV

SEQ ID NO: 5656 - protein, 71 aa, Homo sapiens
  SIGNAL -66..-1
MWSGSWPGGENLEHLRNKTEDLEATSEHFKTTSQKVARKFWWKNVKMIVLICVIVFIIILFIVLFATGAFS

SEQ ID NO: 5657 - protein, 57 aa, Homo sapiens
  SIGNAL -44..-1
MGPAQRNDSNILQSQTHRVLKKEGIIAYWWAQLLMMLQSFLCQSHRQYFDIISAHLP

SEQ ID NO: 5658 - protein, 65 aa, Homo sapiens
  SIGNAL -36..-1
MVLFSVLQHRTLLKYPYQLDFFNLIQVSFASLKCWGWGSEPVIRFCFVDCLDLFLLSKLLPPKLV

SEQ ID NO: 5659 - protein, 55 aa, Homo sapiens
  SIGNAL -20..-1
MISFLPLILFSFFVFHPCLSPHRWILPHFSCLTCPGLLTSVSLRSWTSWDLLGIL

SEQ ID NO: 5660 - protein, 93 aa, Homo sapiens
  SIGNAL -54..-1
  UNSURE -47: Xaa =  * ,Tyr
  UNSURE -40: Xaa = Ala,Ser
  UNSURE -20: Xaa = Cys,Gly,Ser
  UNSURE -46: Xaa = Gly,Arg
MRGVVVSXXLPALWXPGCRTTIPAGTGLSGRGRVXVDLAKQWCPLTTCCLSLHGEPDWPGVSKTWMVTSSLQEQMALQLCGRNFQGVDHLEVI

SEQ ID NO: 5661 - protein, 90 aa, Homo sapiens
  SIGNAL -22..-1
MKISMINYKSLLALLFILASWIIFTVFQNSTKVWSALNLSISLHYWNNSTKSLFPKTPLISLKPLTETELRIKEIIEKLDQQSHPDLSPT

SEQ ID NO: 5662 - protein, 81 aa, Homo sapiens [sequence omitted]

SEQ ID NO: 5663 - protein, 151 aa, Homo sapiens
  SIGNAL -58..-1
  UNSURE -4: Xaa = Ala,Gly
  UNSURE 30: Xaa = Arg,Ser
  UNSURE 59: Xaa = Arg,Ser,Thr
  UNSURE 7: Xaa = Gly,Val
  UNSURE -49: Xaa = Ile,Asn,Ser,Thr
  UNSURE 19: Xaa = Leu,Pro
  UNSURE -2: Xaa = Phe,Leu
MMSSQFTQWXCLLQRRPRLNGRRAGGCGLLQPSVSTRTTPCWGLWVGWPLLRPPXAXAETHPFSXRCPQLSSYCGPXPTAVHPVRDYXGAKHLLQPKAGAATGRIRGGHWRSGGTSXFDEGTTTNSKCPGSARQGDQTGFGGGPAFGVRAQ

SEQ ID NO: 5664 - protein, 63 aa, Homo sapiens
  SIGNAL -61..-1
  UNSURE -18: Xaa = Lys,Gln
MEFALSARLECNGSILAHCKLRLPGSRHSSAASASRVAGTTGAXHHARLIFLCVFSRDGVSSC

SEQ ID NO: 5665 - protein, 94 aa, Homo sapiens
  SIGNAL -76..-1
  UNSURE -36: Xaa =  * ,Tyr
  UNSURE -44: Xaa = Ala,Gly
  UNSURE 16: Xaa = Ala,Pro
  UNSURE -12: Xaa = Asp,Glu,His,Gln
  UNSURE -41: Xaa = Glu,Gln
  UNSURE -34: Xaa = Gly,Arg
  UNSURE -4: Xaa = Pro,Ser
MRKPLNKGKRELQTSPDAFPSRLLSKEKKKKVXACXFWQKXWXPQMHFPACPRCSLCLPPSGLLXRVLALITXVDSRERAGSSESVDIKERXGG

SEQ ID NO: 5666 - protein, 71 aa, Homo sapiens [sequence omitted]

SEQ ID NO: 5667 - protein, 88 aa, Homo sapiens
  SIGNAL -53..-1
MNDIEGGFEGGDSRQGKQKSYVAKLSLLLGGLSWRKWTQELILSTVELGAIRSKRLYLTGMRLLFMAYQMLVLARCSGSCCNPSTLRG

SEQ ID NO: 5668 - protein, 54 aa, Homo sapiens
  SIGNAL -50..-1
  UNSURE -15: Xaa = His,Gln
MTKIKADPDGPEAQAEACSGERTYQELLVNQNPIAXPWLLAASRGSSTNASRKR

SEQ ID NO: 5669 - protein, 69 aa, Homo sapiens
  SIGNAL -53..-1
  UNSURE -24: Xaa =  * ,Ser
MHCDLNCGCVEKLTSRNNYHPHRIDLCMQXILYRIALQVDLVISMQLLPVSVSLSVAQYLLHFGMAHLF

SEQ ID NO: 5670 - protein, 114 aa, Homo sapiens
  SIGNAL -79..-1
MRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNLT

SEQ ID NO: 5671 - protein, 96 aa, Homo sapiens
  SIGNAL -56..-1
MRMPLSLRNLKGIPYTGGENPAVVNTINKPFKSLWIFVCVLKQGLALLSRLECSGAIIAHCNLSLLGSSNPIASASQVAGTTGTSPCPRLWLMPLC

SEQ ID NO: 5672 - protein, 87 aa, Homo sapiens
  SIGNAL -23..-1
  UNSURE 64: Xaa = Asn,Ser
  UNSURE 45: Xaa = Phe,Ser
MGFHHVGQAGLELLTSGDPPASASQSAGVTGMSHRTRPPSFVLVNPIPPLLPPVPSPDGPNTSSSTTXWRGYPEVLRWGLCSFWGCX

SEQ ID NO: 5673 - protein, 53 aa, Homo sapiens
  SIGNAL -43..-1
MELQCKWIICIIGNLYSFVDCRLNALIMSHVIVLGVFVFYSFTSTGSCLLHLW

SEQ ID NO: 5674 - protein, 87 aa, Homo sapiens
  SIGNAL -71..-1
MSQQHRRKRPSSERKSTRKMDTWQSLKVKEVFCKHNSSYECLLYKEVEARQVSKTATDGSYLLVFTSYVISSPVWTGPGDLLPVNRI

SEQ ID NO: 5675 - protein, 149 aa, Homo sapiens
  SIGNAL -135..-1
  UNSURE 11: Xaa = Ala,Glu,Gly,Val
  UNSURE -34: Xaa = Asp,Gly
MTALSARMLTRSRSLGPGAGPRGCREEPGPLRRREAAAEARKSHSPVKRPRKHRDCVWPMRARTVRKVRGLSPQGASLGAPGLAAQLVNIRAMRNKKDAPVXHLGTEHCYDSSAPPKVRRYQVLLSLMLSSQTKDQVTAGACSDCXRGA

SEQ ID NO: 5676 - protein, 85 aa, Homo sapiens
  SIGNAL -80..-1
  UNSURE 5: Xaa = Ala,Gly,Pro,Arg
  UNSURE -77: Xaa = Arg,Thr
MARXEGGPGATPETKRERDQLYYECYSDVSVHEEMIADRVRPDAYRLGILRNWAALRGKTVLDVGAGTGILSIFCAQAGARRVYX

SEQ ID NO: 5677 - protein, 112 aa, Homo sapiens
  SIGNAL -106..-1
MKVKIKCWNGVATWLWVANDENCGICRMAFNGCCPDCKVPGDDCPLVWGQCSHCFHMHCILKWLHAQQVQQHCPMCRQNGSSRSEARPGSRWRGILILLPHAGADGCWGQRP

SEQ ID NO: 5678 - protein, 53 aa, Homo sapiens
  SIGNAL -20..-1
MTFKRIRTFFLISLTSETIADLQFKYWNFTKDIGLNWKMKKKKKKKKLNKKSL

SEQ ID NO: 5679 - protein, 105 aa, Homo sapiens
  SIGNAL -57..-1
  UNSURE -19: Xaa = Gly,Arg
  UNSURE -25: Xaa = Ser,Thr
MADKEKKKKESILDLSKYIDKIDPGKVPGRPRXRWNPEXASTHSSTLCWTAPLSTCGEPPDDQYKLTEDTRQLGLVVCRGTSVVLICPQDGMEAIPNPFIQQQDA

SEQ ID NO: 5680 - protein, 96 aa, Homo sapiens [sequence omitted]

SEQ ID NO: 5681 - protein, 65 aa, Homo sapiens [sequence omitted]

SEQ ID NO: 5682 - protein, 79 aa, Homo sapiens [sequence omitted]

SEQ ID NO: 5683 - protein, 51 aa, Homo sapiens
  SIGNAL -28..-1
  UNSURE -27: Xaa = Ala,Gly
MXTWVTPGAFTRLRGLRLFLKLRGTSSGQSSVRKFVDFPLDLSSSPAHKWL

SEQ ID NO: 5684 - protein, 66 aa, Homo sapiens
  SIGNAL -45..-1
  UNSURE -16: Xaa = His,Arg
MPPLFITGSPVLRTVPGTETGLCKDLLNEXFILLLLILQASDVPPGCLLRFPRLVQAAPPTCSHSP

SEQ ID NO: 5685 - protein, 73 aa, Homo sapiens
  SIGNAL -33..-1
  UNSURE 1: Xaa = Glu,Lys
MSVFSESAHLFPYYMFQTGVLAQFLFSLHSGMGXQVWNLKKNVLEVGALILVSILAHPSQRTISKFMNLLFFM

SEQ ID NO: 5686 - protein, 58 aa, Homo sapiens
  SIGNAL -18..-1
MVRPYPLIYFLFLPLGACFPLLDRREPTDAMGGLGAGERWADLAMGPDPTPCGVPLGG

SEQ ID NO: 5687 - protein, 93 aa, Homo sapiens
  SIGNAL -42..-1
MSGFLEGLRCSECIDWGEKRNTIASIAAGVLFFTGWWIIIDAAVIYPTMKDFNHSYHACGVIATIAFLMINAVSNGQVRGDSYSEGCLGQTGK

SEQ ID NO: 5688 - protein, 120 aa, Homo sapiens
  SIGNAL -51..-1
  UNSURE 41: Xaa = Cys,Phe
  UNSURE 67: Xaa = Met,Arg
MPSPGRRRSGPQLWRREILIQTSSSQTSPEEAMGTPRIQHLLILLVLGASLLTSGLELYCQKGLSMTVEADPANMFNWTTEEVETCDKGALXQETILIIKAGTETAILATKGCIPEGXRP

SEQ ID NO: 5689 - protein, 57 aa, Homo sapiens
  SIGNAL -20..-1
  UNSURE -5: Xaa = His,Arg
MSGAGLAAVVSCLRPXPARSRRPMRTFSWQLPMFWMPSTTEMFHLKLTSGHQTLLFL

SEQ ID NO: 5690 - protein, 76 aa, Homo sapiens
  SIGNAL -32..-1
MEFILRHLPDYRDPPDGSGRLDQLLSLSMVWANHLFLGCSYNKDLLDKVMEMADGIEVEDLPQFTTRSELMKKHQS

SEQ ID NO: 5691 - protein, 102 aa, Homo sapiens
  SIGNAL -58..-1
  UNSURE -43: Xaa = Ala,Pro,Ser,Thr
  UNSURE 16: Xaa = Asp,His
MAPSLLGGFTKSLAMXVLSEVGDKTFFAAAILAMRHPRKLVLAGCLTALIVMTALSASLGWVAPNLISRKWTHXVTTLLFFVFGIWSLWEGFKEDGDSEELG

SEQ ID NO: 5692 - protein, 99 aa, Homo sapiens
  SIGNAL -81..-1
MFTFSCFIVSGLILKSLIHFEPVFVYDIRIHFHSSACEYPVFLTPFIYCPCPIVCSWHLCGKSFDHKCMGLFLSIPSCSTGLQFGFYARTCCFDYNSFM

SEQ ID NO: 5693 - protein, 114 aa, Homo sapiens [sequence omitted]

SEQ ID NO: 5694 - protein, 58 aa, Homo sapiens
  SIGNAL -20..-1
MDLSHVSLGFYSACVATSSSQVKQKFSLTSKFLLFKVTFRINHQGNREDALLWVVVKN

SEQ ID NO: 5695 - protein, 113 aa, Homo sapiens
  SIGNAL -79..-1
  UNSURE 25: Xaa =  * ,Ser
MATHALEIAGLFLGGVGMVGTVAVTVMPQWRVSAFIENNIVVFENFWEGLWMNCVRQANIRMQCKIYDSLLALSPDLQAARGLMCAASVMSFLAFMMAILGMKXPGARGTMRR

SEQ ID NO: 5696 - protein, 79 aa, Homo sapiens
  SIGNAL -19..-1
MATTLGIAFILNASLMVQGEQAFLCFLNVPPHFACHHVRCVFAPPLPSTMIVRPPQPCGTVSGVCQDQQALRETDPEDY

SEQ ID NO: 5697 - protein, 119 aa, Homo sapiens
  SIGNAL -37..-1
MSTVGLFHFPTPLTRICPAPWGLRLWEKLTLLSPGIAVTPVQMAGKKDYPALLSLDENELEEQFVKGHGPGGQATNKTSNCVVLKHIPSGIVVKVDHRRPLRGEAPPKGSTASRDFSQV

SEQ ID NO: 5698 - protein, 69 aa, Homo sapiens
  SIGNAL -39..-1
MSIRIESVSSSRPLCLDLLKSWELRGAFIPLCSLSPAQLGTWVVGLETSPLLPSRPLSIPTCFHVADPS

SEQ ID NO: 5699 - protein, 63 aa, Homo sapiens [sequence omitted]

SEQ ID NO: 5700 - protein, 53 aa, Homo sapiens
  SIGNAL -43..-1
MGCGSLRFLVKSAHLCFYICSLPCNPYHVHLFCGFGLLFNCTQVILLGNQNQV

SEQ ID NO: 5701 - protein, 74 aa, Homo sapiens
  SIGNAL -16..-1
  UNSURE 49: Xaa = Asp,Tyr
  UNSURE 39: Xaa = Glu,Gln
  UNSURE 10: Xaa = Gly,Arg
  UNSURE -9: Xaa = Ile,Val
  UNSURE 1: Xaa = Lys,Gln
MKSIILFXLSLLLILEXQAALMGQKXGSKGQLPSGSSQFPHGQKGQHYFGQKDQXHTKSKGSFSXSTHISCRHQ

SEQ ID NO: 5702 - protein, 65 aa, Homo sapiens [sequence omitted]

SEQ ID NO: 5703 - protein, 81 aa, Homo sapiens
  SIGNAL -49..-1
MEGAGAGSGFRKELVSRLLHLHFKDDKTKVSGDALQLMVELLKVFVVEAAVRGVRQAQAEDALRVDVDQLEKVLPQLLLDF

SEQ ID NO: 5704 - protein, 62 aa, Homo sapiens
  SIGNAL -43..-1
MASEQGVVIACHSKAEFDAHMTKAQEAGKLVVIDFTAAWCVHAAPSPHCSSNTPRSSLRSSS

SEQ ID NO: 5705 - protein, 140 aa, Homo sapiens
  SIGNAL -40..-1
MTSMTQSLREVIKAMTKARNFERVLGKITLVSAAPGKVICEMKVEEEHTNAIGTLHGGLTATLVDNISTMALLCTERGAPGVSVDMNITYMSPAKLGEDIVITAHVLKQGKTLAFTSVDLTNKATGKLIAQGRHTKHLGN

SEQ ID NO: 5706 - protein, 64 aa, Homo sapiens
  SIGNAL -62..-1
MLKGNFNEIRYYWLWILKGRRTKYYLPLRIQRKDCLFVWLVELSYFLFIYFLLLRSHFVAQGDF

SEQ ID NO: 5707 - protein, 70 aa, Homo sapiens
  SIGNAL -68..-1
  UNSURE -9: Xaa = Cys,Arg
MERSSPSLISIVLWLHTDRGFLHGSLVARVLSLWEAAENHRMRESVSLSSWASPARVVSXAVISGSLASV

SEQ ID NO: 5708 - protein, 60 aa, Homo sapiens
  SIGNAL -41..-1
MPESLWQHSHWCGESFQLKEAGFLGTLEVFWMSFYLSRVNCTTKETSPLPKPARHLGLEP

SEQ ID NO: 5709 - protein, 62 aa, Homo sapiens
  SIGNAL -44..-1
MTCRYFLSFYVLSFHILDDILFSPNVFNLMEYNLFFSFVACAFSHICENFAYPTLQRFTTSK

SEQ ID NO: 5710 - protein, 119 aa, Homo sapiens
  SIGNAL -42..-1
MNITRKLWSRTFNCSVPCSDTVPVIAVSVFILFLPVVFYLSSFLHSEQKKRKLILPKRLKSSTSFANIQENSNRDLQNGELTYHVNEWWKTQLGFRKKINCDLTSQALKKYKDFRSIFK

SEQ ID NO: 5711 - protein, 55 aa, Homo sapiens [sequence omitted]

SEQ ID NO: 5712 - protein, 95 aa, Homo sapiens
  SIGNAL -42..-1
  UNSURE 3: Xaa = His,Tyr
MRIKSELHRDLWAVIGGDTQGLGEGLALGSLSPALLSPCLSPFPXLILSHPPPLANSSPKQWTLLFPLLLSLILGAFCLASLLAPRVCILSSGGD

SEQ ID NO: 5713 - protein, 73 aa, Homo sapiens
  SIGNAL -42..-1
MNITRKLWSRTFNCSVPCSDTVPVIAVSVFILFLPVVFYLSSFLHSEQKKRKLILPKRLKSSTSFANIQENSN

SEQ ID NO: 5714 - protein, 94 aa, Homo sapiens
  SIGNAL -53..-1
  UNSURE 14: Xaa = Glu,Gln
MRTVASAGWHLTDAAPDCKVPGDDCPLVWGQCSHCFHMHCILKWLHATAGAAALPHVPPGMEVQGVXARPGSRWRGILRLLPHAGADGCWGQRP

SEQ ID NO: 5715 - protein, 62 aa, Homo sapiens; identical to SEQ ID NO: 5709
  SIGNAL -44..-1

SEQ ID NO: 5716 - protein, 105 aa, Homo sapiens
  SIGNAL -43..-1
MGFTGAGIAASSIAAKMMSAAAIANGGGVSAGSLVATLQSVGAAGLSTSSNILLASVGSVLGACLGNSPSSSLPAEPEAKEDEARENVPQGEPPKPPLKSEKHEE

SEQ ID NO: 5717 - protein, 95 aa, Homo sapiens
  SIGNAL -61..-1
MGHGDEIVLADLNFPASSICQCGPMEIRADGLGIPQLLEAVLAAAPGHLCGESGCSHGAGAQRQGEGPADPSVDGVRVHPTQGRLCESPGKDREV

SEQ ID NO: 5718 - protein, 54 aa, Homo sapiens
  SIGNAL -50..-1
MVERWQGTSGFYHPVASSQEMEESSVARWRLEPADGMVLWLTSLQLVAETETAA

SEQ ID NO: 5719 - protein, 51 aa, Homo sapiens [sequence omitted]

SEQ ID NO: 5720 - protein, 56 aa, Homo sapiens [sequence omitted]

SEQ ID NO: 5721 - protein, 54 aa, Homo sapiens
  SIGNAL -21..-1
MGGRPPPAWLPPCSLISDCCASNQRDSVGVGPSEPGVTVRKYLELLLCISSDEG

SEQ ID NO: 5722 - protein, 50 aa, Homo sapiens
  SIGNAL -21..-1
MALNTVRSSISLMLLIILLEQQEMALAPKPATRNTCHHLERSFQYPLVQL

SEQ ID NO: 5723 - protein, 97 aa, Homo sapiens
  SIGNAL -93..-1
MTKKKRENLGVALEIDGLEEKLSQCRRDLEAVNSRLHSRELSPEARRSLEKEKNSLMNKASNYEKELKFLRQENRKNMLLSVAIFILLTLVYAYWTM

SEQ ID NO: 5724 - protein, 87 aa, Homo sapiens
  SIGNAL -46..-1
MVLGKLDSHLKKQKFCPYLTFCLKISSKYMRICFSFLFFLFLFLRQESHPFARLECSGAVSAHCNLCLLPDTRFKQFSCFSLPSSWD

SEQ ID NO: 5725 - protein, 73 aa, Homo sapiens
  SIGNAL -60..-1
MSGVPAEMTGAVEAFLPVVSSSRRLPRFVHMVAGVSSKQERARSNTEALFKLCFHHICQCLTDEHKFHGQVQF

SEQ ID NO: 5726 - protein, 108 aa, Homo sapiens
  SIGNAL -19..-1
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKVKC

SEQ ID NO: 5727 - protein, 90 aa, Homo sapiens
  SIGNAL -66..-1
MQEMSRPINKKFLSLAENGWPHKPRQLEAKRVAQRPASLENQIRSGTYIAWRGGAMIVALAPTAAAHSRISFPAPETLQHHLSWRLGCLV

SEQ ID NO: 5728 - protein, 65 aa, Homo sapiens
  SIGNAL -43..-1
  UNSURE -8: Xaa = Asp,Val
  UNSURE 22: Xaa = His,Gln
MRVEFYFLSQYVSPADSPFRHIFMGRGDHTLGALLXHLRLLRSNSSGTPGATSSTGFQESRFRRX

SEQ ID NO: 5729 - protein, 112 aa, Homo sapiens
  SIGNAL -41..-1
MNEKQSMNLKKSYKREKEVEKEIFLRKKMLCLKSLLKESQASGKRLKITRSPHPDNEIPELSFLMIPSLPLPNSYFPSFSYISSQLYKPSFLAGTTEHFVTYLPFSSASAPE

SEQ ID NO: 5730 - protein, 159 aa, Homo sapiens
  SIGNAL -50..-1
MLVMYLLAALFGYLTFYGEVEDELLHAYSKVYTLDIPLLMVRLAVLVAVTLTVPIVLFPIRTSVITLLFPKRPFSWIRHFLIAAVLIALNNVLVILVPTIKYIFGFIGASSATMLIFILPAVFYLKLVKKETFRSPQKVGALIFLVVGIFFMIGAWHSL

SEQ ID NO: 5731 - protein, 75 aa, Homo sapiens
  SIGNAL -43..-1
MGFTGAGIAASSIAAKMMSAAAIANGGGVSAGSLVATLQSVGAAGLSTSSNILLASVGSVLGACLGEFTFFFSPS

SEQ ID NO: 5732 - protein, 74 aa, Homo sapiens [sequence omitted]

SEQ ID NO: 5733 - protein, 92 aa, Homo sapiens
  SIGNAL -57..-1
MFWLRKLFCFQCKSSQCSKQSSVFCSPLSLTDVCTWLRSPGASQALLFSTSHLPSTPCKLMQTPFLPPAAELFRLPGQGLKQCQPLPSQSYC

SEQ ID NO: 5734 - protein, 55 aa, Homo sapiens [sequence omitted]

SEQ ID NO: 5735 - protein, 94 aa, Homo sapiens
  SIGNAL -25..-1
MCFLVSFNLPIHISLSHLFLDLSRSLWFLACPGLNLVYLALDSFSDLRPSLNLLFYFVPGFGVSKYLTSAQPVLGFLLLPDIDNPALLGTERWS

SEQ ID NO: 5736 - protein, 92 aa, Homo sapiens
  SIGNAL -15..-1
  UNSURE 10,55: Xaa =  * ,Tyr
  UNSURE 29: Xaa = Ala,Ser
  UNSURE 51: Xaa = Arg,Thr
  UNSURE 3: Xaa = Asp,Glu
  UNSURE 28: Xaa = Cys,Phe,Leu,Trp
  UNSURE 35: Xaa = Glu,Lys
  UNSURE 12: Xaa = His,Gln
  UNSURE -3: Xaa = Ile,Val
  UNSURE 20: Xaa = Leu,Met
MLISSCLLFINFXNGNFXKFLVLIXPXSINFCLRXHFKSIRYXXLPQDYXDILYSVSFPVLPFTLXALFXLKFIFIYGKTKESHIIFFLSIL

SEQ ID NO: 5737 - protein, 90 aa, Homo sapiens
  SIGNAL -32..-1
  UNSURE -26: Xaa = His,Gln
MPCLDQXLTVHALPCPAQPSSLAFCQVGFLTAQPSPPRRRNGKDRYTLVLQHQECQDDLATSSLVYLSLPCFKDLGRSKHQSITVADTNK

SEQ ID NO: 5738 - protein, 174 aa, Homo sapiens
  SIGNAL -19..-1
MFLTVKLLLGQRCSLKVSGQESVATLKRLVSRRLKVPEEQQHLLFRGQLLEDDKHLSDYCIGPNASINVIMQPLEKMALKEAHQPQTQPLWHQLGLVLAKHFEPQDAKAVLQLLRQEHEERLQKISLEHLEQLAQYLLAEEPHVEPAGERELEAKARPQSSCDMEEKEEAAADQ

SEQ ID NO: 5739 - protein, 99 aa, Homo sapiens
  SIGNAL -19..-1
MFLTVKLLLGQRCSLKVSGQESVATLKRLVSRRLKVPEEQQHLLFRGQLLEDDKHLSDYCIGPNASINVIMQPLEKMALKEAHQPQTQPLWHQLGLGPS

SEQ ID NO: 5740 - protein, 68 aa, Homo sapiens
  SIGNAL -63..-1
MPRPASAQAWCAAPLSCTHFPTLPSEMNPVPQLEMQKSHVFCVAHAGSCRLELFLFGHLGSTCRDILH

SEQ ID NO: 5741 - protein, 137 aa, Homo sapiens
  SIGNAL -99..-1
MAEDVSSAAPSPRGCADGRDADPTEEQMAETERNDEEQFECQELLECQVQVGAPEEEEEEEEDAGLVARPRPWLPAGCSISSASLFAELSATAAPRTSADPQQRRGYYSWTIQSNSLPVENDIHMSVFDKNCSRKNP

SEQ ID NO: 5742 - protein, 59 aa, Homo sapiens
  SIGNAL -35..-1
MHSLALPPSFHVMMQQEGPCQMWLLDCGLFSPQNCEPNKLLLFITSPVCDILLQQQKMD

SEQ ID NO: 5743 - protein, 85 aa, Homo sapiens [sequence omitted]

SEQ ID NO: 5744 - protein, 99 aa, Homo sapiens
  SIGNAL -39..-1
MDLIGFGYAALVTFGSIFGYKRRGGVPSLIAGLFVGCLAGYGAYRVSNDKRDVKVSLFTAFFLATIMGVRFKRSKKIMPAGLVAGLSLMMILRLVLLLL

SEQ ID NO: 5745 - protein, 51 aa, Homo sapiens [sequence omitted]

SEQ ID NO: 5746 - protein, 174 aa, Homo sapiens; identical to SEQ ID NO: 5738
  SIGNAL -19..-1

SEQ ID NO: 5747 - protein, 55 aa, Homo sapiens [sequence omitted]

SEQ ID NO: 5748 - protein, 95 aa, Homo sapiens
  SIGNAL -30..-1
MPSQTLSQPRISVLHGDLVPAGMAVQEIGAQMVLPCEVVSGSGLTREHLVTRLALCQSPRAGQHGADSEEEAFGILPVRHSHRLSACHTPGLGYR

SEQ ID NO: 5749 - protein, 53 aa, Homo sapiens [sequence omitted]

SEQ ID NO: 5750 - protein, 59 aa, Homo sapiens
  SIGNAL -15..-1
MIFFLSSTCFHSGQQFYIKSPCQGLCLHLYILKMKFLALKFIFSSPFTISVSPELAHRL

SEQ ID NO: 5751 - protein, 88 aa, Homo sapiens
  SIGNAL -86..-1
MESGIRSQWDHVQHWKTRIPSPGQGALGQHIWRAHDIQPPAEEIRLHFGSEDSQGSEHLLNGQAFSGELQERDLFILLTSVSGHLPDT

SEQ ID NO: 5752 - protein, 92 aa, Homo sapiens
  SIGNAL -53..-1
  UNSURE -35: Xaa = Ala,Asp
  UNSURE 29: Xaa = Ala,Asp,Gly,Val
  UNSURE 5: Xaa = Ala,Cys,Gly,Ser
  UNSURE -1: Xaa = Ala,Gly
  UNSURE -22,-5,11: Xaa = Ala,Pro
  UNSURE 4: Xaa = Ala,Ser
  UNSURE 21,27: Xaa = Asp,Glu
  UNSURE 1,36: Xaa = Cys,Gly
  UNSURE -14,8,16: Xaa = Cys,Ser
  UNSURE -51: Xaa = Gly,Ser
  UNSURE -13: Xaa = Ile,Arg
  UNSURE -11: Xaa = Ile,Leu
  UNSURE 7: Xaa = Ile,Met
  UNSURE -16: Xaa = Lys,Asn,Arg,Ser
  UNSURE -20: Xaa = Pro,Ser
MAXSEELGLREDTLRVLAXFLRRGEAAGSPVXTXPRPXYXXLXCFGGPXAGTXXPRXXEXXAQXRITGXPIDRXGSHTAXAXGPAGGGXTSH

SEQ ID NO: 5753 - protein, 109 aa, Homo sapiens
  SIGNAL -18..-1
MASTVVAVGLTIAAAGFAGRYVLQAMKHMEPQVKQVFQSLPKSAFSGGYYRGGFEPKMTKREAALILGVSPTANKGKIRDAHRRIMLLNHPDKGGSPYIAAKINEAKIY

SEQ ID NO: 5754 - protein, 123 aa, Homo sapiens
  SIGNAL -29..-1
MEDALSSVPSRPLPRPRSSLLLADQASRADESSGRLSLSGCQDLIFPGQVTFLKGQAAKKQTAFWHIRETKEMLETGMPAVSRHLIRKQRQSEFVVRVSSSARRTKRNVSPEESQIALEIMWT

SEQ ID NO: 5755 - protein, 123 aa, Homo sapiens
  SIGNAL -29..-1
  UNSURE -4: Xaa = Ala,Pro,Thr
  UNSURE -5: Xaa = His,Gln
MEDALSSVPSRPLPRPRSSLLLADXXSRADESSGRLSLSGCQDLIFPGQVTFLKGQAAKKQTAFWHIRETKEMLETGMPAVSRHLIRKQRQSEFVVRVSSSARRTKRNVSPEESQIALEIMWT

SEQ ID NO: 5756 - protein, 127 aa, Homo sapiens
  SIGNAL -45..-1
MIVKGVASRTVVSRPFPGNWLFSSIQLTDDQGPVLMTTVAMPVFSKQNETRSKGILLGVVGTDVPVKELLKTIPKYKLGIHGYAFAITNNGYILTHPELRLLYEKEKSEGNLTIVALTSLSGVGRPR

SEQ ID NO: 5757 - protein, 62 aa, Homo sapiens
  SIGNAL -45..-1
MTQAPPIFMRGFPGRGREYGELHAGSSCFHLKAAHVLSLIFHCQSKSCSHTSRGVRICNPIA

SEQ ID NO: 5758 - protein, 123 aa, Homo sapiens [sequence omitted]

SEQ ID NO: 5759 - protein, 89 aa, Homo sapiens
  SIGNAL -34..-1
  UNSURE -19: Xaa = His,Pro
  UNSURE 44: Xaa = Leu,Val
  UNSURE 43: Xaa = Pro,Arg
MVGSRSSSKIMKVLFXLFSPFYFLFLHFFSCSKPCVSLPCFGSGLILFMHWVRRILALSYLLCSSLPSSEKRSNTFXXPIYLSKIAAGH

SEQ ID NO: 5760 - protein, 63 aa, Homo sapiens [sequence omitted]

SEQ ID NO: 5761 - protein, 76 aa, Homo sapiens
  SIGNAL -49..-1
MSFLPHPPPLPTSICVCITITHPSDQIQFKWHFFGKHFLILYLPGWVDCMYSTFYCSTLFMAFTYHSLFVIALKLH

SEQ ID NO: 5762 - protein, 91 aa, Homo sapiens
  SIGNAL -43..-1
MAMSFEWPWQYRFPPFFTLQPNVDTRQKQLAAWCSLVLSFCRLHKQSSMTVMEAQESPLFNNVKLQRKASCGVDPDCIRGTEEEREPRVVG

SEQ ID NO: 5763 - protein, 63 aa, Homo sapiens
  SIGNAL -49..-1
MKLAHDEPVFSVTTILTRMNGGGSGPASQVAADVLNISIKISLFPYARGAPELHPYGSYHAVM

SEQ ID NO: 5764 - protein, 91 aa, Homo sapiens [sequence omitted]

SEQ ID NO: 5765 - protein, 60 aa, Homo sapiens [sequence omitted]

SEQ ID NO: 5766 - protein, 76 aa, Homo sapiens
  SIGNAL -61..-1
  UNSURE -58: Xaa =  * ,Glu
MRKXILEIPGPEFHLPSGPDTTRMPAPDSLRPLPVPLLVLVVQPVPTSLPTLVPLVSSGLSEMLDIAINRSSLSPV

SEQ ID NO: 5767 - protein, 53 aa, Homo sapiens [sequence omitted]

SEQ ID NO: 5768 - protein, 84 aa, Homo sapiens
  SIGNAL -64..-1
  UNSURE -5: Xaa =  * ,Lys,Gln,Arg,Trp
  UNSURE -36: Xaa = Lys,Gln
MWTLCINVQCLFRKDTLLLKVYYIRFSNXPWCSRHCNRCLLENAVCGRARWLTPVIPALXEAEAGDSQGQEFKTSLAKMVKSCL

SEQ ID NO: 5769 - protein, 87 aa, Homo sapiens
  SIGNAL -81..-1
  UNSURE -61: Xaa = Asp,Tyr
MLTSKHFHYQYFFQAIPFQDXQIGTALVWSSQRARHRRRVISAFSQSYSFVVVIQHGCGVVVSVTAGSLWSITQFFTEIAAASDQDH

SEQ ID NO: 5770 - protein, 95 aa, Homo sapiens
  SIGNAL -30..-1
MGFSAPTPGPLFDLRRLILSIVAFCPHVTPCKYAVIHTVNTPLLFLWDLQATIFRTSYFIKKEKTVCWLLSLHLGGREVRAGAPQTLQEGSLHSI

SEQ ID NO: 5771 - protein, 77 aa, Homo sapiens
  SIGNAL -21..-1
MEQSLSIPSTLAFLLLAGPRSWRGLVGVGLTDTVVELTEVPPPTRSPGWASASRGNLVSPPWRPAPKDVHVQLNHTI

SEQ ID NO: 5772 - protein, 68 aa, Homo sapiens
  SIGNAL -21..-1
  UNSURE 13: Xaa = Asp,His
MAAIRGAPLLLGGSYCPPLQPLTFTCATQFWFLXSHSKMDPRKALFCGVPSSLLGLSLDCYGHCPGQP

SEQ ID NO: 5773 - protein, 52 aa, Homo sapiens
  SIGNAL -32..-1
MGRWRVSSVESWPFASTGGKLAIATAGTGTQAAPRPFLIRPPDSWALALALM

SEQ ID NO: 5774 - protein, 59 aa, Homo sapiens
  SIGNAL -37..-1
MQERVGRAAFLACLPRVSHEGIEESLSLRGFSLPVSPFEASTLIFFSFAEQFRTSWGLC

SEQ ID NO: 5775 - protein, 109 aa, Homo sapiens
  SIGNAL -41..-1
MPELELALQAEVHGVPQGLSQAGLPPAELLLLPGQLQQVTLLQMGPACAGATAVPSPGKGIRTSHLVRLETARGQRRAELPCSGNHPETHEYRHSPPPRPVSAPQGKQL

SEQ ID NO: 5776 - protein, 143 aa, Homo sapiens
  SIGNAL -120..-1
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELCNERFLTGRGPYQC

SEQ ID NO: 5777 - protein, 55 aa, Homo sapiens
  SIGNAL -52..-1
MFGPGVVAHASNPSTLGGWGGWIMRSGDRDHPGQHGETHSLLKIQTLAECGGMQL

SEQ ID NO: 5778 - protein, 77 aa, Homo sapiens
  SIGNAL -32..-1
MMDASKGEWVKSPWSPTCPFSQLALNCSLASAGCLGPLPSHPDLWPWCCLLSVSSLFRKPTNFSFRHNFRFTKRLQE

SEQ ID NO: 5779 - protein, 55 aa, Homo sapiens
  SIGNAL -34..-1
MENISGSPDAPPSLQREACSEWLLKTGTCPSASPVPSSFLAEEVCGQFSNCSSSV

SEQ ID NO: 5780 - protein, 140 aa, Homo sapiens [sequence omitted]

SEQ ID NO: 5781 - protein, 77 aa, Homo sapiens
  SIGNAL -21..-1
MVTLPSGTWAFSCPYLALVDGGMLGSAREDAHETGTCCVAQAGLELLVLSNHTALATQSTGITGVNHHTQLLKPQYF

SEQ ID NO: 5782 - protein, 62 aa, Homo sapiens
  SIGNAL -49..-1
  UNSURE -25: Xaa =  * ,Trp
  UNSURE -19: Xaa = Asp,His
  UNSURE -28: Xaa = Asp,Tyr
  UNSURE -24: Xaa = Lys,Arg
  UNSURE -16: Xaa = Lys,Gln
  UNSURE -27: Xaa = Phe,Leu
MPVVPSSWDWRSPPPCLANFLXXQXXMGFCXVGXAVLELLSSGDPTVSASQGAGITGVSNCA

SEQ ID NO: 5783 - protein, 92 aa, Homo sapiens
  SIGNAL -14..-1
  UNSURE 41: Xaa = Asp,Glu
  UNSURE 28: Xaa = His,Pro
MDVIHLLCVLPAFQKVIHGKASLQIRLCAHCHSQPREKHSRXWDFRTRVSSERAXSMRKSKWWQRASQNREISELQPSSHQTLHLPSHLRKA

SEQ ID NO: 5784 - protein, 101 aa, Homo sapiens
  SIGNAL -35..-1
  UNSURE 31: Xaa = Leu,Val
MSAVGAATPYLHHPGDSHSGRVSFLGAQLPPEVAAMAATRGPRQEHVQKVAEVVVSSLQGEDCREXCSVLGSAPTCRRAAGCPWQACTHCSSRPSVCPPPA

SEQ ID NO: 5785 - protein, 59 aa, Homo sapiens [sequence omitted]

SEQ ID NO: 5786 - protein, 83 aa, Homo sapiens
  SIGNAL -79..-1
  UNSURE -74: Xaa = Leu,Val
MAGGPXHVPILRGDPGDLHSGPRGECPLCVRSSERGQRVRHRLLGRKTMDPGWPHFKLTHSRCMAVLFLGTLPLCPVTSPVWG

SEQ ID NO: 5787 - protein, 116 aa, Homo sapiens
  SIGNAL -114..-1
MASYPYRQAAQELQDKHQEPLRVATTLDPPIVEGSMVVGYPLVVVMGVLPLEGLMDHQLVRALWTPQSWDVPLWNSRRTIWRCSSRGPLWSATSKFLRCPAAWALWTGWRPSQCGS

SEQ ID NO: 5788 - protein, 81 aa, Homo sapiens [sequence omitted]

SEQ ID NO: 5789 - protein, 60 aa, Homo sapiens
  SIGNAL -49..-1
MDALEDYVWPRATSELILLPVTGLECVGDRLLAGTCPLLCVNLTSPALAPLWLQPVVMGP

SEQ ID NO: 5790 - protein, 116 aa, Homo sapiens; identical to SEQ ID NO: 5787
  SIGNAL -114..-1

SEQ ID NO: 5791 - protein, 50 aa, Homo sapiens
  SIGNAL -21..-1
MGQPSEIILLTTMLSLQGLRPSLSVQDLKQIQSQEERFQERENYSYHRGF

SEQ ID NO: 5792 - protein, 85 aa, Homo sapiens
  SIGNAL -23..-1
  UNSURE 23,31: Xaa = Ala,Gly
MSSNIQNVLSAVGRILLCRPGWSAVAGSRLTASSVSWVHALLLPHXPEQLGLQXPTTVPGCVGWNLPELHGGMEVGQCDLQPWII

SEQ ID NO: 5793 - protein, 61 aa, Homo sapiens [sequence omitted]

SEQ ID NO: 5794 - protein, 97 aa, Homo sapiens
  SIGNAL -53..-1
MIICDLEHLLFMSDPTNQHSLYLQSTKFRVRGVVIGNVKLSYILSLYLHVSLSIGLFFPPFLRRSLWSPGWSAVAQSQLTATSDSLVQAILLPQPPE

SEQ ID NO: 5795 - protein, 92 aa, Homo sapiens [sequence omitted]

SEQ ID NO: 5796 - protein, 78 aa, Homo sapiens
  SIGNAL -70..-1
MARSCDFPLSRDPARSQNKEPGETPQLCSPSPLQSVAGACLWLSSTENQKTRKFSLMYWMVQTWLLGCGAGWRKRRED

SEQ ID NO: 5797 - protein, 54 aa, Homo sapiens
  SIGNAL -52..-1
MPVIPALWEAEVGGSRDQEIETILANTVKPISTKNTTNWLGAVAGACSPSCSGG

SEQ ID NO: 5798 - protein, 71 aa, Homo sapiens
  SIGNAL -16..-1
MFLAFSLYMWPSNILCLEKYKPKASPLQKISSTETSKGHRSALGFRGILTATPQDPLCCDSSPRGPTVSPS

SEQ ID NO: 5799 - protein, 54 aa, Homo sapiens; identical to SEQ ID NO: 5797
  SIGNAL -52..-1

SEQ ID NO: 5800 - protein, 54 aa, Homo sapiens; identical to SEQ ID NO: 5797
  SIGNAL -52..-1

SEQ ID NO: 5801 - protein, 54 aa, Homo sapiens [sequence omitted]

SEQ ID NO: 5802 - protein, 54 aa, Homo sapiens; identical to SEQ ID NO: 5797
  SIGNAL -52..-1

SEQ ID NO: 5803 - protein, 54 aa, Homo sapiens; identical to SEQ ID NO: 5797
  SIGNAL -52..-1

SEQ ID NO: 5804 - protein, 54 aa, Homo sapiens; identical to SEQ ID NO: 5797
  SIGNAL -52..-1

SEQ ID NO: 5805 - protein, 112 aa, Homo sapiens
  SIGNAL -109..-1
MKVKIKCWNGVATWLWVANDENCGICRMAFNGCCPDCKVPGDDCPLVWGQCSHCFHMHCILKWLHAQQVQQHCPMCRQNGSSRSEARPGSRWRGILRLLPHAGADGCWGQRP

SEQ ID NO: 5806 - protein, 64 aa, Homo sapiens [sequence omitted]

SEQ ID NO: 5807 - protein, 50 aa, Homo sapiens
  SIGNAL -37..-1
MKQLSRLALRPGTPGNFRSTGKRLLHSFCLESTDCLSQRSGQLLVTFGSR

SEQ ID NO: 5808 - protein, 74 aa, Homo sapiens [sequence omitted]

SEQ ID NO: 5809 - protein, 50 aa, Homo sapiens
  SIGNAL -47..-1
MQIPASQCRLDGAKTPAEIRGLPGLLGQESCRAHVCPMLATPGWGLGRSV

SEQ ID NO: 5810 - protein, 66 aa, Homo sapiens
  SIGNAL -38..-1
MKTSVTTPSSSKSAGRWGAAHPRPRACYLSPSPPPLTSRTLSSPPSCPSCSLAMSRMLRTWTPCSG

SEQ ID NO: 5811 - protein, 72 aa, Homo sapiens
  SIGNAL -17..-1
MDRPGFVAALVAGGVAGVSVDLILFPLDTIKTRLQSPQGFNKAGGFHGIYAGVPSAAIGSFPNGCLPDSSSI

SEQ ID NO: 5812 - protein, 53 aa, Homo sapiens [sequence omitted]

SEQ ID NO: 5813 - protein, 65 aa, Homo sapiens
  SIGNAL -61..-1
MAYLDDKGSLLAIHSHARQHSHETNQVHQWLPRNTFAFLIKEDRCSCRSTCASFSFSSSFSFLIS

SEQ ID NO: 5814 - protein, 65 aa, Homo sapiens; identical to SEQ ID NO: 5813
  SIGNAL -61..-1

SEQ ID NO: 5815 - protein, 53 aa, Homo sapiens [sequence omitted]

SEQ ID NO: 5816 - protein, 76 aa, Homo sapiens
  SIGNAL -72..-1
MVNKPVRSLALSPRLKCRVQWHDLSSLQLPPPGLKQFFCLSLRSSWEYRCRLPRPAHFCVLVEIGFHHVAQAGLNS

SEQ ID NO: 5817 - protein, 71 aa, Homo sapiens [sequence omitted]

SEQ ID NO: 5818 - protein, 53 aa, Homo sapiens [sequence omitted]

SEQ ID NO: 5819 - protein, 74 aa, Homo sapiens
  SIGNAL -29..-1
MIPGKYRSVSGRAANNVNCGLHLVIQTSSLPEKNKVEFKLNKDTSSFPGRLLQHDLERNYSSRQDFTKNIKNVK

SEQ ID NO: 5820 - protein, 83 aa, Homo sapiens
  SIGNAL -29..-1
  UNSURE 7: Xaa =  * ,Trp
  UNSURE 32: Xaa = Glu,Lys
  UNSURE -13: Xaa = Glu,Val
MSFFQLLMKRKELIPLXVFMTVAAGGASSFAVYSLXKTDVILDRKKNPEPWETVDPTVPQXLITINQQWKPIEELQNVQRVTK

SEQ ID NO: 5821 - protein, 179 aa, Homo sapiens
  SIGNAL -30..-1
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGETPPSLFPLIHLPLPRSVPLFLSTLE

SEQ ID NO: 5822 - protein, 63 aa, Homo sapiens
  SIGNAL -37..-1
MARKALPPTHLGQSWFCSCCRDTELAISALRARTATGSPGSCRCTAGPLPCASALESCCCRVT

SEQ ID NO: 5823 - protein, 74 aa, Homo sapiens
  SIGNAL -45..-1
MSFWSWKSHCLLHGPEKPLAGVNDDFTFFPIRSTMLTSYILPVSSDTSASKGPALFVSDRGKMAVNAFICWFTG

SEQ ID NO: 5824 - protein, 83 aa, Homo sapiens [sequence omitted]

SEQ ID NO: 5825 - protein, 66 aa, Homo sapiens; identical to SEQ ID NO: 5810
  SIGNAL -38..-1

SEQ ID NO: 5826 - protein, 125 aa, Homo sapiens
  SIGNAL -97..-1
  UNSURE -24: Xaa = Ala,Pro
MAASRLELNLVRLLSRCEAMAAEKRDPDDWRLEKYVGALEDMLQALKVHASKPASEVINEYSWKVDFLKGMLQXEKLTSSSEKALANQFLAPGVCQPQPESECPPQRRCICSHGRGTPARCGVSY

SEQ ID NO: 5827 - protein, 63 aa, Homo sapiens
  SIGNAL -37..-1
MARLALPPTHLGQSWFCSCCRDTELAISALRARTATGSPGSCRCTAGPLPCASALESCCCRVT

SEQ ID NO: 5828 - protein, 90 aa, Homo sapiens
  SIGNAL -75..-1
MPSVVNFFPGASTRSPHLPRPFTERPGIPGPGLLLCPWGMCPLHIFSAITPWALGPYPFQPSLLLRLQSTAQLIQMQTTVPAIGSLAGNS

SEQ ID NO: 5829 - protein, 113 aa, Homo sapiens
  SIGNAL -88..-1
MATPNNLTPTNCSWWPISALESDAAKPAEAPDAPEAASPAHWPRESLVLYHWTQSFSSQKAKILEHDDVSYLKKILGELAMVLDQIEAEWRRGSWRTRGRNASCGSVAVLHPR

SEQ ID NO: 5830 - protein, 75 aa, Homo sapiens
  SIGNAL -55..-1
MMLGSLAPDPGSRRHSGQAALRPRRYPTLWDRCRKRWLRPIFTQLLAAVWLTTRSSPFPVSRFLQHQANTYTSAL

SEQ ID NO: 5831 - protein, 60 aa, Homo sapiens
  SIGNAL -35..-1
MGTFVFSANNVGAVIVRAFLTKLCITVWFCFFCCCLFDFDFFFFYVIFGKTHSELYLVST

SEQ ID NO: 5832 - protein, 83 aa, Homo sapiens
  SIGNAL -78..-1
  UNSURE -65: Xaa = Glu,Gly
  UNSURE -64: Xaa = Glu,Gly,Lys,Arg
  UNSURE -70: Xaa = Glu,Val
  UNSURE -67: Xaa = Leu,Ser
MLNLIKELXIFXHXXKTEFVVHRYSLLLDLFQTSEEKSEFLGFTSYTEKSGICNVLDIWEEENSDNLLTAFFSSPSTSTFTGF

SEQ ID NO: 5833 - protein, 59 aa, Homo sapiens
  SIGNAL -14..-1
MVLACYVLFSYSFSYKHLKHERSANTTEEDTLCTPPPHDLGPSPSVRTQSQSLLNPFIS

SEQ ID NO: 5834 - protein, 64 aa, Homo sapiens
  SIGNAL -51..-1
MVLSAMGFTAAGIASSSIAAKMMSAAAIANGGGVASGSLVATLQSLGATVCPRPPQRQNEPIGS

SEQ ID NO: 5835 - protein, 104 aa, Homo sapiens
  SIGNAL -101..-1
MTHADSQDRIKAAAHQLCLKIDRGETHLWSPQVSEDGKAHPFKINLESEPQDGNYFEHKHNIRPKPFVIPGRSSGCSTPSGLTVAVDAAPLLLSVLLVPFAQVT

SEQ ID NO: 5836 - protein, 53 aa, Homo sapiens [sequence omitted]

SEQ ID NO: 5837 - protein, 77 aa, Homo sapiens [sequence omitted]

SEQ ID NO: 5838 - protein, 152 aa, Homo sapiens
  SIGNAL -16..-1
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVD

SEQ ID NO: 5839 - protein, 69 aa, Homo sapiens [sequence omitted]

SEQ ID NO: 5840 - protein, 77 aa, Homo sapiens
  SIGNAL -37..-1
  UNSURE 31: Xaa = Gly,Arg
  UNSURE 30: Xaa = Pro,Ser
MRAAPRGTSRRRPRRSRRESMELERIVSAALLAFVQTHLPEPTSVAWMRSSSPMCLGSWRTGPLGIXXGELRYGGFH

SEQ ID NO: 5841 - protein, 57 aa, Homo sapiens
  SIGNAL -28..-1
  UNSURE 22: Xaa = Arg,Trp
  UNSURE -24: Xaa = Cys,Gly
  UNSURE 6: Xaa = Leu,Arg
  UNSURE 24: Xaa = Leu,Ser
MEAGXFLDSLIYGACVVFTLGMFSAGLSDLRHMXMTRSVDNVSSCPFLPXKXTTWAG

SEQ ID NO: 5842 - protein, 104 aa, Homo sapiens [sequence omitted]

SEQ ID NO: 5843 - protein, 92 aa, Homo sapiens [sequence omitted]

SEQ ID NO: 5844 - protein, 128 aa, Homo sapiens
  SIGNAL -56..-1
  UNSURE -34: Xaa = Ala,Gly
MELEQREGTMAAVGFEEFSAPPXQSWRCLPYLVATSWRASWRRKWSLCQVVWAAQGSGSEMKRKRQPGVGGGAAGIKSQKVPGTRSALPGDRAGERAGPEQAPSGAEDNSEAAAGTEVPHGSAGLLRG

SEQ ID NO: 5845 - protein, 81 aa, Homo sapiens [sequence omitted]

SEQ ID NO: 5846 - protein, 84 aa, Homo sapiens
  SIGNAL -28..-1
  UNSURE -2: Xaa = Leu,Pro
MSCAGVGEGKLKTFFIFCCFFLLRRSXLSPRLECSGTISAHCKFRLPGSRHSPASASRVAGTTGGHHGARLIFCIFGRDGVSPC

SEQ ID NO: 5847 - protein, 99 aa, Homo sapiens
  SIGNAL -37..-1
  UNSURE 6: Xaa =  * ,Tyr
  UNSURE 53: Xaa = His,Gln
MAAPAEPCAGQGVWNQTEPEPAATSLLSLCFLRTAGVWVPPMXLWVLGPIYLLFIHHHGRGYLRMSPLFKAKMVAAIPGSLEPGNVRGRXGTGWNLVKS

SEQ ID NO: 5848 - protein, 78 aa, Homo sapiens
  SIGNAL -72..-1
  UNSURE -2: Xaa = Cys,Gly,Arg,Ser
  UNSURE 3: Xaa = Gly,Arg
MSDLRITEAFLYMDYLCFRALCCKGPPPARPEYDLVCIGLTGSGKTSLLSKLCSESPDNVVSTTGFSIKAXAIPXMPS

SEQ ID NO: 5849 - protein, 68 aa, Homo sapiens
  SIGNAL -47..-1
MDFSPGFISRFVFVPHFASNVHKAQCIGTQYMIPLLFERVFLLGLDGGDYRLLCCSLHMLLKLAFRFS

SEQ ID NO: 5850 - protein, 88 aa, Homo sapiens [sequence omitted]

SEQ ID NO: 5851 - protein, 65 aa, Homo sapiens [sequence omitted]

SEQ ID NO: 5852 - protein, 52 aa, Homo sapiens
  SIGNAL -31..-1
MPETDVYLRDICQGWVLWLMPVVPALWEAEAGRSLEFRSSRPVWPTWQTPSL

SEQ ID NO: 5853 - protein, 59 aa, Homo sapiens
  SIGNAL -36..-1
  UNSURE 15: Xaa = Ile,Asn,Ser,Thr
MPVASAAWEAGAGGSLEPRRSKLQWAMIASLHSSLSDRARPCPKKQNQNTXKQKQPIDP

SEQ ID NO: 5854 - protein, 64 aa, Homo sapiens
  SIGNAL -36..-1
  UNSURE -4: Xaa = Pro,Ser
MIDFCLLEASSEPEQMPVRGDNVLASLAGSQSXSASASTLATLEKPFSPPLHCRSPSLGWLAWS

SEQ ID NO: 5855 - protein, 140 aa, Homo sapiens
  SIGNAL -30..-1
MTLSVLSRKDKERVIRRLLLQAPSGEFVNAFDDLCLLIRDEKLMHHQGECAGHQHCQKYSVPLCIDGNPVLLSHHNVMGDYRFFDHQSKLSFKYDLLQNQLKDIQSHGIIQNEAEYLRVVLLCALKLYVNDHYPKGNCTC

SEQ ID NO: 5856 - protein, 61 aa, Homo sapiens
  SIGNAL -32..-1
MSQDCHETIWILYSGSFISSICISLNCPRASAMNPGISEERNFSSFTVSSARPGHFVQASL

SEQ ID NO: 5857 - protein, 61 aa, Homo sapiens; identical to SEQ ID NO: 5856
  SIGNAL -32..-1

SEQ ID NO: 5858 - protein, 108 aa, Homo sapiens
  SIGNAL -41..-1
MSVWWSSQRKTPGAGELCMDMQSRAAHLLLLTLPVPEGLHSPWSCFIAQAGVQWRNHGSLQPQPLGPEQSSHLGLLKCWDNRHEHHIWLRPTFSFCAETCKLGSWSWL

SEQ ID NO: 5859 - protein, 53 aa, Homo sapiens [sequence omitted]

SEQ ID NO: 5860 - protein, 62 aa, Homo sapiens
  SIGNAL -42..-1
MVRLGLNQISLSVSLIQWKVEPKSKWKFSSFCTWCLHQSLYACVTRGYLFNGNCLLLCLIAI

SEQ ID NO: 5861 - protein, 81 aa, Homo sapiens
  SIGNAL -18..-1
  UNSURE -10: Xaa = Ala,Gly
  UNSURE -14: Xaa = Gly,Arg
  UNSURE -1: Xaa = Phe,Leu,Pro,Ser
  UNSURE 33: Xaa = Ser,Thr
MLSCXLQCXLAACPSSWXWAVSPALPRTPDSVSFCRSPWLLPRGSRNWPSXSWQSCCLNPTRRRMMPWNLKICPRLLSRMK

SEQ ID NO: 5862 - protein, 76 aa, Homo sapiens
  SIGNAL -52..-1
  UNSURE 1: Xaa = Arg,Ser
  UNSURE 7: Xaa = Phe,Leu
MLNSYTCFLFVTVCLIFFHPLIFNLFNVVLSYMFSGKPHIVGLCSFPQPSRLXGFFWLXVFRDRVLLCHPGWSVVA

SEQ ID NO: 5863 - protein, 81 aa, Homo sapiens
  SIGNAL -51..-1
  UNSURE 26: Xaa = Ala,Pro
MEKLRRVLSGQDDEEQGLTAQVLDASSLSFNTRLKWFAICFVCGVFFSILGTGLLWLPGGIKLFAVFYTLGNLAALXVHAF

SEQ ID NO: 5864 - protein, 81 aa, Homo sapiens; identical to SEQ ID NO: 5863
  SIGNAL -51..-1
  UNSURE 26: Xaa = Ala,Pro

SEQ ID NO: 5865 - protein, 120 aa, Homo sapiens
  SIGNAL -56..-1
  UNSURE -19,-1: Xaa =  * ,Ser
  UNSURE -53: Xaa = Ala,Cys,Gly,Ser
  UNSURE -5: Xaa = Phe,Ser,Tyr
  UNSURE 42: Xaa = Pro,Gln
MSLXIQHERLLLQAQGAGAQHPPEQEGEQDGNPAARPXTTSWDLQIALGLAXPLLXDLHHPETRGRTRRPGRGLTTLNTGYQHPVLAGKTCSGVPAPXPHTPAVVWAVTRRSVAQTVTFV

SEQ ID NO: 5866 - protein, 130 aa, Homo sapiens
  SIGNAL -36..-1
  UNSURE 90: Xaa = Ala,Pro,Ser,Thr
MQQNVFLPLRRFLHQPPRSSGMPPLLWGLQCQSARAGCQALKRGYKAGLGKYTRMDNHLEELSLPVPTSDRTTSRTSSSSSSDSSTNLHSPNPSDDGADTPLAQSDEEEERGDGGAELEPAASSGXLTTD

SEQ ID NO: 5867 - protein, 73 aa, Homo sapiens
  SIGNAL -46..-1
MTSLQSARPSLLGNGHRFLMEKDGLEPLNRVCVFLLCQQWGRKTSALRGKGGHPRSQVHEWQPGFKSLPASRT

SEQ ID NO: 5868 - protein, 57 aa, Homo sapiens
  SIGNAL -43..-1
MPDLSSLAAYLRGTLNSTCSKIILCLNPDSLLLQCSLFQFIATPSSVSHSKSPGVMC

SEQ ID NO: 5869 - protein, 83 aa, Homo sapiens
  SIGNAL -45..-1
  UNSURE 38: Xaa =  * ,Gln
  UNSURE 26: Xaa = Leu,Met
MFPLVKSALNPSPSFEAFQQTNGKAEPPETLHLIFMTNTVNAVLASGATFCIVTWTYVATQVGIEWNLVPXLAELPQRNGGIX

SEQ ID NO: 5870 - protein, 56 aa, Homo sapiens [sequence omitted]

SEQ ID NO: 5871 - protein, 60 aa, Homo sapiens
  SIGNAL -23..-1
  UNSURE 18: Xaa = Leu,Val
MGVRDGNKPWSFLRCHDSSPAWAVVHTVQPWILSIFTCGGXMVTLIVDYTVARINAEHCY

SEQ ID NO: 5872 - protein, 61 aa, Homo sapiens; identical to SEQ ID NO: 5856
  SIGNAL -32..-1

SEQ ID NO: 5873 - protein, 52 aa, Homo sapiens
  SIGNAL -35..-1
  UNSURE -20: Xaa =  * ,Glu,Gly
MPFQFGTQPRRFPVEXGDSSIELEPGLSSSAACNGKEMSPTRQLRSALEVIA

SEQ ID NO: 5874 - protein, 52 aa, Homo sapiens
  SIGNAL -35..-1
MPFQFGTQPRRFPVEGGDSSIELEPGLSSSAACNGKEMSPTRQLRSALEVIA

SEQ ID NO: 5875 - protein, 52 aa, Homo sapiens; identical to SEQ ID NO: 5874
  SIGNAL -35..-1

SEQ ID NO: 5876 - protein, 54 aa, Homo sapiens
  SIGNAL -35..-1
  UNSURE 18: Xaa =  * ,Leu
  UNSURE 3: Xaa = Ile,Met
MPFQFGTQPRRFPVEGGDSSIELEPGLSSSAACNGKEXSPTRQLRSALEVIAXQ

SEQ ID NO: 5877 - protein, 52 aa, Homo sapiens; identical to SEQ ID NO: 5874
  SIGNAL -35..-1

SEQ ID NO: 5878 - protein, 103 aa, Homo sapiens
  SIGNAL -20..-1
MRMSLAQRVLLTWLFTLLFLIMLVLKLDEKAPWNWFLIFIPVWIFDTILLVLLIVKMAGRCKSGFDPRHGSHNIKKKAWYLIAMLLKLAFCLALCVNWNSLLP

SEQ ID NO: 5879 - protein, 99 aa, Homo sapiens
  SIGNAL -21..-1
  UNSURE -20: Xaa = Ala,Asp
MXEDVIPCQVTLLGSVIFTFQHTQHLAISKHNLMFLYTIFIVATKITMMTTQTSTMTFAPFEDTLSWMLFGWQQRFHHVRRKVKQSHLPMALGHWPQSR

SEQ ID NO: 5880 - protein, 152 aa, Homo sapiens
  SIGNAL -77..-1
MGSAGLSRLHGLFAVYKPPGLKWKHLRDTVELQLLKGLNARKPPAPKQRVRFLLGPMEGSEEKELTLTATSYPLSSTIHWYVDQHSPISRLAWDIGWMPRLLEYLCSAWDMDAGSSPICTMLILPRITQCVASWAKLQMTSVRREAGREDNL

SEQ ID NO: 5881 - protein, 108 aa, Homo sapiens
  SIGNAL -54..-1
MNRTRTGRLAGVPAEGASRPCAAVPGGQRGCPACPLAGERELTHLLLPASEGDTEPQVTPHHQRRCLCLSDKYSQACHPLGSKVRSAESQDQETGSSPGWTNRQRCGK

SEQ ID NO: 5882 - protein, 88 aa, Homo sapiens
  SIGNAL -80..-1
MMFYWLLSIVGRQRASPGWQNWSSARNSASAAEARSMALPPRHRWSSVEVESRALLWPITNPKWGGRILSFWSRAGWLLALPGSVLAS

SEQ ID NO: 5883 - protein, 54 aa, Homo sapiens [sequence omitted]

SEQ ID NO: 5884 - protein, 143 aa, Homo sapiens
  SIGNAL -114..-1
MYTTVDANGYLKNGSAGQLSQSSHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 5885 - protein, 52 aa, Homo sapiens
  SIGNAL -29..-1
METVADGSLCFLKRNYALSMHDLCAWISSLPALFCMLSKRIALGSIVSVHSG

SEQ ID NO: 5886 - protein, 75 aa, Homo sapiens
  SIGNAL -37..-1
  UNSURE 35: Xaa =  * ,Tyr
  UNSURE 31: Xaa = Ala,Pro,Ser,Thr
  UNSURE 27: Xaa = Asn,Tyr
  UNSURE 25: Xaa = Gly,Trp
  UNSURE 10: Xaa = Lys,Arg
MFVFCLILNREKIKGGNSSFFSSFFFFFISKLLPVFSMMDNRGICCXVFYCLVYKAAFECWXFXSFEXTHFXNTC

SEQ ID NO: 5887 - protein, 90 aa, Homo sapiens
  SIGNAL -43..-1
  UNSURE -8: Xaa = Ala,Val
  UNSURE -38: Xaa = Arg,Ser
  UNSURE 6: Xaa = Gly,Val
  UNSURE -22: Xaa = Ser,Trp
MASRNXGGDLEDLSIPGTILAXPGRTATQMRVLGLXLQEEGRGCPWRDXALPFYILQIALGPRSCAPTPLSPACSSVFPGHIVKRFTRLC

SEQ ID NO: 5888 - protein, 64 aa, Homo sapiens
  SIGNAL -26..-1
  UNSURE 32: Xaa = Ala,Pro
  UNSURE -8: Xaa = Gly,Arg
  UNSURE 17: Xaa = His,Gln
  UNSURE -7: Xaa = Ile,Val
MEFCIYYYLSVAQMCVLGXXSRVAFACRLLRWSPVAVRECWPXSLESPPGSQAVPPVXPTAPIL

SEQ ID NO: 5889 - protein, 134 aa, Homo sapiens [sequence omitted]

SEQ ID NO: 5890 - protein, 119 aa, Homo sapiens [sequence omitted]

SEQ ID NO: 5891 - protein, 53 aa, Homo sapiens [sequence omitted]

SEQ ID NO: 5892 - protein, 52 aa, Homo sapiens
  SIGNAL -30..-1
MSSCGIVGSSVSFQLDAVKLLLKMVSSATTERCCNGSANFHKNLCATGIKNF

SEQ ID NO: 5893 - protein, 82 aa, Homo sapiens [sequence omitted]

SEQ ID NO: 5894 - protein, 112 aa, Homo sapiens
  SIGNAL -54..-1
MRKKCKCFTIKKTNTYEESNAGNEGQKEAISICICRRDGLLPLWVTRLSDLVFSKEKAHGMIPLLGSHREKKTSKEMKTSSRNLRYFIVCRDASSYTPQSLISGYIGPCQHQ

SEQ ID NO: 5895 - protein, 92 aa, Homo sapiens [sequence omitted]

SEQ ID NO: 5896 - protein, 79 aa, Homo sapiens
  SIGNAL -46..-1
MASKHESSDADNLDIPKRSCKMLPFSEKVKVLHLIRCLLRTFVSQTRETLIHSLTIGIFVQRPMNYCYFKFASKFIIGS

SEQ ID NO: 5897 - protein, 63 aa, Homo sapiens
  SIGNAL -49..-1
  UNSURE -6: Xaa = Ala,Pro
MAEPTSDFETPIGWHVSPELTPTLGPLSDTAPPRDSWMFWAMLXATATTTYVLASRSRVKAFL

SEQ ID NO: 5898 - protein, 80 aa, Homo sapiens
  SIGNAL -32..-1
MHVIGSFKTERVLPWGLQTLYFTLCNMRGLHASSGCSLLSLWGIQMHDIVCTWEICRFPKLLEGGHLRGDVLRCIMQSTN

SEQ ID NO: 5899 - protein, 54 aa, Homo sapiens
  SIGNAL -48..-1
  UNSURE -19: Xaa = Ala,Pro
  UNSURE -46: Xaa = Arg,Thr
MRXAGGRRRHRGDSWSRGHGGSANGRWSGXLRRGTLQKLCFSPSRILGCDRCSS

SEQ ID NO: 5900 - protein, 58 aa, Homo sapiens
  SIGNAL -19..-1
MPLISHILVNLQSSNEVLTSYYFIQIRRFRITLKISFYFFKPASFHPQKHCSINIKQS

SEQ ID NO: 5901 - protein, 92 aa, Homo sapiens [sequence omitted]

SEQ ID NO: 5902 - protein, 55 aa, Homo sapiens
  SIGNAL -45..-1
  UNSURE -25: Xaa = Ala,Pro,Ser
  UNSURE -30: Xaa = Lys,Asn
MIGCKCEAHQPTLCGXCCGAXCHPPTSLPLLLVTLVCRLPSKLQAYSYLSTALLV

SEQ ID NO: 5903 - protein, 88 aa, Homo sapiens [sequence omitted]

SEQ ID NO: 5904 - protein, 93 aa, Homo sapiens
  SIGNAL -82..-1
MSYPADDYESEAAYDPYAYPSDYDMHTGDPKQDLAYERQYEQQTYQVIPEVIKNFIQYFHKTVSDLIDHPSWLASWTSQSRSSGSSFLSSNTR

SEQ ID NO: 5905 - protein, 53 aa, Homo sapiens [sequence omitted]

SEQ ID NO: 5906 - protein, 110 aa, Homo sapiens
  SIGNAL -69..-1
  UNSURE 21: Xaa = Ala,Pro
MAAPRRGRGSSTVLSSVPLQMLFYLSGTYYALYFLATLLMITYKSQVFSYPHRYLVLDLALLFLMGILEAVRLYLGTRGNLTEAERPLAXSLALTAGTASSLPTSCFGRP

SEQ ID NO: 5907 - protein, 63 aa, Homo sapiens
  SIGNAL -57..-1
MSQIRTVRWMPSDIPLKLWQNCPCLMRRMSRSIVMVERESGIAFLDIFLLNLWLAFPKHSHNK

SEQ ID NO: 5908 - protein, 93 aa, Homo sapiens
  SIGNAL -61..-1
MKIALCQRELPSPRSCLLSRDVTGVICTRMPRLAICSKTAQKALPCIPLLHTSPLCLQLLSAGLHIYATLCKSCASRNHKNIFLHLLHSLSAA

SEQ ID NO: 5909 - protein, 92 aa, Homo sapiens
  SIGNAL -46..-1
  UNSURE 43: Xaa = Cys,Arg,Ser
  UNSURE 42: Xaa = Lys,Asn
MATFTSQVQVILLPQPLSSWDYRHAPTCPANFVFLVETGFLHVGQAGLKLLTSGDPPASASQSAGITGVSHRAQPTSSHLNTNLAGHXXLYN

SEQ ID NO: 5910 - protein, 81 aa, Homo sapiens
  SIGNAL -70..-1
MHFVVFLDTKIVHHACNTFFKNTDDLDLFLKNFKHCRFRRSLYSSSTTNLNPVAKNSNFILIPLSSTSFGTGAQKHRMTLG

SEQ ID NO: 5911 - protein, 112 aa, Homo sapiens
  SIGNAL -67..-1
MKVKIKCWNGVPLGSGWPTMRTVASAGWHLTDAALTARCPATTARWCGASAPTASTCIASSSGCTHSRCSSTAPCAARNGSSRSEARPGSRWRGILRLLPHAGADGCWGQRP

SEQ ID NO: 5912 - protein, 90 aa, Homo sapiens
  SIGNAL -43..-1
  UNSURE -8: Xaa = Ala,Val
  UNSURE -38: Xaa = Arg,Ser
  UNSURE 6: Xaa = Gly,Val
  UNSURE 26: Xaa = Pro,Thr
  UNSURE -22: Xaa = Ser,Trp
MASRNXGGDLEDLSIPGTILAXPGRTATQMRVLGLXLQEEGRGCPWRDXALPFYILQIALGPRSCAPTXLSPACSSVFPGHIVKRFTRLC

SEQ ID NO: 5913 - protein, 88 aa, Homo sapiens [sequence omitted]

SEQ ID NO: 5914 - protein, 92 aa, Homo sapiens [sequence omitted]

SEQ ID NO: 5915 - protein, 182 aa, Homo sapiens
  SIGNAL -64..-1
MAVTEASLLRQCPLLLPQNRSKTVYEGFISAQGRDFHLRIVLPEDLQLKNARLLCIWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTLRAP

SEQ ID NO: 5916 - protein, 57 aa, Homo sapiens
  SIGNAL -15..-1
  UNSURE 5: Xaa = Cys,Asp,Gly,Tyr
MHLTALSSYMSGIIQNVSFXVRLISLSIISSRFILLVHSYNKGSTTCELGKSRLDIF

SEQ ID NO: 5917 - protein, 63 aa, Homo sapiens
  SIGNAL -43..-1
  UNSURE 6: Xaa = Cys,Phe,Tyr
  UNSURE 1: Xaa = Phe,Ile
  UNSURE 2: Xaa = Phe,Ile,Asn,Tyr
MKSLFWLLYLYVQNCYLIHFYIFKIFLLIFLTCLYIVLLISFSXXVCMXVFVFHGFLQLSEHI

SEQ ID NO: 5918 - protein, 75 aa, Homo sapiens
  SIGNAL -37..-1
  UNSURE 28: Xaa = Pro,Ser
MFVFCLILNREKIKGGNSSFFSSFFFFFISKLLPVFSMMDNRGICCRVFYCLVYKAAFECWWFYXFDTTHFYNTC

SEQ ID NO: 5919 - protein, 106 aa, Homo sapiens
  SIGNAL -73..-1
MTSPLCNLSLWGLYQRHGTSVWYPDCEISLWAKEGPTDKVASQPHPRNPRDFTPAGCHWGTELSQLSLPSCLAFVNHQSGERVSGLARIWAGWKSLSRSEIKGLGI

SEQ ID NO: 5920 - protein, 77 aa, Homo sapiens
  UNSURE 67: Xaa = Leu,Val
MPVVPALWEAEGGGSRGQEIETILANMVKPLSTKNTKNYPGVVVGACSPSYLGVPRQENFVNLGGGXAVSRDRATAL

SEQ ID NO: 5921 - protein, 67 aa, Homo sapiens
MGDKKSPTRPKRQPKPSSDEGYWDCSVCTFRNSAEAFKCMMCDVRKGTSTREEKAGSLTSNWSSPIG

SEQ ID NO: 5922 - protein, 51 aa, Homo sapiens
  UNSURE 34: Xaa = Cys,Arg
  UNSURE 14: Xaa = Gly,Trp
MAGENFATPFHGTXPRRLQRRVRARGGHVSAFGXARGSGCRTGRVRGGEGL

SEQ ID NO: 5923 - protein, 58 aa, Homo sapiens
MGRSPEVMSLRPAWPTWGKSVSTKNTKISRAWWQEPVIPATWEAEAEESLEPGRRWLQ

SEQ ID NO: 5924 - protein, 58 aa, Homo sapiens [sequence omitted]

SEQ ID NO: 5925 - protein, 56 aa, Homo sapiens
  UNSURE 52: Xaa = Ala,Pro
MTTSLCRESFLQMKKCDLAADGVSLCHPGWSAVAQSRLTASSASQVHAILLXQPPE

SEQ ID NO: 5926 - protein, 50 aa, Homo sapiens
  UNSURE 4: Xaa = Ile,Asn,Ser,Thr
MLAXWSQTPDLMPVIPAVWEAKAGGSPEIRSSRPCLANMAKPHSTKNTKN

SEQ ID NO: 5927 - protein, 51 aa, Homo sapiens
MHSREIRFRSNSIIQEVKHVRASCEISMGQPGTVTHACNLSILGGQGWRII

SEQ ID NO: 5928 - protein, 88 aa, Homo sapiens
MVSSDRPVSLEDEVSHSMKEMIGGCCVCSDERGWAENPLGLLRRARLQRRVHQACYGIVQVPTGPWFCRKCESQERAARVVRTIYQKH

SEQ ID NO: 5929 - protein, 91 aa, Homo sapiens
  UNSURE 89: Xaa = Pro,Arg
MESHSVTQAGMQWCHLRSLQPLPPRFRRFFYLSLLGSWDYRHALPCLANFCIFSRNRILPCWPGWSQTPDLKLSAHFGLPECWDYGHEXNF

SEQ ID NO: 5930 - protein, 96 aa, Homo sapiens
MKQGGAALEGSALANGRALSAGSPPVPPAGTLTLHPGRAQEETRAPISPATHRGTLQRTKKLCSNPNLCEVARPSPSCLPGPGPSRLQVHPSRPEK

SEQ ID NO: 5931 - protein, 58 aa, Homo sapiens
MNPKIQETQRAPRRINIDSGQVQWLTPIIPALWEAEVGGSQGHEIKTSLTNMVKPCLY

SEQ ID NO: 5932 - protein, 58 aa, Homo sapiens
  UNSURE 3: Xaa = Pro,Arg
MEXGLEVSTGQAPGSPCRLGRWRLLESRGTSSPWPNSCRPEARRDRLQPLGGVCETGQ

SEQ ID NO: 5933 - protein, 68 aa, Homo sapiens
  UNSURE 12: Xaa =  * ,Trp
  UNSURE 14: Xaa = Glu,Gly
  UNSURE 18: Xaa = Ile,Lys,Arg,Thr
MCISMGKKASHXFXMKTXIFMVKCQHVCTCVVCTSKQRRLIKVNALRPSAVAHTGNPSTLGGRGGRIA

SEQ ID NO: 5934 - protein, 58 aa, Homo sapiens [sequence omitted]

SEQ ID NO: 5935 - protein, 102 aa, Homo sapiens
  UNSURE 87: Xaa = Cys,Gly
MLLPSSTHTIPFYPNPLHPRPFPSSRLPPGIIGGEYDQRPTLPYVGDPISSLIPGPGETPSQFPPLRPRFDPVGPLPGPNPILPGRXGPNDRFPFRPSRVGN

SEQ ID NO: 5936 - protein, 109 aa, Homo sapiens [sequence omitted]

SEQ ID NO: 5937 - protein, 61 aa, Homo sapiens
MQAWGLGLLDLCVPFHRDCHLLPPARRWGGLQSWWYSGQQQIPVKHPKDQHPQDSGRQSGV

SEQ ID NO: 5938 - protein, 61 aa, Homo sapiens [sequence omitted]

SEQ ID NO: 5939 - protein, 50 aa, Homo sapiens
MAQMSIRISVQGLQWLQPIPEAQGARQEVIVGPGAVALACNPSTLGGRGW

SEQ ID NO: 5940 - protein, 72 aa, Homo sapiens
  UNSURE 63: Xaa = Lys,Asn,Thr
MLFVHPTSPWGTNTPHFIIIRFIHMVQVGLFLPSSGDRLTQAQAHQNALSWSGMVAHACNPSXLGDRGAWIT

SEQ ID NO: 5941 - protein, 76 aa, Homo sapiens
  UNSURE 6: Xaa = Leu,Arg
MTHNIXYFALLENIPWLSHAAGIWQELSSIEWKWGHTLDLARALLGTHSSITQPHGAGSTREKRLETRQMLVPRRW

SEQ ID NO: 5942 - protein, 118 aa, Homo sapiens
  UNSURE 24: Xaa = Gly,Leu,Val,Trp
  UNSURE 23: Xaa = Leu,Trp
MPRVGECRWFRLRQSRPGSVAAXXNARMGTRKKVHAFVRVKPTDDFAHEMIRYGDDKRSIDIHLKKDIRRGVVNNQQTDWSFKLDGVLHDASQDLVYETVAKDVVSQALDGYNGNLIN

SEQ ID NO: 5943 - protein, 58 aa, Homo sapiens
MTRIQESTVGMCTTGGHLLTLSPHWTTFLGSQLIAAEQAYFLLLPCFTCFQFNSSVLS

SEQ ID NO: 5944 - protein, 82 aa, Homo sapiens
MSHRTSSTFRAERSFHSSSSSSSSSTSSSASRALPAQDPPMEKALSMFSDDFGSFMRPHSEPLAFPARPGGAGNIKDPRRRL

SEQ ID NO: 5945 - protein, 74 aa, Homo sapiens
  UNSURE 41: Xaa =  * ,Arg,Ser,Thr
  UNSURE 45: Xaa = Lys,Arg
MQPPPRKVKVTQELKNIQVEQMTKLQAKHQAECDLLEDMRXFSQXKAAIEREYAQGMQKLASQYLKERLAWSKS

SEQ ID NO: 5946 - protein, 75 aa, Homo sapiens
  UNSURE 71: Xaa = Asn,Tyr
MGISGGLSSGYQNQYLSILFQHVGQEDEGRGYPGTSPAQEKLEAFPQQGRSLEEGCKSILYPLICLSDFYXCSAY

SEQ ID NO: 5947 - protein, 61 aa, Homo sapiens
MPGVRGKEESTERKKKMTWPPCKRVNGIHIQHLYQKRGLRVRMANKLESLNLWGKVLWTVS

SEQ ID NO: 5948 - protein, 100 aa, Homo sapiens
  UNSURE 36: Xaa = His,Gln
MAQFAFESYLHSLLQLDAPIPNAPPARWQRKPRKPXPAPSPMRAANRSHSAGRTPGRTPGKSSSKVQTTPSKPGGDRYIPHRSAAQMEVASFLLSKEEPA

SEQ ID NO: 5949 - protein, 56 aa, Homo sapiens
  UNSURE 44: Xaa = Ile,Lys,Arg,Thr
MGQPHGLMPIKLSTAMPWSQWIDFICVVGGKNLSGDYTSEDVEXRELLYTVDGNIN

SEQ ID NO: 5950 - protein, 51 aa, Homo sapiens
  UNSURE 18,19: Xaa = Glu,Lys
  UNSURE 17: Xaa = Glu,Lys,Met,Val
  UNSURE 16: Xaa = Met,Val
MMRLRKRKVRKKKKKXXXXKPKIEDMASDEEDDSGMDKKKKIKAGCSGSCL

SEQ ID NO: 5951 - protein, 99 aa, Homo sapiens
  UNSURE 88: Xaa = Ala,Glu
MVSNPVHGLPFLPGTSFKDSTKTAFHRSQTLSYRNGYAIVRRPTVGIGGDRLQFNQLSQAELDELASKAPVLTYGQPKQAPPADFIPXHVAFDKKVLKF

SEQ ID NO: 5952 - protein, 66 aa, Homo sapiens [sequence omitted]

SEQ ID NO: 5953 - protein, 69 aa, Homo sapiens
  UNSURE 33: Xaa = Leu,Val
MPVIPALWEAEAGGSQGQEIETILANTVKPHLXLKIQNISGVWWRAPVVPATQEPEAGEWREPRRQSFQ

SEQ ID NO: 5954 - protein, 63 aa, Homo sapiens
MLPSDVSILYHMKTLLLLQDTERLKHALEMFPEHCTMPPDHARVISAFFSYWITHILPEKSSD

SEQ ID NO: 5955 - protein, 64 aa, Homo sapiens
MRQGLALSPRLECSGAIRVYCRLDFPSSSDPPSLSNSWDHRHLPPYPANFCIFCKDGVLPCCLG

SEQ ID NO: 5956 - protein, 57 aa, Homo sapiens [sequence omitted]

SEQ ID NO: 5957 - protein, 67 aa, Homo sapiens
MDRAPTEQNVKLSAEVEPFIPQKKSPDTFMIPMALPNDNGKCFWCGTNSNSQLPDYLLPICAGKPVQ

SEQ ID NO: 5958 - protein, 65 aa, Homo sapiens
  UNSURE 15: Xaa = Ile,Lys,Arg,Thr
MCCFIWTSHTKCLSXVDFKVVYRNLNSIPEIEVVQTAHGLVQTPAQPSLSKLVPPPGSHWWFSYY

SEQ ID NO: 5959 - protein, 50 aa, Homo sapiens [sequence omitted]

SEQ ID NO: 5960 - protein, 63 aa, Homo sapiens; identical to SEQ ID NO: 5954

SEQ ID NO: 5961 - protein, 61 aa, Homo sapiens [sequence omitted]

SEQ ID NO: 5962 - protein, 57 aa, Homo sapiens
MQISTRLQNKLFMISTNCSGKEATEEKNTNFGLKNESFLQQRNTQKKCKITHMGWTT

SEQ ID NO: 5963 - protein, 58 aa, Homo sapiens; identical to SEQ ID NO: 5931

SEQ ID NO: 5964 - protein, 75 aa, Homo sapiens
  UNSURE 47: Xaa = Ala,Asp,Gly,Val
MTSFEDADTEETVTCLQMTVYHPGQLQCGIFQSISFNREKLPSSEVXEIWPKFQHLSLYFSGQTGFPSSVFSAAV

SEQ ID NO: 5965 - protein, 63 aa, Homo sapiens
  UNSURE 2: Xaa = Ser,Thr
MXHHAHPVMVFCCCCLRQGGTLLPKLEYSGKYMAHCSLNFLGSNNPPASAFRVAGSIRVHPYA

SEQ ID NO: 5966 - protein, 56 aa, Homo sapiens
MPVSQATRTHSWLYLMRSQDKPFNSSKKVRKYSKHQSHNVELRCNFLFTLLPAWSG

SEQ ID NO: 5967 - protein, 56 aa, Homo sapiens
MHTNLRSELPSCNMHRKCTWRELQGDYSLAMGLRSLCNILTTGYGSGEKRNSIEGQ

SEQ ID NO: 5968 - protein, 87 aa, Homo sapiens [sequence omitted]

SEQ ID NO: 5969 - protein, 77 aa, Homo sapiens
MLDDDTENLTHERVPTELKKAIMQARTDKKLTQSQLAQIINEKPQVIQEYESGKAIPNQQILSKLERALGAKLRGKK

SEQ ID NO: 5970 - protein, 71 aa, Homo sapiens [sequence omitted]

SEQ ID NO: 5971 - protein, 74 aa, Homo sapiens
MGFFSRPRKLSGMGVLCSHPGGWNWRGPLCPAVSVSRTLTSLSLPLSTLPVRPLSRSVTWSVTQCPYTFHCCFW

SEQ ID NO: 5972 - protein, 113 aa, Homo sapiens
  UNSURE 75: Xaa =  * ,Glu,Lys,Gln
MRPLTEEETRVMFEKIAKYIGENLQLLVDRPDGTYFFRLHNDRVYYVSEKIMKLAANISGDKLVSLGTCFGKFTXTHKFRLHVTALDYLAPYAKYKVWIKPGAEQSFLYGNMC

SEQ ID NO: 5973 - protein, 68 aa, Homo sapiens
  UNSURE 30: Xaa = Asp,Asn
  UNSURE 36: Xaa = Gln,Arg
  UNSURE 41: Xaa = Gly,Ser
  UNSURE 47: Xaa = Pro,Arg
MSRQHPSSAAAATAVLSSRHWLPKLSSTRXLSGTPXRRGRXGPGAAXAAPVRRALFGRRTAGPHRLPS

SEQ ID NO: 5974 - protein, 66 aa, Homo sapiens [sequence omitted]

SEQ ID NO: 5975 - protein, 70 aa, Homo sapiens
MGKGFVRTLERYFLSGKPCCGPQISNLLVKDGVGPRGKEVGEERRRGRGKIVVLTRFTVLVKCGLCHQRK

SEQ ID NO: 5976 - protein, 84 aa, Homo sapiens [sequence omitted]

SEQ ID NO: 5977 - protein, 65 aa, Homo sapiens
MSTQMCQGKQIYTISVKNTEERWGFITPSDSCTSLLSFNKRCLINNFFGMLIILKVLCENLIRIC

SEQ ID NO: 5978 - protein, 65 aa, Homo sapiens [sequence omitted]

SEQ ID NO: 5979 - protein, 66 aa, Homo sapiens [sequence omitted]

SEQ ID NO: 5980 - protein, 60 aa, Homo sapiens
  UNSURE 36: Xaa =  * ,Glu,Lys,Gln
  UNSURE 35: Xaa = Arg,Thr
MNILPKKSWHVRNKDNVARVRVTRPRPGRRRRSVXXGAAGSARGPYRIPTEESQTSELTA

SEQ ID NO: 5981 - protein, 73 aa, Homo sapiens
  UNSURE 49: Xaa = Glu,Gly
MGVKLEIFRMIIYLTFPVAMFWVSNQAEWFEDDVIQRKRELWPPEKLQXIEEFKERLRKRREEKLLRDAQQNS

SEQ ID NO: 5982 - protein, 86 aa, Homo sapiens
  UNSURE 57: Xaa = Ala,Pro
  UNSURE 55: Xaa = His,Gln
MEYLSALNPSDLLRSVSNISSEFGRRVWTSAPPPQRPFRVCDHKRTISERPDSCXPXGAASQSIGDPTAEWSANPGARGGWNCSGQ

SEQ ID NO: 5983 - protein, 88 aa, Homo sapiens
  UNSURE 75: Xaa = Leu,Val
MKSLEFHWPRDGSLLLNFKQEEPRAEKGPVPDKISELMPLNAAQCPVLNLDRVLERRNHAGTEAIDLTSSGPFLXFGRCAVNGQALRE

SEQ ID NO: 5984 - protein, 55 aa, Homo sapiens
MGRGFHLSPSASCTSVTSLTKEEELACSLGFPQWPPFRWHNVVPCPGPQFPHLWN

SEQ ID NO: 5985 - protein, 64 aa, Homo sapiens; identical to SEQ ID NO: 5955

SEQ ID NO: 5986 - protein, 62 aa, Homo sapiens
  UNSURE 32: Xaa =  * ,Cys
  UNSURE 61: Xaa = Gly,Arg
  UNSURE 43: Xaa = Leu,Pro
  UNSURE 42: Xaa = Phe,Ser
  UNSURE 34: Xaa = Pro,Ser
MTKKKRFQLDYLNIGKYCALGFVFPFKKYVLXIXKLHDLYLXXFNSSFMLTFKRFVFPQRXI

SEQ ID NO: 5987 - protein, 56 aa, Homo sapiens
  UNSURE 32: Xaa = Asp,Glu
MGFHLTCHPGLKLLTSCSTRLSLPECWDCRRXTTPRLLRLLKVLLHYSNLRNLVLF

SEQ ID NO: 5988 - protein, 62 aa, Homo sapiens
  UNSURE 2: Xaa = Ala,Pro
  UNSURE 61: Xaa = Gly,Val
MXPNQSQIQTPTDLVSLVTQHHLIPPNQSQIQIPTDLVSLIRASNPTGWSLCCLPGSDVRXI

SEQ ID NO: 5989 - protein, 61 aa, Homo sapiens
  UNSURE 34: Xaa = Asp,His,Asn,Tyr
MSTSWIKNTDGNLVKDHSDCYMENVLGRKKTAGXKSSEQALAVIQVRCRSWSWSSHSELCR

SEQ ID NO: 5990 - protein, 90 aa, Homo sapiens
MKTSQIAFCSKTELLSRRSQLPSSHFKEWERVGVGFSFSFSCGAAEILQRSFPFKKILVFPVLPPEDRFSLDILISLTYFFPILFTEQVM

SEQ ID NO: 5991 - protein, 83 aa, Homo sapiens [sequence omitted]

SEQ ID NO: 5992 - protein, 87 aa, Homo sapiens
  UNSURE 36: Xaa = Ser,Thr
MSGMRRYEVALEAEEEIYWGCFYFFPWLRMWRRERXRAHPGEQKLEPLRGLMSCLSSGLGPTPQRSGRGFPRRSPTAAAQPASALKI

SEQ ID NO: 5993 - protein, 74 aa, Homo sapiens
MASGDFCSPGEGMEILQQVCSKQLPPCNLSKEDLLQNPYFSKLLLNLSQHVDESGLSLTLAKEQAQAWKGSSTA

SEQ ID NO: 5994 - protein, 53 aa, Homo sapiens
  UNSURE 47: Xaa = Ala,Glu,Gly,Val
  UNSURE 31: Xaa = Gly,Arg,Trp
MALSGKVKSERRTLATAVVFCSSFLFGELHXWSYQWSVLCGYFAQQXVLDTSV

SEQ ID NO: 5995 - protein, 64 aa, Homo sapiens
MLPLRSGLRHLRATPNTRGSARLLRAEMPKKAGATTKGKSQSKEPERPLPPLGPWQLILKDASP

SEQ ID NO: 5996 - protein, 53 aa, Homo sapiens [sequence omitted]

SEQ ID NO: 5997 - protein, 50 aa, Homo sapiens [sequence omitted]

SEQ ID NO: 5998 - protein, 60 aa, Homo sapiens [sequence omitted]

SEQ ID NO: 5999 - protein, 71 aa, Homo sapiens
  UNSURE 60: Xaa =  * ,Asp,Glu,His,Lys,Asn,Gln,Tyr
  UNSURE 10: Xaa =  * ,Tyr
MWDVYLSVAXTRTPLNKTSKCRRDSWGNCIPLWISELVRSMCIGEPRGTVDDQVSLGSWXIMISPRGRSLY

SEQ ID NO: 6000 - protein, 67 aa, Homo sapiens
MLRSSRSRESTCPTRSWRGAAVAVGGGPSPLVAVVALDCWKTITFSRSALGNNHSPPARACLCPLYH

SEQ ID NO: 6001 - protein, 102 aa, Homo sapiens
MGNPGTFKRGLLLSALSYLGFETYQVISQAAVVHATAKVEEILEQADYLYESGETEKLYQLLTQYKESEDAELLWRLARASRDVAQLSRTSEEEKKLLVYEA

SEQ ID NO: 6002 - protein, 55 aa, Homo sapiens
MGVLTRELFGVVGMLYILIVGMVTWLDAFVKTHLMVMQNEYILILCNYTSKFEFF

SEQ ID NO: 6003 - protein, 60 aa, Homo sapiens [sequence omitted]

SEQ ID NO: 6004 - protein, 55 aa, Homo sapiens [sequence omitted]

SEQ ID NO: 6005 - protein, 63 aa, Homo sapiens
MESRCITQAGVQWHDLGSLQPPPPRFKQFCLSLLSSWDYRRVPPHLTCIFSRDEVSPCFSGWS

SEQ ID NO: 6006 - protein, 59 aa, Homo sapiens
  UNSURE 25: Xaa = Ala,Asp,Glu,Gly,Val
  UNSURE 26: Xaa = Glu,Gly,Lys,Gln,Arg
MAQLIAKEAGTGHMHRALKNIHKPXXIKLLSSSSETLTIQSSQMAGGILRLPFLLIDTF

SEQ ID NO: 6007 - protein, 63 aa, Homo sapiens
MQLRGGRQWEPAFSPARANSGSSLPRSSRRPRAAPLARSWMNPLATEMGKAAPRLWGLDRSPR

SEQ ID NO: 6008 - protein, 51 aa, Homo sapiens [sequence omitted]

SEQ ID NO: 6009 - protein, 56 aa, Homo sapiens
  UNSURE 6: Xaa =  * ,Glu,Lys,Gln
  UNSURE 5: Xaa = His,Leu,Pro,Gln,Arg
MKAQXXRLQIPGLTLDLTPRSLSPTPSSPGSPCSPLLAFHFWSPVCPNAGRTSPLG

SEQ ID NO: 6010 - protein, 52 aa, Homo sapiens
MWLRGRHCPLQKGLRGREKTCARFWGAGDAVNPAEAGFCPDSRWWLWEGLGP

SEQ ID NO: 6011 - protein, 89 aa, Homo sapiens
MPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 6012 - protein, 65 aa, Homo sapiens [sequence omitted]

SEQ ID NO: 6013 - protein, 74 aa, Homo sapiens
MGPEQGTRPAACNRCICARSCAPASYLTPGSQSRWEFLTYSKKSVLGKEHTRIDFRLAASLETHKKRPNGKATF

SEQ ID NO: 6014 - protein, 54 aa, Homo sapiens
  UNSURE 22: Xaa =  * ,Ser
  UNSURE 48: Xaa = Cys,Trp
  UNSURE 25: Xaa = Leu,Val
MQPRFLYLLRIGITGASEGVGXCSXVVRTSGFRDGQVLVWALAQLPPXFISLRS

SEQ ID NO: 6015 - protein, 66 aa, Homo sapiens
MFTGNLSEKENSEVEFQCIDETALQAIVEYAYTGTVFISQDTVESLLPAANLLQIKACPERMLCIS

SEQ ID NO: 6016 - protein, 57 aa, Homo sapiens [sequence omitted]

SEQ ID NO: 6017 - protein, 128 aa, Homo sapiens
MAAEIHSRPQSSRPVLLSKIEGHQDAVTAALLIPKEDGVITASEDRTIRVWLKRDSGQYWPSIYHTMASPCSAMAYHHDSRRIFVGQDNGAVMEFHVSEDFNKMNFIKTYPAHQNRVSAIIFSLATEW

SEQ ID NO: 6018 - protein, 103 aa, Homo sapiens
  UNSURE 90: Xaa = Asp,Glu
  UNSURE 47: Xaa = Asp,His
MGKRKSAAKPPPKKRMDKLDTVFSCPFCNHGSSVECRIDMKNLIGEXLVESVRKTSAQLLMHSLSLLIYIVNGLTSVSVSTLLKATMMRXLPHAMKLLPTIVM

SEQ ID NO: 6019 - protein, 82 aa, Homo sapiens
  UNSURE 62: Xaa =  * ,Tyr
  UNSURE 51: Xaa = Ala,Val
  UNSURE 11: Xaa = Asp,His
  UNSURE 67: Xaa = Phe,Leu
MRPVFCGNFDXDTRQYDLERLFSKYGPISRIDMKLGYAFIYFEDERDAEDXIRRLENVSFGXNRRRXSVEWSRQVEPGAKEP

SEQ ID NO: 6020 - protein, 58 aa, Homo sapiens
  UNSURE 26: Xaa = Ile,Leu,Val
MIYRNWSLLSSTVVIWGGVAPPASPXIFLLGGKEKFNGYLCREGERLRQQDRAAMGRS

SEQ ID NO: 6021 - protein, 78 aa, Homo sapiens [sequence omitted]

SEQ ID NO: 6022 - protein, 69 aa, Homo sapiens
MYSGGPCPPSSNSGISASTCSSNGRMEGPPPTYSEVMGHHPGASFLHHQRRTHTGAADCSFSRTMQRAQ

SEQ ID NO: 6023 - protein, 57 aa, Homo sapiens
MWNIQSGKFGKSIPKAKSLAHTNIGGKRDTLKELLCFGRWRRADHEIKRLRPSWPTQ

SEQ ID NO: 6024 - protein, 50 aa, Homo sapiens
MCGGLSCLNLFRAVCSVHQMGRSGMRHLRPFRSGLNRMLEPRLDSDTLRF

SEQ ID NO: 6025 - protein, 56 aa, Homo sapiens
MWDCFLFPSQVLIWSKQITKRSDRRSEEDYPVEQSCFRLRPGAPVSGSCCQTWKVN

SEQ ID NO: 6026 - protein, 70 aa, Homo sapiens
MESCSVAQAGVQWYDLGSLQAPPPGFLPFSCLSLQSGWDCRRPPPRLANFFLYFWWRRGFAMLARMVWIF

SEQ ID NO: 6027 - protein, 60 aa, Homo sapiens
MRGLDQMEIQGVRGCPHAAHPHPHGPWSLHPSSHHAPAPQILPKVSKKKKDTTDTCKQHG

SEQ ID NO: 6028 - protein, 50 aa, Homo sapiens
  UNSURE 39: Xaa = Asp,Glu
  UNSURE 46: Xaa = Lys,Met,Arg
MYAMHLVELSERSSAISLVQRARRDGMPFFSGGKEQRAXRWWWRSXRSSS

SEQ ID NO: 6029 - protein, 79 aa, Homo sapiens
MSSRPSFKLKPRVKGGKKGAAADEDATAASKAMRIVKEWTSWTMTKAKVVVHYGFIPLVIITGMNSNPKPSAFQVISPV

SEQ ID NO: 6030 - protein, 160 aa, Homo sapiens
  UNSURE 138: Xaa =  * ,Glu,Lys,Gln
MDEDYYGSAAEWGDEADGGQQEDDSGEGEDDAEVQQECLHKFSTRDYIMEPSIFNTLKRYFQAGGSPENVIQLLSENYTAVAQTVNLLAEWLIQTGVEPVQVQETVENHLKSLLIKHFDPRKADSIFTEEGETPAWLXQMIAHTTWRDLFYKLAEAIQTV

SEQ ID NO: 6031 - protein, 62 aa, Homo sapiens
MPVISTLWEAEVVGPPEVRSSRPAWPTWQNSVSTKKYRPGTVAPCNASTLGGWGRQIMRSKD

SEQ ID NO: 6032 - protein, 73 aa, Homo sapiens
MSWEKEEGKSRHVDFQCVKSKSITNLAAAAADIPQDQLVVMHPTPQVDELDILPIHPPSGNSDLDPDAQNPML

SEQ ID NO: 6033 - protein, 50 aa, Homo sapiens [sequence omitted]

SEQ ID NO: 6034 - protein, 88 aa, Homo sapiens
MVPVQPAEPPEVLKSEPYGEKADVWAVGCILYQMATLSPPFYSTNMLSLATKIVEAVYEPVPEGIYSEKVTDTISRCLTPDAELVQIL

SEQ ID NO: 6035 - protein, 66 aa, Homo sapiens [sequence omitted]

SEQ ID NO: 6036 - protein, 74 aa, Homo sapiens
MGRKVKGVKPERECARCHNQSRNITCLLRINLHDYSLVSDLITPEFHQTFKQNQIFEKIKEEYSQTHFMKPALP

SEQ ID NO: 6037 - protein, 96 aa, Homo sapiens
MEVDAAVVPSVMACGVTGSVSVALHPLVILNISDHWIRMRSQEGRPVQVIGALIGKQEGRNIEVMNSFELLSHTVKRRLSLTRNIITPRRSSVRVE

SEQ ID NO: 6038 - protein, 104 aa, Homo sapiens
  UNSURE 22: Xaa = Ala,Pro
MCAWGLLPAAIFSPLNEGWVSXFLFLIFLEVTRFLFFSPGGEVSLSELIAVIHCQCFSSSGRRKAFRKKIVCKPSATTSSSSESRFLGELGLLKINYNKSQGSK

SEQ ID NO: 6039 - protein, 57 aa, Homo sapiens
MLRQENRLNPRSEGCSDPRSHHCTPSWATERDPVSKKKLRFFWGKEVKTYLNVLSSL

SEQ ID NO: 6040 - protein, 65 aa, Homo sapiens
  UNSURE 14: Xaa =  * ,Asp,Glu,His,Gln,Tyr
  UNSURE 16: Xaa = Ala,Gly
MEEFTCCRCAPPRXQXSGAARGSEASLSDLSPFGHRWEGERHSPDPAWQYSSVQPVTVGRGGVYL

SEQ ID NO: 6041 - protein, 93 aa, Homo sapiens
MQYGDHLYSKGNHDGAVQQYIRTIGKLEPSYVIRKFLDAQRIHNLTAYLQTLHRQSLANADHTTLLLNCYTKLKDSSKLEEFIKKKSESEVPL

SEQ ID NO: 6042 - protein, 98 aa, Homo sapiens
MNQYLETNSFPSAFPIMIQESMRFEKVFESAVDPGAVVDLLENGDPSKAETEAAGHREEYIGTGRTTRSLAGAVGREPGLPSGPTPGENHLPAGSPIC

SEQ ID NO: 6043 - protein, 60 aa, Homo sapiens [sequence omitted]

SEQ ID NO: 6044 - protein, 53 aa, Homo sapiens
  UNSURE 11: Xaa = Ala,Gly,Pro,Arg
MGRRGGSRLVXALWEAEAGGSPEVRSSRPGWPIWRNPVSTRNTIISQAWWRAL

SEQ ID NO: 6045 - protein, 112 aa, Homo sapiens
MAHVGSRKRSRSRSRSRGRGSEKRKKKSRKDTSRNCSASTSQGPRPARPLGRRREASRRPGGEQDPAPPPLLPVLLAPLLPPRPPPLPPVMAGRSGGITRTRGGRRRRRGRS

SEQ ID NO: 6046 - protein, 77 aa, Homo sapiens
MPVVPALWEAEGGGSRGQEIETILANMVKPLSTKNTKNYPGVVVGACSPSYLGVPRQENFVNLGGGLAVSRDRATAL

SEQ ID NO: 6047 - protein, 50 aa, Homo sapiens
MLNLSGVSQPFHGTPVHAGIHGQEAARHNRKIPELLLTNKILARCVGSRL

SEQ ID NO: 6048 - protein, 57 aa, Homo sapiens
MHSGKWLCMETRNGRGFQGHAFQAPFKFYSYCEESCIPTENMSDWRKIVTKGLPKGL

SEQ ID NO: 6049 - protein, 145 aa, Homo sapiens
MAAQCVRLARRSLPALALSLRPSPRLLCTATKQKNSGQNLEEDMGQSEQKADPPATEKTLLEEKVKLEEQLKETVEKYKRALADTENLRQRSQKLVEEAKLYGIQAFCKDLLEVADVLEKATQCVPKEEIKDDNPHLKNLYEGWS

SEQ ID NO: 6050 - protein, 130 aa, Homo sapiens
MSSKQEIMSDQRFRRVAKDPRFWEMPEKDRKVKIDKRFRAMFHDKKFKLNYAVDKRGRPISHSTTEDLKRFYDLSDSDSNLSGEDSKALSQKKIKKKKTQTKKEIDSKNLVEKKKETKKAITRVLKIKLI

SEQ ID NO: 6051 - protein, 55 aa, Homo sapiens [sequence omitted]

SEQ ID NO: 6052 - protein, 85 aa, Homo sapiens
  UNSURE 66: Xaa = Lys,Arg
MKMLDHPHIIKLYQVMETKSMLYLVTEYAKNGEIFACKQKIQNTSLKNKTIYASQGIYCTRLEAQXVLLFKDVCHTHTSSLRLID

SEQ ID NO: 6053 - protein, 86 aa, Homo sapiens
  UNSURE 17: Xaa = Ala,Gly,Pro,Arg
  UNSURE 15: Xaa = Ala,Val
  UNSURE 14: Xaa = Leu,Val
MDDKKKKRSPKPCXXQXAQAPGTLRRVPVTYQPQRLLGPRTSSSAIPQAAGQVQESRQREVPPSPGWRWKRLCRHAPAALLPDRGD

SEQ ID NO: 6054 - protein, 76 aa, Homo sapiens
MGEHEQKPLETSSSKVKAKTIVMIPDSQKLLRCELESLKSQLQAQTKAFEFLNHSVTMLEKESCLQKSRFSSLKRC

SEQ ID NO: 6055 - protein, 76 aa, Homo sapiens; identical to SEQ ID NO: 6054

SEQ ID NO: 6056 - protein, 63 aa, Homo sapiens
  UNSURE 25: Xaa = Cys,Gly,Arg,Ser
MLTEGCVIPSSFFLSQVSNLNISWXRTRWLTPVIPPLWEAEAGGSRGQEIETILAGTVKPRLY

SEQ ID NO: 6057 - protein, 89 aa, Homo sapiens
MRRSSRSFRAPGVREPPFRPGLRSLPCSCFYHHPSPPNPVDPLVSPSLQCTGFPSSSAQSISAHLSNSMPSSLLTISRCPGMFAVRCPL

SEQ ID NO: 6058 - protein, 97 aa, Homo sapiens
  UNSURE 13: Xaa = Lys,Asn
MYLGPCAVTHSCXSQHFGRLRRVDCLRPGVQEQPGQHGKTLSLMKIPKLARCGSPHLWSQLLRRLKHENCLNPGGRGCSELGSRTTLQPGKQRETYL

SEQ ID NO: 6059 - protein, 63 aa, Homo sapiens
MRRTMMRMTMMRMTMMRTTTRRRTMMRMRTTTRRNSCDGRTRAKGPRDIKEAFHSLKAFGSFT

SEQ ID NO: 6060 - protein, 131 aa, Homo sapiens
MAAAVAMETDDAGNRLRFQLELEFVQCLANPNYLNFLAQRGYFKDKAFVNYLKYLLYWKDPEYAKYLKYPQCLHMLELLQYKHFRKELVNAQCAKFIDEQQILHWQHYSRKRMRLQQALAEQQQQNNTSGK

SEQ ID NO: 6061 - protein, 53 aa, Homo sapiens [sequence omitted]

SEQ ID NO: 6062 - protein, 52 aa, Homo sapiens
  UNSURE 47: Xaa = Asp,Val
MITPLHLSLGSRVRPVFKKKKELGTVAHACNPSTLGGRGRQITRSGXRDHPG

SEQ ID NO: 6063 - protein, 60 aa, Homo sapiens
MIVWIKKMWHIYTMEYYAAINNDEFMSFVGTWMRLETIILSKLSQEREAKHRIFSLIGGS

SEQ ID NO: 6064 - protein, 76 aa, Homo sapiens
MAVAPSFNMTNPQPAIEGGISEVEIISQQVDEETKSIAPVQLVNFAYRDLPLAAVDLSTAGSQLLSNLDEDYQREG

SEQ ID NO: 6065 - protein, 55 aa, Homo sapiens
MPYSPLIILKSPKIFSLVTDLGTAKQLLTQYSLVFICWLFICLFICIFIFMYVTM

SEQ ID NO: 6066 - protein, 53 aa, Homo sapiens
MPCTDSASWGLHSCTVSNNYNNSYHLMSIYHVPGIRLNLYMNYSIEPFYPCLE

SEQ ID NO: 6067 - protein, 69 aa, Homo sapiens
MTPHPCGLCCKCCSFYHLSYWQPPSQSSGIPGLLSSAYHFTSTPDFPASQHPIFSQCRLLLCHLLGVPC

SEQ ID NO: 6068 - protein, 84 aa, Homo sapiens
MPYLLISTQIRMEVGPTMVGDEQSDPELMQHLGASKRRALGNNFYEYYVDDPPRIVLDKLERRGFRVLSMTGVGQTLVWCLHKE

SEQ ID NO: 6069 - protein, 178 aa, Homo sapiens
MTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPRPVRPEDIE

SEQ ID NO: 6070 - protein, 50 aa, Homo sapiens
MSTRLTNRCSHSVTFGVNEAPDLSEVAVSLRHILNAGGLHQQRVVCGGDF

SEQ ID NO: 6071 - protein, 102 aa, Homo sapiens
MGLGAVPGRQAAFREGLEQAVRYAKALGCPRIHLMAGRVPQGADRIAVKAEMEAVFLENLRHAAGVLAQEDLVGLLEPINTRITDPQYFLDTPQQAAASYRR

SEQ ID NO: 6072 - protein, 55 aa, Homo sapiens
MSASSLLEQRPKGQGNKVQNGSVHQKDGLNDDDFEPYLSPQARPNNAYTAMSDFP

SEQ ID NO: 6073 - protein, 127 aa, Homo sapiens
MKNQAEEKAAEQFRMRLKNKQDEMKLEGDLRRSQRACQQLDVQKNIQVPREAWYWLRLEEETEEDEEEKEQDEDEYKSEDLSVLEKLQILTSYLREEHLYCIWCGTAYEDKEDLSSNCPGPTSADHD

SEQ ID NO: 6074 - protein, 101 aa, Homo sapiens
MEMVKREKDFCFQILCFLRLGAEFSCPWRSSSSGPLAGPHPLQSGQIPCSQGKWPMPAVLVCNIGPACWNLTLFLPDTQQNKPQGRDQCLQPESRRKRSDR

SEQ ID NO: 6075 - protein, 56 aa, Homo sapiens
MKGDQSERRWQWTRKLGCRCYCSPLGSGESFPCQARGVRIIFLFWKLKSAPRVGDY

SEQ ID NO: 6076 - protein, 84 aa, Homo sapiens [sequence omitted]

SEQ ID NO: 6077 - protein, 83 aa, Homo sapiens [sequence omitted]

SEQ ID NO: 6078 - protein, 105 aa, Homo sapiens
MKNENADKLLKSEKQMKNSEKKSKQEKEKSKKKKGGKTEQDGYQKPTNKHFTQSPKKSVADLLGSFEGKRRLLLITAPKAENNMYVQQRDEYLESFCRWLPGKSL

SEQ ID NO: 6079 - protein, 115 aa, Homo sapiens [sequence omitted]

SEQ ID NO: 6080 - protein, 59 aa, Homo sapiens
MKVNRETKRLYVGGLSRTFLRQTYKISSADLEKFRMWRSSHGKMTKETHRKFLHISTSV

SEQ ID NO: 6081 - protein, 61 aa, Homo sapiens
MKTGPFAEHSNQLWNISAVPSWSKVNQGLIRMYKAECLEKFPVIQHFKFGSLLPIHPVTSG

SEQ ID NO: 6082 - protein, 52 aa, Homo sapiens
MSCLCHRRSFRILELNCLNSFCGISKTTWTLSLYPFPVWLPRVLWPRVKCAR

SEQ ID NO: 6083 - protein, 51 aa, Homo sapiens
MLKRKNKALLGTWNQSAVMLGLHVVCFVGTTGPGMGLHCCDFLLPGDLGLS

SEQ ID NO: 6084 - protein, 70 aa, Homo sapiens
  UNSURE 68: Xaa = Ala,Thr
  UNSURE 69: Xaa = Gly,Arg
  UNSURE 18: Xaa = Lys,Arg
MITETAAELRSLQCLLLXRPPKLGDARSRRGPGKTPRSGRWCSASTSCRLSARRASADWRKATASTCXXP

SEQ ID NO: 6085 - protein, 80 aa, Homo sapiens
MATPTQTPTKAPEEPDPFYYDYNTVQTVGMTLATILFLLGILIVISKKVKCRKADSRSESPTCKSCKSELPSSAPGGGGV

SEQ ID NO: 6086 - protein, 66 aa, Homo sapiens
MGWRAGPRGTKGRPHSGAVPRGGREGALCAPQEEEALSPGIRHPFTCIPTQMQAHQGPLSVPFPTP

SEQ ID NO: 6087 - protein, 81 aa, Homo sapiens [sequence omitted]

SEQ ID NO: 6088 - protein, 51 aa, Homo sapiens
MVSPIGFWRRPSPVNLGLLSRRGDLPSFWWLGNTKIHLKVLTVSCVKWTKF

SEQ ID NO: 6089 - protein, 61 aa, Homo sapiens
  UNSURE 29: Xaa =  * ,Glu
MVKIKDCRSKRDSGHRETPPQSVVPFPTXAKWTGSLPPGKVQISVHYAMGWLLSCTSQTSP

SEQ ID NO: 6090 - protein, 74 aa, Homo sapiens
MRQGTQGSGSPWGLGAAPGRGEPGQGWCWARSSIFRCYPPLPPLTAQAKSSGRSLHLSTLTFYLVFLLLPAFAL

SEQ ID NO: 6091 - protein, 79 aa, Homo sapiens [sequence omitted]

SEQ ID NO: 6092 - protein, 73 aa, Homo sapiens
  UNSURE 28: Xaa = Ala,Gly,Pro,Arg
  UNSURE 33,48: Xaa = Ala,Pro
  UNSURE 26: Xaa = Arg,Ser
  UNSURE 15: Xaa = Asp,His
  UNSURE 53: Xaa = Ile,Leu
  UNSURE 21: Xaa = Lys,Thr
  UNSURE 18,31: Xaa = Pro,Arg
MAESPPTFPTPYQFXHGXFAXFYPEXRXASXSXLRSWAESMGKRIKRXDCRQXTSDLDTSPPPAGASVSPSVT

SEQ ID NO: 6093 - protein, 114 aa, Homo sapiens
MDIVAHCEKAMAESVKKHQFSTSESYLPATLILNSISFNTDGSIQYKEKLYFSASEALDAYIDDFHLNYEPPDIDTKVNLDQSPLEFLAKSNSGVHGIAPGQSGMEKIIQWYAA

SEQ ID NO: 6094 - protein, 62 aa, Homo sapiens
MRGAPVGLSGQQAVCGEAEPVAPGEQKIHVLEIDAASCRLLTPHSLVLGHCFQNPGLWTPLE

SEQ ID NO: 6095 - protein, 54 aa, Homo sapiens
MGQLQNIAKKENCVCSVIVSFPAHRSADPFVSQMLFGSWCAAVSIRPSWRPYSH

SEQ ID NO: 6096 - protein, 101 aa, Homo sapiens
  UNSURE 96: Xaa =  * ,Ala,Glu,Gly,Ile,Lys,Leu,Arg,Ser,Thr,Val
MKEHGKRKTHRTPQRSFENWAVWLSHHPFGHQLWSQLLCPRGMHYCPERALVPFWGVILAGWYGFTAVNMAHLGEAQVPRFEQLWKLKAQKALKCXYFEGT

SEQ ID NO: 6097 - protein, 50 aa, Homo sapiens
  UNSURE 41: Xaa = Arg,Ser
MKKESMEKRERKRRKQGREEKERIIESQGEEAERRQKERLXIWGETRHFT

SEQ ID NO: 6098 - protein, 57 aa, Homo sapiens
MLCAHFSDQGPAHLTTSKSAFLSNKKTSTLKHLLGETRSDGSACNSGISGGRGRKIP

SEQ ID NO: 6099 - protein, 59 aa, Homo sapiens
MAEVAIVSAATKTVLTCTTFPSIFPGVPLTLHLRVQQAGFRECSVQKRKNCRESSPSFC

SEQ ID NO: 6100 - protein, 85 aa, Homo sapiens
  UNSURE 40: Xaa = Lys,Met
MEAAVKEEISVEDEAVDKNIFRDCNKIAFYRRQKQWLSKXSTYRALLDSVTTDEDSTRFQIINEASKVRWKYFLQRIICFCIYWA

SEQ ID NO: 6101 - protein, 106 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLVIRT

SEQ ID NO: 6102 - protein, 126 aa, Homo sapiens
  UNSURE 115: Xaa = Ala,Asp,Gly,Val
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNXDSLFLCLSLPC

SEQ ID NO: 6103 - protein, 54 aa, Homo sapiens
MRSDRDHPGQHGETLSLIKVQGLSGCGGVCLWSRLLGGLRRESRLGPEIGGCSE

SEQ ID NO: 6104 - protein, 57 aa, Homo sapiens
MRSVSEQCQIKETFTIKMLPAPQCHSTESLQRQHSPEYGTNIEMDKAHHSSRLTINS

SEQ ID NO: 6105 - protein, 69 aa, Homo sapiens
MTQTKEAIVSASSLPMSIIIVGVGPAMFEAMEELDGDDVRVSSRGRYAERDIVQFVPFRDYVDRSGNRC

SEQ ID NO: 6106 - protein, 87 aa, Homo sapiens
MDIGIQTEMSRKAARWSITSVAQVGVQWCDLGSLQALPPRFTPFSCLSLPSSWNCRHPPPSPANFFVFSVETGFHRVNQDGLGLLTS

SEQ ID NO: 6107 - protein, 71 aa, Homo sapiens
MPDKESNIKFTLNKIYDIDSELLCIFSDFGICILVLSVRLVEFKNLRSMHCTSVLTFFFILSVYIGSIFFL

SEQ ID NO: 6108 - protein, 106 aa, Homo sapiens
  UNSURE 22: Xaa = Ala,Gly
  UNSURE 12: Xaa = Ala,Thr
  UNSURE 55: Xaa = Asp,His
  UNSURE 72: Xaa = Cys,Trp
  UNSURE 11: Xaa = Ile,Met
  UNSURE 17: Xaa = Ser,Thr
MKIPACVAADXXSKEPXLHACXSSSSVLSLLPAKSSWIYFSDGVSLCRPGWSAVXDLGSLQPLPPRFKRFSXLSLLSSWDYSHLNKKMSFCNQEKSPHQPSDLLAP

SEQ ID NO: 6109 - protein, 51 aa, Homo sapiens
  UNSURE 3: Xaa = Ala,Gly
  UNSURE 30: Xaa = Asn,Ser
MVXPPLCLDCGQVTSPLWASVSSLENRGNXTGVVAHTCNPSTLGGQGRWIT

SEQ ID NO: 6110 - protein, 60 aa, Homo sapiens
MSEHQKEQTPDKPSLRTVTLTARVRGFILESEQDQELTNSGHSTIIHNSQKVETIQMSIN

SEQ ID NO: 6111 - protein, 105 aa, Homo sapiens
  UNSURE 87: Xaa = Asp,His
MDTPPLSDSESESDESLVTDRELQDAFSRGLLKPGLNVVLEGAEEGRERREWPEAMFGRIQADLEWVERLDVTLGPVPEIGGSEAPXLRTRTRKLLIQKTTSSER

SEQ ID NO: 6112 - protein, 102 aa, Homo sapiens
  UNSURE 48: Xaa =  * ,Gly
MEMPHLLGSRRKSSYIVLHIWLVIDFVKRYVKICLFFETEAHCVALAXVQWRDIGSLQPLPLGLKQSSCLSLLSSWDYRLLPPHPANFCIFSRDGVSPCWPG

SEQ ID NO: 6113 - protein, 61 aa, Homo sapiens [sequence omitted]

SEQ ID NO: 6114 - protein, 86 aa, Homo sapiens
MPCADSGSQCPLLWRMYLNFLVSLGNKERSKGVFYKALQSCPWAKVLYLDAVEYFPDEMQEILDLMTEKELRVRLPLEELELLLDD

SEQ ID NO: 6115 - protein, 91 aa, Homo sapiens
MFSFFFPPIFLPFTNSFFCFCPGNPFCLQYHFSTYKHKIMGKIKAPCSMQFVWESFGCQRSLGIDGEAEIAWEKEAGKKEIFMGNQLPKAR

SEQ ID NO: 6116 - protein, 71 aa, Homo sapiens
MAGMALARAWKQMSWFYYQYLLVTALYMLEPWERTVFNSMLVSIVGMALYTGYVFMPQHIMAILHYFEIVQ

SEQ ID NO: 6117 - protein, 50 aa, Homo sapiens [sequence omitted]

SEQ ID NO: 6118 - protein, 71 aa, Homo sapiens; identical to SEQ ID NO: 6116

SEQ ID NO: 6119 - protein, 131 aa, Homo sapiens
MIPPADSLLKYDTPVLVSRNTEKRSPKARLLKVSPQQPGPSGSAPQPPKTKLPSTPCVPDPTKQAEEILNAILPPREWVEDTQLWIQQVSSTPSTRMDVVHLQEQLDLKLQQRQARETGICLSAGTLLTVF

SEQ ID NO: 6120 - protein, 56 aa, Homo sapiens
MPGQRVQLTFTILGIESQNNTFRPGVVAHAVIPALSKAKASGSSEVRRSRPAWPTW

SEQ ID NO: 6121 - protein, 58 aa, Homo sapiens
MICLLKIPQIVQVQCSLLSSQHFGRSRRMDHEVRHSRPAWPTWRNPVSTKNTKISQAC

SEQ ID NO: 6122 - protein, 51 aa, Homo sapiens [sequence omitted]

SEQ ID NO: 6123 - protein, 54 aa, Homo sapiens
MVTEQHCPVEIESKELGEVAHACNPSILGGRGGWITSGQEFETSLANIAKLRLY

SEQ ID NO: 6124 - protein, 53 aa, Homo sapiens
MCKKMYSFFWVCFGVWKGRVIFYFLFQFLCIDFHNSSKAGTAGLGVGRAVFGM

SEQ ID NO: 6125 - protein, 97 aa, Homo sapiens
  UNSURE 15: Xaa = Ala,Glu
  UNSURE 39: Xaa = Ala,Thr
MRRMLFISAPNIRTXPLGRSEKRTAICFSTGAQDSSQRXPFRLQNPGQLLQLGMHSLHLQPELPTTDPAFFCKLHFIKGNDPYCLTISHVKSVLTFS

SEQ ID NO: 6126 - protein, 50 aa, Homo sapiens
MSQATKRKHVVKEVLGEHIVPPTSSRLSGYSGPQGTICMRWRQPKGSASW

SEQ ID NO: 6127 - protein, 89 aa, Homo sapiens [sequence omitted]

SEQ ID NO: 6128 - protein, 71 aa, Homo sapiens
  UNSURE 32: Xaa = His,Pro,Arg
  UNSURE 47: Xaa = Lys,Met,Arg,Thr
MLLELFCKILEYQNTTFFGGTCISMIDYLLWXWFERLDVYGILDCVXPHSSPAALDISHEVGPHSLCSSHG

SEQ ID NO: 6129 - protein, 55 aa, Homo sapiens [sequence omitted]

SEQ ID NO: 6130 - protein, 77 aa, Homo sapiens [sequence omitted]

SEQ ID NO: 6131 - protein, 88 aa, Homo sapiens
  UNSURE 66: Xaa = Asp,Glu,Val
METVQTGESEIYFKGRSHGIMRLVIYMRFATKRVKESSKFPRILNCLESLGLYGNEKVSGEMNLSXLKFGYFLVYKFRYLDVTIQNNT

SEQ ID NO: 6132 - protein, 68 aa, Homo sapiens
MYKSAGDWGKGLGFLSKCYLIHPQSYWLYNGWGQRSHSQCQVFSTVLLITTTVLKLISTRSLSQFHEF

SEQ ID NO: 6133 - protein, 57 aa, Homo sapiens
  UNSURE 42: Xaa = Cys,Ser
  UNSURE 6: Xaa = Leu,Met,Val
MFGCFXYVHIKAQHLFFNLFMTQRPLFTCLPADPLPTITLLXCHIPLSEMVEIMTNK

SEQ ID NO: 6134 - protein, 54 aa, Homo sapiens
MPVIPALWEAKTGGSFEVGSWRPAWPKWQNPASTKIQKLAGRGGGRCNPSYLGG

SEQ ID NO: 6135 - protein, 70 aa, Homo sapiens
MTIVFFYAQIKNQLFTSPVFPSDTPSSRAIYSCLCEVPNTHSSQVLQSLVYFMHCAFKMKFLKGTLNEVE

SEQ ID NO: 6136 - protein, 63 aa, Homo sapiens
  UNSURE 17: Xaa = Phe,Ile
MNHHCQRGACCSFPTQXENEGYDHCVGGVCVAIAGITCGIVERLSVGKKTHSEVTPIYVKLSP

SEQ ID NO: 6137 - protein, 74 aa, Homo sapiens [sequence omitted]

SEQ ID NO: 6138 - protein, 52 aa, Homo sapiens
  UNSURE 11: Xaa = Ala,Gly
MLGSNSPGWPXTDASACNHGNVSGGGHPGEPTAMGSLLVTDGRVSTSQTESA

SEQ ID NO: 6139 - protein, 55 aa, Homo sapiens
MAEPAGTIIPLSGEVCSRASVLQFVAWHFVKSVFISASLVQQSMTKIQQIFIEES

SEQ ID NO: 6140 - protein, 77 aa, Homo sapiens
MVLAFLSKIRLECSGMISAHCNLHLPDSLASASRVAGITGVHHHARLTFLFLTGTGFHHVGQAGLELLTNMEEPRLY

SEQ ID NO: 6141 - protein, 60 aa, Homo sapiens
MQNKTPTKTSKLLQRESAFPCNSQGIEPALSFTEFMRPSHYCSCVERPVRSFLGKFNFIE

SEQ ID NO: 6142 - protein, 51 aa, Homo sapiens
  UNSURE 32: Xaa = Leu,Gln
MIQNSRPSLLQPQDVGDTVETLMLHPVIKAFXVWLHQWDLLYPPFPTSGSP

SEQ ID NO: 6143 - protein, 69 aa, Homo sapiens
  UNSURE 56: Xaa = Asp,Gly,His,Asn,Arg,Ser
MSLEDPFFVVRGEVQKAVNTARGLYQRWCELLQESAAFGREELDWTTNELRNGLRXRSGTSRTWKRPSV

SEQ ID NO: 6144 - protein, 104 aa, Homo sapiens
MGGNHPYQSPPLSPAVPEPDSSCHQNGGGDGSGGSTYAGGEQAKEVASERVETMMRTRKVGLRGADLPLDTSPLDLVPRLRVKLNTPHDLPATIASYEVHYTCR

SEQ ID NO: 6145 - protein, 54 aa, Homo sapiens
MESSFSLMKTSTCGALTARSQGGIPQPGCPQSCPVPSGALLARWQGASRRGWPE

SEQ ID NO: 6146 - protein, 73 aa, Homo sapiens
MLTGSPSVTQAGVQQRNLSSLHPPPPRLRRFSCFSLPTSWDYKRAPPSPADFLYFSRDGVSPNIKVHHLVLKI

SEQ ID NO: 6147 - protein, 104 aa, Homo sapiens
MFLDKIWNNSTDYQTETLVLFSYTNGISVSVLGHLEAFFNQSLSRIYVCLKPWGSTISRRQNQPGEKKSHPIANTAANVLSLRSSQQVSVPLKALNIVPGCCHW

SEQ ID NO: 6148 - protein, 51 aa, Homo sapiens
  UNSURE 19: Xaa = Ala,Cys,Asp,Phe,Gly,His,Ile,Leu,Asn,Pro,Arg,Ser,Thr,Val,Tyr
  UNSURE 16: Xaa = Cys,Ser,Thr
  UNSURE 18: Xaa = His,Gln
MRRGFSVWGPKSCFLXHXXPILPPYKPQTPTSRAYQQVEEIRGKPTDGKTT

SEQ ID NO: 6149 - protein, 62 aa, Homo sapiens [sequence omitted]

SEQ ID NO: 6150 - protein, 54 aa, Homo sapiens
MSFTEKNLKALLKHFDLFVRFLAEYHDDFFPESAYVAASEVHYSTRNPQAVNKC

SEQ ID NO: 6151 - protein, 90 aa, Homo sapiens [sequence omitted]

SEQ ID NO: 6152 - protein, 60 aa, Homo sapiens [sequence omitted]

SEQ ID NO: 6153 - protein, 93 aa, Homo sapiens [sequence omitted]

SEQ ID NO: 6154 - protein, 52 aa, Homo sapiens [sequence omitted]

SEQ ID NO: 6155 - protein, 75 aa, Homo sapiens
MYKSWTLGDPKEKEGVGNILEETKRTQNNTEQASRAINSPLQSPYTDSMKALAISSHWCGYVTSGVELFLSLTLY

SEQ ID NO: 6156 - protein, 58 aa, Homo sapiens
MSPPALFRLWCLNCVLKAKKSDRQMKEREKALQVAGTACAESKRHEENLKCSLPSHVP

SEQ ID NO: 6157 - protein, 116 aa, Homo sapiens
MEDVEAEKLSWDLIYLGRKQVNPEKETAVEGLPGLVVAGYSYWTLAYALRLAGARKLLASQPLPACCPWTSSCPSCSTSTPTSSTRHTSGHGTWWPSPPAPARCPYPLCRGRRVAQ

SEQ ID NO: 6158 - protein, 57 aa, Homo sapiens
MGHVWLEGDNLQNSTDSRCYGPIPYGLIRGRIFFKIWPLSDFGFLRASPNGHRFSDD

SEQ ID NO: 6159 - protein, 69 aa, Homo sapiens
  UNSURE 29: Xaa = Ala,Pro
  UNSURE 32: Xaa = Cys,Gly,Arg,Ser
MDMEGQNQDSTVPLCGGPRLPLRPAHHRXPGXHECSAPGPAPARHATRWGGPGQDVHSIYWGRREGGDT

SEQ ID NO: 6160 - protein, 74 aa, Homo sapiens [sequence omitted]

SEQ ID NO: 6161 - protein, 52 aa, Homo sapiens [sequence omitted]

SEQ ID NO: 6162 - protein, 60 aa, Homo sapiens
MLLGNEAFGRQLGLDEVMRVEPRDGISAFIRRDIRLSPVAHACNPSTLGGQGEWIMRSGD

SEQ ID NO: 6163 - protein, 75 aa, Homo sapiens [sequence omitted]

SEQ ID NO: 6164 - protein, 60 aa, Homo sapiens [sequence omitted]

SEQ ID NO: 6165 - protein, 59 aa, Homo sapiens
MDKEVPKGSPREPALNIKKSDKSFKRKKPTENVLIFLINRQLGRHRSDIDLSRWVWMLS

SEQ ID NO: 6166 - protein, 58 aa, Homo sapiens
  UNSURE 7: Xaa = Pro,Ser
MADRGRXRTAGLAEKSPLQTIGEEQTQNPYTELLVLKAHHDIVRFLVQLDDYRQGKNF

SEQ ID NO: 6167 - protein, 54 aa, Homo sapiens
  UNSURE 42: Xaa = Ala,Pro
  UNSURE 29: Xaa = Cys,Trp
MESVAQVGVQWYHLGLLQPPPPRFKRLSXLSLRSSLDYRHLXPHPADFVFLVEM

SEQ ID NO: 6168 - protein, 89 aa, Homo sapiens
MGLRRLMRCCCCCIAKHADDGDKIDFGGGNVHVVTSKEDWDQRIAEANKDGKTVVANFSASWCGPCVSSHLSTPKCRRVPSAHVPDDRC

SEQ ID NO: 6169 - protein, 50 aa, Homo sapiens [sequence omitted]

SEQ ID NO: 6170 - protein, 61 aa, Homo sapiens
MRQMRIGNIMWLPRAPWQGRGRGDLSPGSYSSADLSRHFPAAQCELYPVQSHEVLEHMDVL

SEQ ID NO: 6171 - protein, 103 aa, Homo sapiens
MKKRNSEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIQEI

SEQ ID NO: 6172 - protein, 56 aa, Homo sapiens
  UNSURE 33: Xaa = Gly,Arg
MRQRARSLHSLLIQRAPAGLVLKRVGSLWRAIXRLLERRPADGFGLAHRSGSGFVS

SEQ ID NO: 6173 - protein, 50 aa, Homo sapiens
  UNSURE 21: Xaa = Asp,Glu
MWWLMPVVPATWEAEAGGSRXLGGRGCSELRPHHCTPAWATESDSVSKNK

SEQ ID NO: 6174 - protein, 62 aa, Homo sapiens
  UNSURE 50: Xaa = His,Gln
MTPLCPRPALCYHFLTSLLRSAMQNARGARQRAEAAVLSGPGPPLGRAAXTGFPGRCPALAA

SEQ ID NO: 6175 - protein, 73 aa, Homo sapiens
  UNSURE 37: Xaa =  * ,Cys,Gly,Arg,Ser,Trp
  UNSURE 36: Xaa = Met,Arg,Thr
MATVIHNPLKALGDQFYKEAIEHCRSYNSRLCAERXXRLPFLDSQTGVAQNNCYIWMEKRHRGPGLAPGQLYT

SEQ ID NO: 6176 - protein, 84 aa, Homo sapiens [sequence omitted]

SEQ ID NO: 6177 - protein, 80 aa, Homo sapiens
  UNSURE 42: Xaa =  * ,Lys
MFIVALFTIAKTWNQAKCPSMIDWIKKMWHIYTMEYYAAIKXDEFMSFVGTWMKLETIILSKLSQGQKTKHRMFSLIGRN

SEQ ID NO: 6178 - protein, 56 aa, Homo sapiens
  UNSURE 26: Xaa = Ser,Thr
MPPRLDNFCIFSRDGVSPCWSSWSPXPDLKSSARVGLRKCWDYRPEPPHSTPNHPF

SEQ ID NO: 6179 - protein, 103 aa, Homo sapiens
  UNSURE 87: Xaa = Asn,Thr
MPSETLWEIAKAEVEKRGINGSEGDGAEIAEKSVFFIGSKNGGKTTIILRCLDRDGTTKTNLSFGIYIWKKSKRAQHTKRYRSLLGXRWRNLFIGLNQHTHHR

SEQ ID NO: 6180 - protein, 67 aa, Homo sapiens
MWGQKRARPKSRQHRFLGSCEGIMRREELSSQVEDSTLHAWIRYSLVLDAELLAHCSTTRDVRMPPS

SEQ ID NO: 6181 - protein, 51 aa, Homo sapiens [sequence omitted]

SEQ ID NO: 6182 - protein, 80 aa, Homo sapiens
MCKREKNSGEGWAGPRERDRKTDTNVRHRVGSASLAVRKTGPWRGLGGSPLAGVPRCLSQCYLQAGQLPLRSGKLRPSAD

SEQ ID NO: 6183 - protein, 54 aa, Homo sapiens
MILTRGRWVGASILVPTCQNRCQVAPHHSTSLVCTMDTALSELPWLYVKHSIVF

SEQ ID NO: 6184 - protein, 55 aa, Homo sapiens
MRLCNQKVLPFLIFNFLETESCFVTQAGVQWYDHSLLQFFSPGFKVILLLQPPSS

SEQ ID NO: 6185 - protein, 57 aa, Homo sapiens
  UNSURE 27: Xaa =  * ,Phe,Ile,Lys,Leu,Asn,Tyr
MILNNTKNSINSLITVKTPDYYYAWMXEVDSLLTEQILYDIVRVDFILVAKVSHWII

SEQ ID NO: 6186 - protein, 60 aa, Homo sapiens
  UNSURE 42: Xaa = Cys,Phe,Tyr
  UNSURE 41: Xaa = Ile,Met
MVLPFSMLTLFEPLTCRWVVSFLGFYFAILYIYTYYIYIYXXGLVLYSFLFESLSTKAAL

SEQ ID NO: 6187 - protein, 70 aa, Homo sapiens
MNNLKFTQECVFFLHYKMWYWVLGNYFKLHDHLKKIALRKKEMISSNFLEPLHCQMGIYFYCLIQVSSKA

SEQ ID NO: 6188 - protein, 54 aa, Homo sapiens
  UNSURE 47: Xaa = Phe,Leu
MAGLSNSYFLILLIHIFKLKKSLYIQSSSVDFLLFADKEGILLNIFXLWSIKCH

SEQ ID NO: 6189 - protein, 68 aa, Homo sapiens [sequence omitted]

SEQ ID NO: 6190 - protein, 66 aa, Homo sapiens
  UNSURE 46: Xaa = Ala,Pro
  UNSURE 26: Xaa = Ser,Thr
MAEAGKVPLSLGLTGEKRQSGLCSGXRCIPSNTRDPPGPCLEAGTXPAPHGRFLIPMKNLDILFSP

SEQ ID NO: 6191 - protein, 76 aa, Homo sapiens
MMKTRIKLFLKSCMKIGSLDLSLHPCPDHLALESVHERERKRIASYFKHVFPFGLNIILTEAELSTWKWCIFFYSF

SEQ ID NO: 6192 - protein, 78 aa, Homo sapiens
  UNSURE 57: Xaa = Lys,Asn
MDEVTEAVNNLNISGVGAAGVAGAEGHKKNRIQVSNTKKPLFFYVNLAKSTCSCTTXRAVGPRHGHCDGGDSSRNSEK

SEQ ID NO: 6193 - protein, 87 aa, Homo sapiens [sequence omitted]

SEQ ID NO: 6194 - protein, 50 aa, Homo sapiens
MDINSNKLLFNDLILPSKYLGLLAFCLLFTKKFIYFQRNSYRTCIAIFLI

SEQ ID NO: 6195 - protein, 79 aa, Homo sapiens
  UNSURE 25: Xaa = Ala,Glu
  UNSURE 26: Xaa = Ala,Thr
MASGHAFQPDLVKRIRDSIRMGLSXXTRAQPHPGNQGHPVYAQRQESGSCRQTDHRWKSRGARRCFLEPRDPGSVPGHP

SEQ ID NO: 6196 - protein, 110 aa, Homo sapiens
MENGRFAKYKYFTHVMINKTDMLMITRRGVLFVTKGTFGQLTCEWQYSFDEFTKEPFIVHGRRLRIEAKERVKSVFHAREFGKIINFKTPEDARWILTKLQEAREPSPSL

SEQ ID NO: 6197 - protein, 52 aa, Homo sapiens
MISAMFSNRVRKQTALREKAGTQNQINSKLKFSHFDKKRNCMCFSASCRCMS

SEQ ID NO: 6198 - protein, 82 aa, Homo sapiens
MCMFIAARFTIAKSWNQPKCPSINEWVKKLWYIHTMEYYAAIKRNELTAFAVTWMRLETIILSEVTQEWKTKHRMFSLICGS

SEQ ID NO: 6199 - protein, 50 aa, Homo sapiens; identical to SEQ ID NO: 6173
  UNSURE 21: Xaa = Asp,Glu

SEQ ID NO: 6200 - protein, 50 aa, Homo sapiens [sequence omitted]

SEQ ID NO: 6201 - protein, 56 aa, Homo sapiens
MPFGRAWWLTPIIPALWEAEAGGSLSQEIETILANMVKPVSTKKYKKSARCGGGRL

SEQ ID NO: 6202 - protein, 62 aa, Homo sapiens
MVTRWLYELAILSSQSETGHVKTTKHRIQCRSLGPVVSVDLQTEFNHMGNILINHTYAIKSS

SEQ ID NO: 6203 - protein, 54 aa, Homo sapiens
MESVAQVGVQWYHLGLLQPPPPRFKRLSCLSLRSSLDYRHLPPHPADFVFLVEM

SEQ ID NO: 6204 - protein, 61 aa, Homo sapiens
MIRTYFGKRTSFLGNGTGKIGYETEPLFHTIYKFCTFSLNYLNHEYCLIYCLYDQNIQIYI

SEQ ID NO: 6205 - protein, 61 aa, Homo sapiens
MRRDVIGCTQEMDFILWPRNDIEKIVCLLFSRWKESDEPFRPVQANLSFIMVTMKNSFCMY

SEQ ID NO: 6206 - protein, 56 aa, Homo sapiens
MDEAGSHHSRQTDTGTENQTPHVLTRKWELNNENTWTQGGKDHTLGPFRGWGAGGR

SEQ ID NO: 6207 - protein, 59 aa, Homo sapiens
MIDWIKKGWRIYTMEYFAAIKKDELMSIAGTWMKLEAIVLGKLSQDQRTICMFSLIGGR

SEQ ID NO: 6208 - protein, 69 aa, Homo sapiens
MAPGCARGLSRRGAGRGNAATLSLVSRLRRPVSEVSGAVNKGSGLASGCVPTFGNGELRRFCLHHRLCQ

SEQ ID NO: 6209 - protein, 56 aa, Homo sapiens; identical to SEQ ID NO: 6201

SEQ ID NO: 6210 - protein, 64 aa, Homo sapiens
MHVTHIISFNPRQQPSEGVSLLSTFYSRKLGLREVMCPRTHSWQVGALRFQCGARKLTLCLNFF

SEQ ID NO: 6211 - protein, 116 aa, Homo sapiens
MRLTPRALCSAAQAAWRENFPLCGRDVARWFPGHMAKGLKKMQSSLKLVDCIIEVHDARIPLSGRNPLFQETLGLKPHLLVLNKMDLADLTEQQKIMQHLEGEGLKKCHFYQLCKG

SEQ ID NO: 6212 - protein, 50 aa, Homo sapiens
MLNRSGESRQTCLVHDLRGKTLMNPNVHYRVLFGRCLLLGKKIPFYSWLA

SEQ ID NO: 6213 - protein, 53 aa, Homo sapiens [sequence omitted]

SEQ ID NO: 6214 - protein, 90 aa, Homo sapiens
  UNSURE 7: Xaa = Ala,Asp
  UNSURE 78: Xaa = Arg,Thr
  UNSURE 13: Xaa = Pro,Thr
MARVIIXNKDGPXQKYLLIFGAFVSVYIQEMFRFAYYKLLKKASEGLKSINPGETAPSMRLLAYDLHKFLLWNKPGVXFIILVLMGTGHS

SEQ ID NO: 6215 - protein, 61 aa, Homo sapiens
MGNRLTLSNMTNLFNEMKVMKMRRKIIVITIKISRHRERKKCTLGNMGNNGGRKEEEENSN

SEQ ID NO: 6216 - protein, 54 aa, Homo sapiens
MIQFQVIMPFIGTDRAWGRAWSFQFTSKARMQQTNRGFPVIGSLHRGLRDPSPL

SEQ ID NO: 6217 - protein, 70 aa, Homo sapiens
  UNSURE 55: Xaa = Ile,Lys
MNRINNELCEECSMNPNQTQTPVSLRNLPLCYYSLWIYPVVLDVTRANPCIYRLXCCFQNLLKLSLDEQD

SEQ ID NO: 6218 - protein, 95 aa, Homo sapiens [sequence omitted]

SEQ ID NO: 6219 - protein, 51 aa, Homo sapiens [sequence omitted]

SEQ ID NO: 6220 - protein, 64 aa, Homo sapiens
MAELSDLGVCCQAGYFHTLFSCFALKLRLSIHFPTYIFTLYLRTQSSPLKLMTQAANNHFWVSA

SEQ ID NO: 6221 - protein, 94 aa, Homo sapiens
  UNSURE 86: Xaa = Lys,Arg
  UNSURE 78: Xaa = Pro,Ser
MGSTKGLGLMYPQLSAFCLISQYSWFIHQLWGLRGMALSLFSKIVRLLAVLKCRVENVLSEVNLPPREKKEECLFFFXCQIHHHIXCYTWKVWK

SEQ ID NO: 6222 - protein, 52 aa, Homo sapiens
MEMRICEKDTCTDACRGGHTDAHIAEHHHKNIENIENTSIFQTSMEIYVGFT

SEQ ID NO: 6223 - protein, 111 aa, Homo sapiens
MTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERYEESTFQGY

SEQ ID NO: 6224 - protein, 53 aa, Homo sapiens
  UNSURE 21: Xaa = His,Gln
MLCFEQVDTSSKKTFTRCWWXVLGLLSLPNHKPRVKYITAFPAPAAIKIVFGI

SEQ ID NO: 6225 - protein, 109 aa, Homo sapiens
  UNSURE 102: Xaa = Asp,His
MINEVASEKPKEPNVGGATSLQHTSKLLQWLFFPSPWKGTKSQPLEGLVDCALLSLQRTSVPVTPPTHLATVALTCQEPGEDEGIRGSLPPWLPGGSKWCLXLGALHSG

SEQ ID NO: 6226 - protein, 79 aa, Homo sapiens
MRRATAIPGLSRGLPSQFRARPSTTGTESALPRSNQHLWLHDRSMSMSRRTSCGNRCQVISGCAPAPEAADRPGEQAEG

SEQ ID NO: 6227 - protein, 56 aa, Homo sapiens
  UNSURE 32: Xaa = Ala,Gly
  UNSURE 33: Xaa = Glu,Gln
  UNSURE 20: Xaa = Pro,Arg
MVRYRVRSLSETLATRVYRXTVAWARASDTTXXEEQVAEPGSTSKVYERTHGQVSL

SEQ ID NO: 6228 - protein, 63 aa, Homo sapiens
  UNSURE 2: Xaa = Ala,Glu,Gly
  UNSURE 7: Xaa = Ala,Thr
  UNSURE 53: Xaa = His,Gln
  UNSURE 47: Xaa = Ile,Met
  UNSURE 40: Xaa = Leu,Trp
MXGPQAXLVSLTNKQTNSLVSLVTSCVYKEARNTGFLDDXGFNFVFXAPDKIXLSDGPSIMLF

SEQ ID NO: 6229 - protein, 106 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQGL

SEQ ID NO: 6230 - protein, 61 aa, Homo sapiens
MSPKPRASGPPAKATEAGKRKSSSQPSPSDPKKKTTKVAKKGKAVRRGRRGRKGLRQRWRP

SEQ ID NO: 6231 - protein, 58 aa, Homo sapiens
MRLFLRYIRCFCRFNFPYLYQKSRLGPVRWFTPIIPTLWEAEVGGSLEARSLRPAWPT

SEQ ID NO: 6232 - protein, 125 aa, Homo sapiens
  UNSURE 125: Xaa = Glu,Lys
MAMQAAKRANIRLPPEVNRILYIRNLPYKITAEEMYDIFGKYGPIRQIRVGNTPETRGTAYVVYEDIFDAKNACDHLSGFNVCNRYLVVLYYNANRAFQKMDTKKKEEQLKLLKEKYGINTDPPX

SEQ ID NO: 6233 - protein, 82 aa, Homo sapiens
MIVRLPQPRGTKQGTFLKKNKNLLYHPGWNAVVQSYIRHCSLEILDSSDPPTSASRVAGTTRAHHHCWLRTGHLNIHSSKMS

SEQ ID NO: 6234 - protein, 64 aa, Homo sapiens
MGMTRTLDCFQSEWYELIQKGVTELRTVGNVPDVYTQIMLLENENKNLKKDLKHYKQAAEYVIF

SEQ ID NO: 6235 - protein, 82 aa, Homo sapiens; identical to SEQ ID NO: 6233

SEQ ID NO: 6236 - protein, 81 aa, Homo sapiens
  UNSURE 68: Xaa =  * ,Lys
MRQSVCEHKQSQPELGSLHTPGDSGQFGGYAKEADYVAQATRLRAALEGTATYRGDIYFCTGYDPPMXPYGRRNEIWLLKT

SEQ ID NO: 6237 - protein, 70 aa, Homo sapiens
MVPSMRNRPSPDTRSVGALILDFLASKTLQGLDLDMDQISLATMMALAPSPDETILQNKPVEQVTPPDNS

SEQ ID NO: 6238 - protein, 70 aa, Homo sapiens
  UNSURE 31: Xaa = Ala,Glu,Gly,Leu,Pro,Gln,Arg,Val
MGDLVLTVLIALAVYFLGRLVPRGRGAAEAXPGNSVSLRPSRLIRSSRVRGRMSTATSTHRGRITNEPES

SEQ ID NO: 6239 - protein, 129 aa, Homo sapiens
MDYKTYLDFVLALENRKEPAALQYIFKLLDIENKGYLNVFSLNYFFRAIQELMKIHGQDPVSFQDVKDEIFDMVKPKDPLKISLQDLINSNQGDTVTTILIDLNGFWTYENREALVANDSENSADLDDT

SEQ ID NO: 6240 - protein, 119 aa, Homo sapiens
  UNSURE 89: Xaa = Ile,Lys,Met,Asn,Arg,Ser,Thr
MDYKTYLDFVLALENRKEPAALQYIFKLLDIENKGYLNVFSLNYFFRAIQELMKIHGQDPVSFVKPKDPLKISLQDLINSNQGDTVTTXLIDLNGFWTYENREALVANDSENSADLDDT

SEQ ID NO: 6241 - protein, 89 aa, Homo sapiens
MATSGDCPISESQGEEPAECSEAGLLQEGVQPEEFVAIADYAATDETQLSFLRGEKILILRQTTADWWWGERAGLLWVHSGKPCGEARG

SEQ ID NO: 6242 - protein, 82 aa, Homo sapiens
  UNSURE 48: Xaa = Asn,Ser
  UNSURE 51: Xaa = His,Arg
  UNSURE 64: Xaa = Leu,Val
MDCCTENACSKPDDDILDIPLDDPGANAAAAKIQASFRGHMARKKIKXGEXGRKGPGPGGPGGXGWPGEARAAAQRRLGQKN

SEQ ID NO: 6243 - protein, 62 aa, Homo sapiens [sequence omitted]

SEQ ID NO: 6244 - protein, 77 aa, Homo sapiens
MPDEINIDELLELESEEERSRKIQGLLKSCGKPVEDFIQELLAKLQGLHRQPGLRQPSPSHDGSLSPLQDRARTAHP

SEQ ID NO: 6245 - protein, 60 aa, Homo sapiens
MFKNGIGHRYGIYSLAGKRRCVPKELAQDRPGAVAHACNSSTLGGQGGRITRSGDPDHPG

SEQ ID NO: 6246 - protein, 54 aa, Homo sapiens
MARISIRVSQTMGEVRKFPRVYVFCVQKNSTKYYQGLGQPYDNGRLAHQQSQGI

SEQ ID NO: 6247 - protein, 91 aa, Homo sapiens
MSTKQITCRYFMHGVCREGSQCLFSHDLANSKPSTICKYYQKGYCAYGTRCRYDHTRPSAAAGGAVGTWPTVCPPQLSTVLTLLPRSLHPL

SEQ ID NO: 6248 - protein, 77 aa, Homo sapiens
MEWTSQALLTVDIVDSGNLAEITVFGRPRVQNRVKSMLLCLAWFHREHRARAEKMKHLEKNLKAHASDPHSPQDPVA

SEQ ID NO: 6249 - protein, 53 aa, Homo sapiens
  UNSURE 13: Xaa = Asn,Thr
MRQFVRASAGECXNQEALLLDSFYWTQLHKSLKGQINLYRGWKDEFLPDTLRP

SEQ ID NO: 6250 - protein, 112 aa, Homo sapiens
MPKRKKQNHHQPPTQQQPPLPEREETGDEEDGSPIGPPSLLGPPPMANGKPGDPKSAPNWIPPTCPSSVEWINKLFVYACNGDYTATKMNELLLQATWMNLTNMMLSERSQT

SEQ ID NO: 6251 - protein, 84 aa, Homo sapiens
MLARRQRDPLQALRRRNQELKQQVDSLLSESQLKEALEPNKRQHIYQRCIQLKQAIDENKNALQKLSKENITEYASFLPFFFLF

SEQ ID NO: 6252 - protein, 125 aa, Homo sapiens
  UNSURE 87: Xaa = Ala,Val
  UNSURE 15: Xaa = Asp,Glu
  UNSURE 19: Xaa = Gly,Arg,Trp
  UNSURE 63: Xaa = Lys,Asn
MGYIMGKAEGSVARXEWHXHVTALSVAPEFRRLGLAAKLMELLEEISERKGGFFVDLFVRVSXQVAVNMYKQLGYSVYRTVIEYYSXSNGEPDEDAYDMRKALSRDTEKKSIIPLPRPVRPEDIE

SEQ ID NO: 6253 - protein, 60 aa, Homo sapiens
MAPVKKLVVKGGKKKKQVLKFTLDCTHPVEDGIMDAANFEQFLQERIKVNGKAGNLVEGW

SEQ ID NO: 6254 - protein, 53 aa, Homo sapiens
MNKSRLSAMQGEKVLSINTAATSLLAQAPALEFMSSSKDGKKQSSNQLGKDLT

SEQ ID NO: 6255 - protein, 98 aa, Homo sapiens
  UNSURE 89: Xaa = Ile,Leu
MEMINENAKSRGRLIDFKEIQYGYRRVNPMHGVEYILDLLLLYKRHKGRKLTVPVRRHAYLQQLFSKPFFRETEELDVNSLVESINSEXSHSPLYLIL

SEQ ID NO: 6256 - protein, 58 aa, Homo sapiens
  UNSURE 51: Xaa = Ile,Arg
MDEELLFRDEQRKWFLEMESTGEVAVNIVKMPIKDLGITETWLIKQCQGVXELTSILK

SEQ ID NO: 6257 - protein, 72 aa, Homo sapiens [sequence omitted]

SEQ ID NO: 6258 - protein, 65 aa, Homo sapiens
  UNSURE 61: Xaa =  * ,Gly,Arg
MSCPGIPGRRNSLSKLQKGRGGQALLKNCWQFSETGIYSCGQRMWRLRSSKICRWQAGDPXDLMV

SEQ ID NO: 6259 - protein, 116 aa, Homo sapiens
MVNQEMLNMSKKTVSCFVNFTRLQQITNIQAEIYQKNLEIELLKLEKDTADVVHPFFLAQKCHTLQSMNNHLEAVLKEKRSLRQRLLKPMCQENLPIEAVYHRYMVHLLGVGCDFH

SEQ ID NO: 6260 - protein, 65 aa, Homo sapiens
MTLSFTVLVKKSCSLPPPLKKHNTPFWVTMGYFPTALSSHTIFSNKILMASTFSRNTAPDLCVFA

SEQ ID NO: 6261 - protein, 57 aa, Homo sapiens
MNTGICSVGNTVEILEGKDAGKQGKVVQVIRQRNWVVVGGLNTHYRYIGKTMDYRGT

SEQ ID NO: 6262 - protein, 55 aa, Homo sapiens
MVLLRRNVNTVFETLEITCVGRWGRFPCCGELCGCDGCSCRASVGTLSACNSRQS

SEQ ID NO: 6263 - protein, 51 aa, Homo sapiens
MYSYGLKVYRKKIRPFLQSKCLPGLFKMMYVEAFVNCQMLCKCYYFKHYDV

SEQ ID NO: 6264 - protein, 68 aa, Homo sapiens
  UNSURE 48: Xaa = Cys,Gly,Arg,Ser
  UNSURE 21: Xaa = Glu,Gly
MGMFSHSARERPESGIKVSSXLWGRIQPLPGIPWLVAHHSTVLPSSRXHLSVLCPNLPLFVRTQVLFD

SEQ ID NO: 6265 - protein, 91 aa, Homo sapiens
  UNSURE 74: Xaa = Asp,Tyr
  UNSURE 75: Xaa = Ile,Met
MEPLLRISSSTQSASTTSGSRESLNLGARRDILAGTRRLFSRHPGTRILGGAGEREKVPANPEALLLMASSQRXXEDWVQAIRRVIWAPLA

SEQ ID NO: 6266 - protein, 76 aa, Homo sapiens
  UNSURE 59: Xaa = Ala,Gly
  UNSURE 54: Xaa = Ala,Pro,Ser,Thr
MGDTFSTCSEPGPLAGMLLLPPPPLLLPPLICFRHSLPRLIFNWKSSQQWDIRXPDSTXSSSPPHCPHLNVNLTDE

SEQ ID NO: 6267 - protein, 55 aa, Homo sapiens
MNSQSTLYFNIYKDKEGRIDGPAVTSWADTGSGRETEVELPGKIQKRKRVGNVSA

SEQ ID NO: 6268 - protein, 70 aa, Homo sapiens [sequence omitted]

SEQ ID NO: 6269 - protein, 63 aa, Homo sapiens
MPSRGTRPEDSSVLIPTDNSTPHKEDLSSKIKEQKIVVDELSNLNKNRTEQKCCLRARIYWMN

SEQ ID NO: 6270 - protein, 67 aa, Homo sapiens
MWLLFWERGGRRLRDSPTSSSSLGKAIGRLELAPLWTQKFSFATLGCFIWLQWEDSWKVLNWVTAAF

SEQ ID NO: 6271 - protein, 65 aa, Homo sapiens
  UNSURE 37: Xaa =  * ,Trp
  UNSURE 39: Xaa = Ala,Thr
  UNSURE 35,36: Xaa = Arg,Ser
  UNSURE 61: Xaa = Asn,Thr
  UNSURE 58: Xaa = Asp,Glu,Lys,Asn
  UNSURE 29: Xaa = Asp,Val
  UNSURE 56: Xaa = Cys,Phe,Gly,Val
  UNSURE 47: Xaa = Glu,Lys
  UNSURE 55: Xaa = Gly,Trp
MKLNISFPATGCQKLIEVDDERKLRTFYXEAYGHXXXLXDALGEEWXGLCGPNQXXWXRQXKVSP

SEQ ID NO: 6272 - protein, 82 aa, Homo sapiens
MFTSRTNAKETATLLSERGAHPEMHWFTGNQWCHHRPTPYCDDLLSLGPAGPRQKTPPGHILMKASFLTQDCTSDSLCLISW

SEQ ID NO: 6273 - protein, 60 aa, Homo sapiens
  UNSURE 8: Xaa = Arg,Ser
MNFPESGXLALLSGMSMHLGFKQQFPIILILSCSCDELRDSIGVCCCVPRSCVGGTDLGS

SEQ ID NO: 6274 - protein, 94 aa, Homo sapiens
  UNSURE 82: Xaa = Ala,Pro
MSATAATAPPAAPAGEGGPPAPPPNLTSNRRLQQTQAQVDEVVDIMRVNVDKVLERDQKLSELDDRADALQAGASQFETSAXSSSANTGGKTSR

SEQ ID NO: 6275 - protein, 56 aa, Homo sapiens
MPPRLDNFCIFSRDGVSPCWSSWSPTPDLKSSARVGLRKCWDYRPEPPHSTPNHPF

SEQ ID NO: 6276 - protein, 102 aa, Homo sapiens
  UNSURE 2: Xaa =  * ,Arg
  UNSURE 56: Xaa = Ala,Asp
  UNSURE 43: Xaa = Ala,Met,Thr,Val
  UNSURE 54: Xaa = Cys,Arg
  UNSURE 62: Xaa = Ile,Met,Thr
  UNSURE 59: Xaa = Leu,Pro
  UNSURE 48: Xaa = Leu,Ser
  UNSURE 55: Xaa = Phe,Leu,Pro,Ser
  UNSURE 67: Xaa = Pro,Arg
MXSLPSLCSREPRRRGGSCTSGGSSSVLFGRTPPPSNPVEAVXRRAAXWPPRLXXXPVXGWXEAGPXFLAPVQRGAASRTDDPGNRIDGRVTVAPYPRVSVL

SEQ ID NO: 6277 - protein, 100 aa, Homo sapiens
  UNSURE 23: Xaa = Ala,Gly
  UNSURE 74: Xaa = His,Gln
MELEQREGTMAAVGFEEFSAPPXQELALPPLFGGHILESELETEVEFVSGGLGGSGLRERDDEEEAARGRRRRXRELNRRKYQALGRRCRGDRAGERAGS

SEQ ID NO: 6278 - protein, 64 aa, Homo sapiens
MEKGFPKRNSGKPLTSRKRAEWQGSLPSLLAVMMRLVPRDESFLLSSMCSKTQIKILVLVSTEF

SEQ ID NO: 6279 - protein, 91 aa, Homo sapiens
  UNSURE 83: Xaa = His,Arg
MKPILLQGHERSITQIKYNREGDLLFTVAKDPIVNVWYSVNGERLGTTWAIPELCGVWTLTGTPSMSSLAQLTTAVVSGTVKXLGRGVGEC

SEQ ID NO: 6280 - protein, 52 aa, Homo sapiens
  UNSURE 30: Xaa = Arg,Trp
MAHKQIYYSDKYFDEHYEYRCFYGPRFLLXLPDHINVHSTRRRKRVQHVLSL

SEQ ID NO: 6281 - protein, 52 aa, Homo sapiens
MILSFLRPPQPCRTVTTPLLQNIPCDHAGDSILKAICPINRTWDQALRNFNI

SEQ ID NO: 6282 - protein, 67 aa, Homo sapiens
  UNSURE 50: Xaa = Ala,Gly,Pro,Arg
  UNSURE 62: Xaa = Pro,Arg
MPGQGHQRAWSSSNTSVWEDACCKVDHGLPVASVSRKNTHYLADWEKEPXFPRGSLEKTTPXPLVEA

SEQ ID NO: 6283 - protein, 79 aa, Homo sapiens [sequence omitted]

SEQ ID NO: 6284 - protein, 101 aa, Homo sapiens [sequence omitted]

SEQ ID NO: 6285 - protein, 52 aa, Homo sapiens
MMISLLDQTHNQLHLLQNWAPQLQLSWEAHRLRFHTLSGKVLSILALNHSLK

SEQ ID NO: 6286 - protein, 62 aa, Homo sapiens
MDGAGRHYPQQTNEGTENQTLHILTYKWELSDENTWTHGREQHTVEAVRGRCGRRESIRKNS

SEQ ID NO: 6287 - protein, 142 aa, Homo sapiens
MAAVVAVCGGLGRKKLTHLVTAAVSLTHPGTHTVLWRRGCSQQVSSNEDLPISMENPYKEPLKKCILCGKHVDYKNVQLLSQFVSPFTGCIYGRHITGLCGKKQKEITKAIKRAQIMGFMPVTYKDPAYLKDPKVCNIRYRE

SEQ ID NO: 6288 - protein, 142 aa, Homo sapiens; identical to SEQ ID NO: 6287

SEQ ID NO: 6289 - protein, 142 aa, Homo sapiens; identical to SEQ ID NO: 6287

SEQ ID NO: 6290 - protein, 66 aa, Homo sapiens
MVLIKEFRVVLPCSVQEYQVGQLYSVAEASKNETGGGEGIEVLKNEPYEKDGEKGQYTHKIYHLKR

SEQ ID NO: 6291 - protein, 77 aa, Homo sapiens
MKTNQQDGGDCESLQGSSELKSVRCLGECLAPGSTVYSKKGDINMTIKDMKRCLTPLVIVEMQMKTTIQTLEWFKFE

SEQ ID NO: 6292 - protein, 127 aa, Homo sapiens
  UNSURE 120: Xaa = Glu,Lys
MVQIIKDTNEFKTFLTAAGHKLAVVQFSSKRCGPCKRMFPVFHAMSVKYQNVFFANVDVNNSPELAETCHIKTIPTFQMFKKSQKVTLFSRIKRIICCYRSGFMSNLIFEFCGADAKKLXAKTQELM

SEQ ID NO: 6293 - protein, 92 aa, Homo sapiens
  UNSURE 89: Xaa =  * ,Cys,Asp,Glu,Gly,His,Lys,Asn,Gln,Arg,Ser,Trp,Tyr
  UNSURE 88: Xaa = Asp,Glu
  UNSURE 91: Xaa = Phe,Ile,Leu,Val
  UNSURE 90: Xaa = any one of the twenty amino acids
MEDAAEVASALVVGKTPPSTTVGSHSPPETPVLTRSSAQTSAAGATATTSTSSTVTVTAPAPAATGSPVKKQRPLLPKRLPRPCSGRXXXXK

SEQ ID NO: 6294 - protein, 103 aa, Homo sapiens
MEEKQPQKTKEPSKEDEPQQKEMPTHLSLGAESKAEAKTPVLVETQTVDNANEKSEKPPENQKKLSDKDTVATKIQAWWRGTWCVGHCCTQPSVPASFSAGGG

SEQ ID NO: 6295 - protein, 50 aa, Homo sapiens
MPGIGFQACLSFSSLPGIAMRWEGEPSSPAEIPGGLATGRGVLDSSGRHH

SEQ ID NO: 6296 - protein, 140 aa, Homo sapiens
MAVCIAVIAKENYPLYIRSTPTENELKFHYMVHTSLDVVDEKISAMGKALVDQRELYLGLLYPTEDYKVYGYVTNSKVKFVMVVDSSNTALRDNEIRSMFRKLHNSYTDVMCNPFYNPGDRIQSRAFDNMVTSMMIQCAE

SEQ ID NO: 6297 - protein, 89 aa, Homo sapiens
MLERTTCSPAVSRHAADLLVAQEAKMRVFPENIDIGSTLTLDASGPLPEGTHRAPHNRPNKSCWMDSISPYSSKGTCTTPPTTSSAGLR

SEQ ID NO: 6298 - protein, 68 aa, Homo sapiens
MSKLGKFFKGGGSSKSEPLPVPRRPWSDFGRLRRCWARNKSTWKIESREKSPWPRSTARRISELHYRH

SEQ ID NO: 6299 - protein, 55 aa, Homo sapiens [sequence omitted]

SEQ ID NO: 6300 - protein, 87 aa, Homo sapiens [sequence omitted]

SEQ ID NO: 6301 - protein, 58 aa, Homo sapiens
MSPCVSHPGGVKVGARRGGVAAPQHREGARTTPEEGTAPPMSTAGNLCFHFKWDTVFF

SEQ ID NO: 6302 - protein, 70 aa, Homo sapiens
  UNSURE 67: Xaa = Gly,Val
  UNSURE 68: Xaa = His,Gln
MDKSASRVPGITGMGHHPPADFVLLVETGFLNFGQAGLELPTLGDLPPSAYQSAGIIDGSHLAWLTXXVL

SEQ ID NO: 6303 - protein, 76 aa, Homo sapiens
  UNSURE 55: Xaa = Arg,Ser,Thr
MAGGKAGKDSGKAKTKAVSRSQRAGLQFPVGRIHRHLKSRTTSHGRVGATAAVYXQPSWSTSPQRYLNWQEMHQKT

SEQ ID NO: 6304 - protein, 74 aa, Homo sapiens [sequence omitted]

SEQ ID NO: 6305 - protein, 56 aa, Homo sapiens
MRSHVHSDCIPHPCPALRGRRDSPPLTISGVGLDYWLKNYTLFDGMQFNSVDQSYV

SEQ ID NO: 6306 - protein, 64 aa, Homo sapiens [sequence omitted]

SEQ ID NO: 6307 - protein, 69 aa, Homo sapiens
MSRYLRPPNTSLFVRNVADDTRSEDLRREFGRYGPIVDVYVPLDFYTRRPRGFAYVQYPFFRWLISEGC

SEQ ID NO: 6308 - protein, 61 aa, Homo sapiens
MEEPMDTSEPLSALPFTGQQSFEPSGKFGQYPSMQMNHIQALGSGGHRTAQSVFDPTLPSH

SEQ ID NO: 6309 - protein, 91 aa, Homo sapiens
MILLSSGALAFEDIYIEQRTIKTMLEYADKVFTYIFILEMLLKWVAYGFQTYFTNAWCWLDFLIVDARCHLQPFCLSPLTTNQSASSSPFY

SEQ ID NO: 6310 - protein, 65 aa, Homo sapiens
MNVPTCQEQTLPQPCSHRNELVQKEHNATWASLKFPKSKISQVAGTRLLLEDRFYHPKQHSYISI

SEQ ID NO: 6311 - protein, 55 aa, Homo sapiens
  UNSURE 29: Xaa = Arg,Thr
MLAMLVLELQNSSDPSASVFQTAGITGVXPRPAFGEVLFTVHHPLPPHLLLTSYL

SEQ ID NO: 6312 - protein, 50 aa, Homo sapiens [sequence omitted]

SEQ ID NO: 6313 - protein, 64 aa, Homo sapiens
MKWTQHVKTILSRSLAVKENRECAKEHTDTEQTGHLCNHMEVCLILKLKKLSWKTERPSPDDIV

SEQ ID NO: 6314 - protein, 63 aa, Homo sapiens
MKCGPVAPHCRFSSFLPPFRKCAKEHTDTEQTGHLCNHMEVCLILKLKKLSWKTERPSPDDIV

SEQ ID NO: 6315 - protein, 57 aa, Homo sapiens
  UNSURE 56: Xaa = Cys,Phe
MHPSSSVVIYRRRMEKDVPMLPQSQRRKMGCPSVLNMSVECPGTSCSNEEDQPRAXG

SEQ ID NO: 6316 - protein, 51 aa, Homo sapiens
MLIGFHETPKKRGLYTGWSRVFTFLFLSTCHIHLQGPKTKAARSLCCLIGK

SEQ ID NO: 6317 - protein, 64 aa, Homo sapiens; identical to SEQ ID NO: 6313

SEQ ID NO: 6318 - protein, 64 aa, Homo sapiens; identical to SEQ ID NO: 6313

SEQ ID NO: 6319 - protein, 64 aa, Homo sapiens; identical to SEQ ID NO: 6313

SEQ ID NO: 6320 - protein, 64 aa, Homo sapiens; identical to SEQ ID NO: 6313

SEQ ID NO: 6321 - protein, 163 aa, Homo sapiens
MFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRLGSIAAYGFNKKFSS

SEQ ID NO: 6322 - protein, 55 aa, Homo sapiens
MMAFSLFKSSVFQLQLKLTIGSYQKWKKSCALSGILEESVNNSKVVLTQYLICSF

SEQ ID NO: 6323 - protein, 53 aa, Homo sapiens
MLLNALWHNRIKTFQMPCRFNKTQDMSKWLPQNFHLILSFAVTHIDLHFLFSF

SEQ ID NO: 6324 - protein, 50 aa, Homo sapiens [sequence omitted]

SEQ ID NO: 6325 - protein, 113 aa, Homo sapiens
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQ

SEQ ID NO: 6326 - protein, 112 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIAMGMAQALGLTRHSQPSPAVKSSPWR

SEQ ID NO: 6327 - protein, 52 aa, Homo sapiens
MQCPGTYMHCGDDEDCFTGHGVAPGTGPVINKGCLRATSCGLEEPVSYRGVT

SEQ ID NO: 6328 - protein, 82 aa, Homo sapiens
MSQAGAQEAPIKKKRPPVKEEDLKGARGNLTKNQEIKSKTYQVMRECEQAGSAAPSVFSRTRTGTETVFEKPKAGPTKSVFG

SEQ ID NO: 6329 - protein, 54 aa, Homo sapiens
  UNSURE 28: Xaa = Ile,Met
  UNSURE 18: Xaa = Leu,Pro
  UNSURE 22: Xaa = Phe,Leu
  UNSURE 30: Xaa = Pro,Ser
MQSPCETRCCSQRRKHCXPVVXNEEMEXVXGGNQASWKTSNYAKWSDFTIEILC

SEQ ID NO: 6330 - protein, 98 aa, Homo sapiens
MSSDDKSKSNDPKTEPKNCDPKCEQKCESKCQPSCLKKLLQRCFEKCPWEKCPAPPKCLPCPSQSPSSCPPQPCTKPCPPKCPSSCPHACPPPCPPPE

SEQ ID NO: 6331 - protein, 52 aa, Homo sapiens
MDWEILGTDGQKPLQVSEVHISNISARMRLILLGFHQIHRRMNLGLNRQQKI

SEQ ID NO: 6332 - protein, 55 aa, Homo sapiens
MRLWMKRALNSSFHESKRRAIKIPFPIDEEGIQYMLLKQLSSNLEPKKVKSLPHT

SEQ ID NO: 6333 - protein, 53 aa, Homo sapiens
MFISIKYDLGWSTLPICPGLSRSRDLALYPERSIHLLPQQDANATPKIIVASL

SEQ ID NO: 6334 - protein, 81 aa, Homo sapiens
MEPVEPQYQLVNAESTSPFLHCLREVIGEYSRVKGLDCGLHGWFSSVSSSSPQVSTYRMQSSPSSKDLLRKLLRNSVCSSA

SEQ ID NO: 6335 - protein, 63 aa, Homo sapiens [sequence omitted]

SEQ ID NO: 6336 - protein, 50 aa, Homo sapiens
  UNSURE 14: Xaa = Arg,Thr
MESTLRTFKRQSAXEGGWVPESPTGGELPTRAFIQEHPHCNDIGMRSELH

SEQ ID NO: 6337 - protein, 59 aa, Homo sapiens [sequence omitted]

SEQ ID NO: 6338 - protein, 76 aa, Homo sapiens
MESHSVTQAGVQWCNLGSLQAPPPGFTPFSCLSLPSSWDYRRLPPCPANFFFFFWVFLVETGFHRVSQDGLDLLTS

SEQ ID NO: 6339 - protein, 58 aa, Homo sapiens
  UNSURE 40: Xaa =  * ,Gln
METGACRARWCTTLIPAFWEAKAGGSPEVRNLRPAWPTWXNPVSTKNTKLARDGGACL

SEQ ID NO: 6340 - protein, 122 aa, Homo sapiens
MAASTDMAGLEESFRKFAIHGDPKASGQEMNGKNWAKLCKDCKVADGKSVTGTDVDIVFSKVKGKSARVINYEEFKKALEELATKRFKGKSKEEAFDAICQLVAGKEPANVGVTKGKKQGVL

SEQ ID NO: 6341 - protein, 94 aa, Homo sapiens
  UNSURE 45: Xaa = Lys,Thr
MESVKSKIGELEDESLSRACHQQNKIKDLQKEQKTLQVKCQHYKXKRTEQEQTIASLQMEVCRLKKEEEDRIVTQNRVFAYLCKRVPHTVLDRQ

SEQ ID NO: 6342 - protein, 96 aa, Homo sapiens
MLRRRREAIIPAVGTAAAHGAPGGRTGSSAHSAERCRHLTPLETTSALWTAKQKEFTDNVSSAFEQDDFEEAKEILTKMRYFSNIEEKIKLKKIPL

SEQ ID NO: 6343 - protein, 50 aa, Homo sapiens; identical to SEQ ID NO: 6336
  UNSURE 14: Xaa = Arg,Thr

SEQ ID NO: 6344 - protein, 106 aa, Homo sapiens
MFASSEPVPGFQGDTLQLAFIDLRQLLDLFMVWDWSTYLADYGQPASKYLRVNPNTALTLLEKMKDTSKKNNIFAQFRKNDRDKQKLIETVVKQLRSLVNGMSQHM

SEQ ID NO: 6345 - protein, 86 aa, Homo sapiens [sequence omitted]

SEQ ID NO: 6346 - protein, 60 aa, Homo sapiens
MCVVFSAQLLSSNGSKFYFYFCHSEHFMSNDVMQKFLCIFVTEGSFLDLFLFLIKFRFLF

SEQ ID NO: 6347 - protein, 61 aa, Homo sapiens
  UNSURE 46: Xaa = Ala,Pro
  UNSURE 41: Xaa = Glu,Gly
  UNSURE 22: Xaa = Gly,Ser
MQSLKSRGYVKEQFAWRHFLLXTLPMRVIQYLRDYLHLAPXNLCLXNPTPVAGPETGRPAA

SEQ ID NO: 6348 - protein, 75 aa, Homo sapiens
MPPRHSPQSPQEDPDCWPLKLGSRLEQLQAQMNRLESRVSSDLSRILQLLQKPMPQGHAATFWKPLPPMTWPWFL

SEQ ID NO: 6349 - protein, 53 aa, Homo sapiens [sequence omitted]

SEQ ID NO: 6350 - protein, 54 aa, Homo sapiens
MVNNRLLPWKHSVTNFGNSEFPPSLKLTSNPRLQTSKHTCSTFLPVQLSPQVWS

SEQ ID NO: 6351 - protein, 50 aa, Homo sapiens
  UNSURE 7: Xaa = His,Gln
MSPCPRXMSPTCIFPKVKIDLVVKDMFSPCLLPLQPDSVSDFLPQPVRES

SEQ ID NO: 6352 - protein, 77 aa, Homo sapiens
  UNSURE 22: Xaa = Leu,Trp
MSDLGRSLSIFTQCMNSLHNKXSSSLHSVASVAKVKRNKIIPLSVRIDHGILDTVNEIFKNNCFNWLFTFGLALQTC

SEQ ID NO: 6353 - protein, 125 aa, Homo sapiens
MPRYELALILKAMQRPETAATLKRTIEALMDRGAIVRDLENLGERALPYRISAHSQQHNRGGYFLVDFYAPTAAVESMVEHLSRDIDVIRGNIVKHPLTQELKECEGIVPVPLAEKLYSTKKRKK

SEQ ID NO: 6354 - protein, 57 aa, Homo sapiens
MGKQRNLTLFFSFPFCETVFLNHLLNSVFFPSYSFVEPLLSYLRFPQTHISLLFQLY

SEQ ID NO: 6355 - protein, 65 aa, Homo sapiens [sequence omitted]

SEQ ID NO: 6356 - protein, 102 aa, Homo sapiens
MPVCAPVLWRARRLCGMPVCAPVPWRARRLCTRAVVCPSSVPFIAGQGCTHMCKPATDPRFTRSPLAGGVILGVALWLRMTRRPPTSCIWSWETSPRPTPSM

SEQ ID NO: 6357 - protein, 96 aa, Homo sapiens
MDRGAIVRDLENLGERALPYRISAHSQQHNRGGYFLVDFYAPTAAVESMVEHLSRDIDVIRGNIVKHPLTQELKECEGIVPVPLAEKLYSTKKRKK

SEQ ID NO: 6358 - protein, 95 aa, Homo sapiens
MPSSHIVLKEETRMLGLMYAIWMNLNSFGLAIIGILLIACEIILFLTKDETIQWPHVPSNRGSKANLILKELQLLVRSTWWFHRETAQRTCLYLA

SEQ ID NO: 6359 - protein, 52 aa, Homo sapiens
MAWTLQVASKIDFDPLTLSHGGIASTLSKDLARNDSFPLSVIGDSINSLESK

SEQ ID NO: 6360 - protein, 62 aa, Homo sapiens [sequence omitted]

SEQ ID NO: 6361 - protein, 68 aa, Homo sapiens [sequence omitted]

SEQ ID NO: 6362 - protein, 64 aa, Homo sapiens
MWAAGRWGPTFPSSYAGFSADCRPRSRPSSDSCSVPMTGRMRKTWMMRKTWMKMPMIQRPKWRA

SEQ ID NO: 6363 - protein, 141 aa, Homo sapiens
  UNSURE 120: Xaa = Arg,Thr
MWAAGRWGPTFPSSYAGFSADCRPRSRPSSDSCSVPMTGARGQGLEVVRSPSPPLPLSCSNSTRSLLSPLGHQSFQFDEDDGDGEDEEDVDDEEDVDEDAHDSEAKVASLRGMELQGCAXSRLNQKITKKNRNRCAYQKAA

SEQ ID NO: 6364 - protein, 62 aa, Homo sapiens
  UNSURE 47: Xaa = Lys,Gln
MPTAMPRILTGQKGLQVEFWPKFVAFPSLTSLNEYNPETCLGTWSEXKLREPPLLRQGGMAW

SEQ ID NO: 6365 - protein, 163 aa, Homo sapiens
MVGGGGVGGGLLENANPLIYQRSGERPVTAGEEDEQVPDSIDAREIFDLIRSINDPEHPLTLEELNVVEQVRVQVSDPESTVAVAFTPTIPHCSMATLIGLSIKVKLLRSLPQRFKMDVHITPGTHASEHAVNKQLADKERVAAALENTHLLEVVNQCLSARS

SEQ ID NO: 6366 - protein, 77 aa, Homo sapiens
MSWKIIFLLCFLEDWYYFFSNIYQTSLGKPFRTEIFYVNNMVRYSIYLKDLDYSDVHLDSVLIRCISKGICPFYLNY

SEQ ID NO: 6367 - protein, 82 aa, Homo sapiens
  UNSURE 29: Xaa = Gly,Arg
MQRQNFRPPTPPYPGPGGGGWGSGSSFRXTPDGGGPRPPSPRDGVLQGHLHHLDQGVLEKKECLMSWKIISSLQCLKILGLA

SEQ ID NO: 6368 - protein, 78 aa, Homo sapiens
MSLGMPRIASNFQKPGKCVEGSFLQRLWRESDPTNTLILDFWPPELTQLSTKTALLSCHRVAGRGVSILVFPTQQMQE

SEQ ID NO: 6369 - protein, 83 aa, Homo sapiens [sequence omitted]

SEQ ID NO: 6370 - protein, 63 aa, Homo sapiens
MYRQGSCQGLGWRPREDARKFMLCELHRRPAFHVYPFYRTLQNSKMSEQTLGHSWSCSKGYKE

SEQ ID NO: 6371 - protein, 50 aa, Homo sapiens
MVNKPVSSSATTTRYLGFLPPPRDRRGAGCERGSVEPPRPRYGVSLCRPG

SEQ ID NO: 6372 - protein, 87 aa, Homo sapiens
  UNSURE 73: Xaa = Ala,Glu,Gly,Val
MMANHTSISSLFESSCQQFDKLRKRDAFLEQFRKRTCSRTTLMRWTGLGRLFRSSLMSTMRPPSQTTFPGAPXAVISLPTTPSPSRW

SEQ ID NO: 6373 - protein, 90 aa, Homo sapiens
  UNSURE 32: Xaa = Cys,Gly,Arg,Ser
MVLCPVIGKLLHKRVVLASASPRRQEILSNAXLRFEVVPSKFKEKLDKASFATPYGYAMETAKQKALEVPNRLYQARGPCPSALMKIPLL

SEQ ID NO: 6374 - protein, 93 aa, Homo sapiens [sequence omitted]

SEQ ID NO: 6375 - protein, 52 aa, Homo sapiens [sequence omitted]

SEQ ID NO: 6376 - protein, 89 aa, Homo sapiens
MEKIKARLKAEFEALESEERHLKEYKQEMDLLLQEKMAHVEELRLIHADINVMENTIKQSENDLNKLLESTRRLHDEYKPLKEHVDACA

SEQ ID NO: 6377 - protein, 67 aa, Homo sapiens
MADEQEIMCKLESIKEIRNKTLQMEKIKARLKAEFEALESEERHLKEYKQEMDLLLQEKMAHVEELD

SEQ ID NO: 6378 - protein, 80 aa, Homo sapiens
  UNSURE 36: Xaa =  * ,Glu
  UNSURE 24: Xaa = Glu,Lys,Gln
  UNSURE 5: Xaa = His,Gln
MILHXLLCQYMTAAAPMQGTYIPXYTPVPPTAVSIXGVVADTSPQTVAPSSQDTSGQQQQIAVDTSNEHAPAYSYQQSKP

SEQ ID NO: 6379 - protein, 52 aa, Homo sapiens
MADPKTWGSAVSIVQKGIESYFYTNLGRPGWLCTCQLFYLAFDLFEPLFSHW

SEQ ID NO: 6380 - protein, 130 aa, Homo sapiens
  UNSURE 72: Xaa = Leu,Met
  UNSURE 71: Xaa = Phe,Ser
MESESESGAAADTPPLETLSFHGDEEIIEVVELDPGPPDQQMTWPRRWKMWTLRKKRRKRGNEEGWVLEPXXEGVVGSMEGPDDSEVTFALHSASVFCVSLDPKTNTLAVTGGEDDKAFVWRLSDGGAAL

SEQ ID NO: 6381 - protein, 57 aa, Homo sapiens
MPPDQLRRSSERLGHQRMTHKWRNFQARSKLMGGKILKCNIPEFSLVCSDSCQLPCT

SEQ ID NO: 6382 - protein, 60 aa, Homo sapiens
MSLPRFQRVNFGPYDNYIPVSELSKNHGISNTLPCYFPNHNGQEPKGDQNLLKYGTTRFL

SEQ ID NO: 6383 - protein, 110 aa, Homo sapiens
MASMQKRLQKELLALQNDPPPGMTLNEKSVQNSITQWIVDMEGAPGTLYEGEKFQLLFKFSSRYPFDSPQVMFTGENIPVHPHVYSNGHICLSISNRRLVPSALSPISLS

SEQ ID NO: 6384 - protein, 110 aa, Homo sapiens; identical to SEQ ID NO: 6383

SEQ ID NO: 6385 - protein, 79 aa, Homo sapiens
  UNSURE 16: Xaa = Cys,Pro,Arg,Ser
  UNSURE 3: Xaa = Lys,Asn
  UNSURE 15: Xaa = Phe,Leu
MRXPSSASRCQATGXXPPPPGPRVSSCLLSPQCDKPLVGAALVLGRSRRMAIWEPLHGTPLTLCHWNFIYFLVHILFCL

SEQ ID NO: 6386 - protein, 52 aa, Homo sapiens
MQFCLPFYESVFVAVPTVTKDRCKILRYRQLPPGGVCSDCLGDNLELNLLNY

SEQ ID NO: 6387 - protein, 65 aa, Homo sapiens [sequence omitted]

SEQ ID NO: 6388 - protein, 102 aa, Homo sapiens
MERLTLPLGGAAAVDEYLEYRRIVGEDDGGKLFTPEEYEEYKRKVLPLRLQNRLFVSWRSPTGMDCKLVGPETLCFCTHRYKQHKTDLEAIPQQCPIDPPAK

SEQ ID NO: 6389 - protein, 51 aa, Homo sapiens
MASMRESDTGLWLHNKLGATDELWAPPASRPCSRPRSSTTSVSASMASRRQ

SEQ ID NO: 6390 - protein, 70 aa, Homo sapiens [sequence omitted]

SEQ ID NO: 6391 - protein, 100 aa, Homo sapiens
  UNSURE 92: Xaa = Gly,Val
MNSAGLHPFRLQGLRSDLVQEAPSPSIGHWCEPRERRWCKRDENTGVNHLLVQGTEPSHKLTLKKPPHPTLVNRKPIHISISHTISKILQKXITIAMQSI

SEQ ID NO: 6392 - protein, 73 aa, Homo sapiens
MSHNLNSGLHPAMRAPIPSPSCVPVEESQHQWCAESWLESSHFTCGLDLYIRGEMSTLMPGLRAMGMILHLGL

SEQ ID NO: 6393 - protein, 99 aa, Homo sapiens
  UNSURE 26: Xaa = Ala,Pro
  UNSURE 44: Xaa = Ala,Thr
  UNSURE 80: Xaa = Asp,Glu
  UNSURE 25: Xaa = Leu,Arg
MCEGLPLSPRLECSGTISGHCSLDXXGSSDPLTSAFQVVGTTGXRHRDWLIFCIFTMVPRLVSELLSCLGLPKCWDYRRXTVPGQEKRICLTLAHFHIK

SEQ ID NO: 6394 - protein, 56 aa, Homo sapiens
  UNSURE 50: Xaa = Leu,Gln,Arg
  UNSURE 51: Xaa = Leu,Met,Val
  UNSURE 21: Xaa = Lys,Gln
MSLVAGKALSSARMSDAVLSXSSLMGSQQFQDGENEECGASLGGHEHPDXXMAASI

SEQ ID NO: 6395 - protein, 57 aa, Homo sapiens
MKFKRRDKLQNTSWRVLERLWNGMTLQSCRLKISMAGTPSWPLYSWYVFFLWTMRNM

SEQ ID NO: 6396 - protein, 74 aa, Homo sapiens
  UNSURE 35: Xaa = His,Gln
  UNSURE 44: Xaa = Leu,Met
  UNSURE 23: Xaa = Lys,Met,Arg,Thr
MLEQPGLRAFPQTESGSFPSASXNTPGSTPRMVIXAMALVCGHXPPITCGSKCSDSTSLCLSFHMYKMRIMLLL

SEQ ID NO: 6397 - protein, 82 aa, Homo sapiens
MLTLTFLLVGLLNHQWLKETDVPQKSRQLYAIIAEYGSRLYKYQETYRGERHREEKKRPRKGRGRDWSDAATSLGMPRATRS

SEQ ID NO: 6398 - protein, 72 aa, Homo sapiens
MILDPDIKENIKMKKRDAVREKWDFPPNILLLTHMGGSDQPSVTQMGTGRALDYPFKAGGPRKLFSAPYVSP

SEQ ID NO: 6399 - protein, 71 aa, Homo sapiens
MFRGLSSWLGLQQPVAGGGQPNGDAPPEQPSETWLSLRRRSCSKRETRSSSTRPKTSATIYLTLHLLPQKR

SEQ ID NO: 6400 - protein, 127 aa, Homo sapiens
MSILALIFIMGNSAKEALVWKVLGKLGMQPGRQHSIFGDPKKIVTEEFVRRGYLIYKPVPRSSPVEYEFFWGPRAHVESSKLKVMHFVARVLNRCSKDWPCNYDWDSDDDAEVEAILNSGARGYSAP

SEQ ID NO: 6401 - protein, 59 aa, Homo sapiens
MSPASSTTSLPVSPLTEEPVPFKNIQHYINCTHIWSDTCHCIIIEEPKDNQFCIGYNER

SEQ ID NO: 6402 - protein, 89 aa, Homo sapiens
MQVQQQQQLCGNYPTIHFSSTSFKRAASAIEKSIGILGSGSNPATGLSGQNAQMPVQNFADSSNADELELKCSCRLKHDCVQRLWGLLP

SEQ ID NO: 6403 - protein, 61 aa, Homo sapiens [sequence omitted]

SEQ ID NO: 6404 - protein, 51 aa, Homo sapiens
MHYTGKLEDGTEFDSSLPQNQPFVFSLGTGQVIKGWDQGLLGMCEGEKRNC

SEQ ID NO: 6405 - protein, 66 aa, Homo sapiens [sequence omitted]

SEQ ID NO: 6406 - protein, 89 aa, Homo sapiens
MWTVSSQGLFRGTPGQLVQHRLSKGPPEHRPQEKASAGPLPLSSFLGPHTPSHLGLRGLREDLMGRKDSLGRGWAPGPGGTESSTHTTM

SEQ ID NO: 6407 - protein, 74 aa, Homo sapiens
MAQADIALIGLAVMGQNLILNMNDHGFVVCAFNRTVSKVDDFLANEAKGTKVVGAQSLKEMVSKLKKPRRSSSW

SEQ ID NO: 6408 - protein, 56 aa, Homo sapiens
MTGPSGSCSALEWWTNMKLTDKGKGLFLITSIRIHWQRQHFAWTLLPSSDTTKKKI

SEQ ID NO: 6409 - protein, 66 aa, Homo sapiens [sequence omitted]

SEQ ID NO: 6410 - protein, 60 aa, Homo sapiens
MEELDGEPTVTLIPGVNSKKNQMYFDWGPGEMLVCETSFNKKEKSEMVPSCPFIYIIRKM

SEQ ID NO: 6411 - protein, 52 aa, Homo sapiens
  UNSURE 43: Xaa = Phe,Leu
MGYLAGETRSLLRKCRCSDSLFRSQKNKYKQTKKYPEKKLSFXPFLMMSQKY

SEQ ID NO: 6412 - protein, 93 aa, Homo sapiens
MIRFRLKEFSVLLNQQVFNDPLVSEEDMVTVVEDWMNFYINYYRQQVTGEPQERDKALQELRQELNTLANPFLAKYRDFLKSHELPSHPPPSS

SEQ ID NO: 6413 - protein, 64 aa, Homo sapiens
MMPEINTNHLDKQQVQLLAEMCILIDENDNKIGAETKKNCHLNENIEKGLLHRAFRCLLIQHRK

SEQ ID NO: 6414 - protein, 91 aa, Homo sapiens
  UNSURE 2: Xaa = Ala,Pro
  UNSURE 48: Xaa = Asn,Ser
  UNSURE 7: Xaa = Pro,Ser
MXPVRGXAKWRPGGIEARGEGVSTVGYRNKNVRQKTWRPNHPQAFVGXVREGTRLCFSKKTENTAKLQEIATEGKEGSNVTGISIHRSIPR

SEQ ID NO: 6415 - protein, 105 aa, Homo sapiens
  UNSURE 7: Xaa = Pro,Arg
MIFRSLXVGYNISKQVLDQYLTLLADDPLEFVGKSGDSGGGMYVINLHKALASLATATLESVVQERFGSRCARIFRLVFAEETHRAEASGRLCNDSCKGGKGYAI

SEQ ID NO: 6416 - protein, 50 aa, Homo sapiens [sequence omitted]

SEQ ID NO: 6417 - protein, 54 aa, Homo sapiens
MTNVSRTAPDPLNTDKISNNRFSETPAKVKQALSFIGITRDNHHSFSETSSYVS

SEQ ID NO: 6418 - protein, 63 aa, Homo sapiens
MCFRDSDCFIGKYDLFLSGIGLRGGGGTSSKDSFLQAPVAPRVSFARKMGSHVANRTLCPVAP

SEQ ID NO: 6419 - protein, 58 aa, Homo sapiens [sequence omitted]

SEQ ID NO: 6420 - protein, 86 aa, Homo sapiens
  UNSURE 9: Xaa = His,Leu,Gln
MLAGASLRXSQDGAHRKAFRESVRPGWEYIGRKMDVADFEWVMWFTSFRNVIIFALSGTCAVCLNSARWLPQSSAPGCMLCTGPWL

SEQ ID NO: 6421 - protein, 93 aa, Homo sapiens
  UNSURE 89: Xaa = Ala,Pro,Ser,Thr
MLLENLTDNESENTNLKKKVFEKEAHIQELSCLFQSEKANTLKANRFSQSVKVVHERLQIQIHKREAENDKLKEYVKSLETKIAKWNLXIKNE

SEQ ID NO: 6422 - protein, 66 aa, Homo sapiens
MDPPARKEKTKVKESVSRVEKAKQKSAQQELKQRQRAEIYALNRVMTELEQQQFDEFCKQMQPPGE

SEQ ID NO: 6423 - protein, 71 aa, Homo sapiens
MVMNGLNAMSPRRRGAKSRDICDCRNWEICYWNLVGRDQGCCSTSYNAQTTSSQQRNYLAQKVNSTDFEKP

SEQ ID NO: 6424 - protein, 73 aa, Homo sapiens
  UNSURE 71: Xaa = Ile,Ser
MPLKIPPARVTLTSRTTAGAASLTKWIQKNPDLLKASNGLCPEILGKPHDPDSQKKLRKKSITKTVQQARXQP

SEQ ID NO: 6425 - protein, 85 aa, Homo sapiens [sequence omitted]

SEQ ID NO: 6426 - protein, 58 aa, Homo sapiens
MLDTWCQNLGQGDSFVRPAPCPGPHSVKRSTCDLGSSDQPKEHLTNFKSDLLGLVAED

SEQ ID NO: 6427 - protein, 53 aa, Homo sapiens
  UNSURE 51: Xaa = Cys,Phe
MSPMPVLERPLKKRKPGAVAHACNPNTLGSQGGQITRSRDRDHPGQQGETXLY

SEQ ID NO: 6428 - protein, 88 aa, Homo sapiens
MDDADPEERNYDNMLKMLSDLNKDLEKLLEEMEKISVQATWMAYDMVVMRTNPTLAESMRRLEDAFVNCKEEMEKNWQELLHETKQRL

SEQ ID NO: 6429 - protein, 77 aa, Homo sapiens
MFAQMNSFKPQNNSVSNLNIWTQTAPAILEETLEIRGSSSMKTTAALRNQYSVPIFKRRAKRHAWIIPEFCCYEQCC

SEQ ID NO: 6430 - protein, 50 aa, Homo sapiens [sequence omitted]

SEQ ID NO: 6431 - protein, 57 aa, Homo sapiens
MINTATTVADLKSIINECYNYLELIGCLRLITTLSDKYMLVKDILGYHVIQRVHTPF

SEQ ID NO: 6432 - protein, 69 aa, Homo sapiens
  UNSURE 54: Xaa = Pro,Gln
MIEYDRIRATSKELGCARPLISVYSEKGESSGKNVTLPAVFKAPIRPDIVNFVXPTCAKTTDSPMLSVN

SEQ ID NO: 6433 - protein, 56 aa, Homo sapiens
  UNSURE 41: Xaa = Pro,Gln
MACARPLISVYSEKGESSGKNVTLPAVFKAPIRPDIVNFVXPTCAKTTDSPMLSVN

SEQ ID NO: 6434 - protein, 110 aa, Homo sapiens
  UNSURE 62: Xaa = Ala,Gly
  UNSURE 54: Xaa = Leu,Gln
MEPTRDCPLFGGAFSAILPMGAIDVSDLRPVPDNQEVFCHPVTDQSLIVELLEXQAHVRGEXAARYHFEDVGGVQGARAVHVESVQPLSLENLALRGAVKKPGSSLASSR

SEQ ID NO: 6435 - protein, 53 aa, Homo sapiens
MAIVDVKAMFKIERGSPKPGPQTSTGPWPVRNQATQQEPGMVVCACSPSYSGG

SEQ ID NO: 6436 - protein, 52 aa, Homo sapiens
MGVSGASIAWVRQWPQRQSEEEKDNTPVPDQLFLRCGGSEGLLAPKGDVQGA

SEQ ID NO: 6437 - protein, 52 aa, Homo sapiens
  UNSURE 30: Xaa = Ala,Gly
  UNSURE 38: Xaa = Phe,Val
MAAPPEPGEPEERKSLKLLGFLDVENTPCXPAFNIVWXIRICCGWLWTFFVH

SEQ ID NO: 6438 - protein, 52 aa, Homo sapiens
  UNSURE 30: Xaa = Ala,Gly
  UNSURE 51: Xaa = Gly,Val
MAAPPEPGEPEERKSLKLLGFLDVENTPCXPAFNIVWFIRICCGWLWTFFXH

SEQ ID NO: 6439 - protein, 52 aa, Homo sapiens
  UNSURE 17: Xaa = Phe,Leu
MASDLDFSPPEVPEPTXPGEPATVRTLPGSHLPAHLCAGHHRTHSQVPRGGG

SEQ ID NO: 6440 - protein, 61 aa, Homo sapiens
MASDLDFSPPECPSPLSWRTCYGTDSSWEPSSSSSVCWPSSYPFPSPTRRRLNRLSPEVLR

SEQ ID NO: 6441 - protein, 73 aa, Homo sapiens
MAYKLPVEDVHPLSRPFFKLEAMKQTFNLEEYSLSQATLEQVFLELCKEQELGNVDDKIDTTVEWKLLPQEDP

SEQ ID NO: 6442 - protein, 80 aa, Homo sapiens
MPKYSSLMAYKLPVEDVHPLSRAFFKLEAMKQTFNLEEYSLSQATLEQVFLELCKEQELGNVDDKIDTTVEWKLLPQEDP

SEQ ID NO: 6443 - protein, 73 aa, Homo sapiens; identical to SEQ ID NO: 6441

SEQ ID NO: 6444 - protein, 85 aa, Homo sapiens
  UNSURE 74: Xaa = Lys,Asn
MLRRKPTRLELKLDDIEEFENIRKDLETRKKQKEDVEVVGGSDGEGAIGLSSDPKSREQMINDRIGYKPQPKPXNRSSQFGSLEF

SEQ ID NO: 6445 - protein, 85 aa, Homo sapiens
  UNSURE 70: Xaa = His,Gln
  UNSURE 74: Xaa = Ile,Asn
  UNSURE 38: Xaa = Phe,Val
MLRRKPTRLELKLDDIEEFENIRKDLETRKKQKEDVEXVGGSDGEGAIGLSSDPKSREQLINDRIGYKPXPRPXNRSSQFGSLEF

SEQ ID NO: 6446 - protein, 72 aa, Homo sapiens
MCFVKQLLEGSMLLESHHHSLISSTQGHKHCGRPQDLCLGKPGIVQGFSPCDSLKYGLVGRERPDRPPARHP

SEQ ID NO: 6447 - protein, 56 aa, Homo sapiens
MTLRKSIWECSTSRKSVWLTPVSTENEIKLDPSPFIADFQTTAEELGLLSSSPNLL

SEQ ID NO: 6448 - protein, 85 aa, Homo sapiens
  UNSURE 83: Xaa = Ile,Lys,Met,Asn,Arg,Ser,Thr
  UNSURE 84: Xaa = Leu,Met,Val
MAAKDKECVANHMRAVENTLHKVRDQISLSWSAASRNDFTLQLPKLHLETFAMEGLKGGPEVVACQAMIKSFMDVYQLASTRXXT

SEQ ID NO: 6449 - protein, 93 aa, Homo sapiens
  UNSURE 65: Xaa = His,Gln
MGQCLRYQMHWEDLEEYQALTFLTRNEILCIHDTFLKLCPPGKYYKEATLTMDQVSSLPALRALXDKSAHQPLTGSGSQEFSSAWVQPLPCRE

SEQ ID NO: 6450 - protein, 81 aa, Homo sapiens [sequence omitted]

SEQ ID NO: 6451 - protein, 69 aa, Homo sapiens
MPEGKAQERPIPTGDGIRRENETKLLRLGNLERKLKRQGTGWKKIFEKDLCELLSGLYKIFLDILTTLK

SEQ ID NO: 6452 - protein, 120 aa, Homo sapiens
  UNSURE 6: Xaa = Ile,Lys,Arg,Thr
  UNSURE 82: Xaa = Ser,Tyr
MTGNNXDLFCATLSCYAGDISSAHETARYFIPPATSLPPRSTLSSATLLVPTLTQRDSSVFTAPNSVEKECYLKPELRHHLXKPMTASWLTKHEPEINAAKSRDKRFDCVSQDGLDLLTS

SEQ ID NO: 6453 - protein, 63 aa, Homo sapiens
MEEEMHTDAKIRAENGTGSSPRGPGCSLRHFACEQNLLSRPDGSASFLQVTPLSWRVCTGRPR

SEQ ID NO: 6454 - protein, 97 aa, Homo sapiens [sequence omitted]

SEQ ID NO: 6455 - protein, 58 aa, Homo sapiens [sequence omitted]

SEQ ID NO: 6456 - protein, 55 aa, Homo sapiens
MADRGGVGEAAAVGASPASVPGLNPTLGWRERLRPGWRGLGPRCGSWRGWGCFTP

SEQ ID NO: 6457 - protein, 60 aa, Homo sapiens
MWGCTPRLCLCPTPAPTPTWLATPSTRPSASPCSTPPWWTPVRTSRAITPPTASGTASRV

SEQ ID NO: 6458 - protein, 58 aa, Homo sapiens [sequence omitted]

SEQ ID NO: 6459 - protein, 54 aa, Homo sapiens
MGASLDQEHSDTLQDPEGWESAAGLRWWQTAVVDELYNDDCTRYQIRRGSISKF

SEQ ID NO: 6460 - protein, 63 aa, Homo sapiens
  UNSURE 16: Xaa =  * ,Asp,Glu,Phe,Ile,Lys,Leu,Asn,Val,Tyr
  UNSURE 53: Xaa =  * ,Glu,Leu,Val
  UNSURE 38: Xaa =  * ,Glu,Lys,Leu,Met,Gln,Val
  UNSURE 10,17: Xaa =  * ,Tyr
  UNSURE 11: Xaa = Asp,Asn
  UNSURE 13: Xaa = Ile,Leu
  UNSURE 15,30: Xaa = Ile,Lys,Asn
  UNSURE 19: Xaa = Phe,Ile,Asn,Tyr
  UNSURE 18: Xaa = any one of the twenty amino acids
MYVLFTALSXXVXHXXXXXLFLLELVVARXLPPPPIYXVFHVPVNSFPSTLTXLYMSFLYSHT

SEQ ID NO: 6461 - protein, 52 aa, Homo sapiens
MQENSSADTACKENDSVVSQDTLLATTISELSELTPQTDSMPTQLHSLSNME

SEQ ID NO: 6462 - protein, 58 aa, Homo sapiens
  UNSURE 21: Xaa = Ser,Tyr
MDVLLEISRILNTVLDMETLXICVRLCEQGINPEALSSVIKELRKATEALKAAENMTS

SEQ ID NO: 6463 - protein, 68 aa, Homo sapiens
  UNSURE 40: Xaa = Ala,Thr
  UNSURE 54: Xaa = Asn,Thr
  UNSURE 3: Xaa = Asp,Glu
  UNSURE 65: Xaa = Ile,Met,Val
MMXEEELEFVEELEAVLQLTPEVQLAIEQVFPSQDPLDRXDFNAVEYINTLFPXRAISGEHRRIXEQN

SEQ ID NO: 6464 - protein, 50 aa, Homo sapiens
MLSEQEHMSISGSSARHMVMQKLLRKQESTVMVLRNMVDPKDIDDDLEGR

SEQ ID NO: 6465 - protein, 68 aa, Homo sapiens
  UNSURE 63: Xaa = Glu,Lys
MEPSTCRTMESEEDYVEEKESEKCVKEGVTNPSNSSQQALLKADYKALKNGVPSPIMATKIPXKVIAQ

SEQ ID NO: 6466 - protein, 60 aa, Homo sapiens
  UNSURE 54: Xaa = Ala,Glu,Gly,Val
  UNSURE 39: Xaa = Ala,Pro,Ser,Thr
MATEQRPFHLVVFGASGFTGQFVTEEVARVQVDPERTPXCPGPWRAAPGRSCSXCWRRRP

SEQ ID NO: 6467 - protein, 55 aa, Homo sapiens
MRLCNQKVLPFLIFNFLETESCFVTQAGVQWYDHSLLQLFSPGFKVILLLQPPSS

SEQ ID NO: 6468 - protein, 58 aa, Homo sapiens
MAGPESDAQYQFTGIKKYFNSYTLTGRMNCVLATYGSIALIVLYFKLRSKKTPAVKAT

SEQ ID NO: 6469 - protein, 102 aa, Homo sapiens
MGRDFAEICSDYMASTIGFYSVSRLPTRSLSDNICAVCGQKIIVELDEEGLIENTYQLSCNHVWERTHFLYGQILDWLRYFVAWQPVVIGIVQGINYSLGLE

SEQ ID NO: 6470 - protein, 51 aa, Homo sapiens
MDSQAICKTISVLDYPPLDLLYKKNNSVFSEKTVIVLRIRVAKHYFNQHSN

SEQ ID NO: 6471 - protein, 78 aa, Homo sapiens
MAKTPLHTTLKSGILVKEDSVLCAGRRVNMNIWSSERKLSAEIVNCPPKLVTAGKLTIMVSRKQEVGDNRGSISLGPK

SEQ ID NO: 6472 - protein, 55 aa, Homo sapiens
  UNSURE 11: Xaa = Ser,Thr
MANRGPSYGLXREVQEKIEQKYDADLENKLVDWIILQCAEDIEHPPPGRPIFRNG

SEQ ID NO: 6473 - protein, 55 aa, Homo sapiens
MANRGPSYGLSREVQEKIEQKYDADLENKLVDWIILQCAEDIEHPPPGRPIFRNG

SEQ ID NO: 6474 - protein, 84 aa, Homo sapiens
MDGTVLCKLINSLYPPGQEPIPKISESKMAFKQMEQISQFLKAAETYGVRTTDIFQTVDLWEGKDMAAVQRTLDGFRQRCSHQG

SEQ ID NO: 6475 - protein, 51 aa, Homo sapiens
  UNSURE 38: Xaa = His,Gln
MHLSPSSWRLTPPNLYSTTHDAPQLMMGLCPNKSIVSXKIVRWARRSGLRL

SEQ ID NO: 6476 - protein, 79 aa, Homo sapiens [sequence omitted]

SEQ ID NO: 6477 - protein, 58 aa, Homo sapiens; identical to SEQ ID NO: 6468

SEQ ID NO: 6478 - protein, 54 aa, Homo sapiens
  UNSURE 33: Xaa = Pro,Ser
MGFFFFHVRRHEEILKDKHLYCEPSAEKINLCXIYRQKKICVKMLNGIIMRKLC

SEQ ID NO: 6479 - protein, 59 aa, Homo sapiens
  UNSURE 27: Xaa = Glu,Gln
  UNSURE 34: Xaa = Glu,Val
  UNSURE 33,57: Xaa = Leu,Pro
  UNSURE 25,32: Xaa = Leu,Val
MAMMEVQGGPSLGQTCVLIVIFTVXLXVPPGXXXTYVYFTNELKADAGQVLQKWHCXGS

SEQ ID NO: 6480 - protein, 133 aa, Homo sapiens
MAADDDNGDGTSLFDVFSASPLKNNDEGSLDIYAGLDSAVSDSASKSCVPSRNCSDLYEEILTEEGTAKEATYNDLQVEYGKCQLQMKELMKKFKEIQTQNFSLINENQSLKKNISALIKTARVEINRKMKNK

SEQ ID NO: 6481 - protein, 60 aa, Homo sapiens [sequence omitted]

SEQ ID NO: 6482 - protein, 57 aa, Homo sapiens [sequence omitted]

SEQ ID NO: 6483 - protein, 63 aa, Homo sapiens
MSVKGGGDFKQGDQEDLVDNFGSEHTPSGVPLCHPGWSGMVRSRLTATSASWVHAILLPQPPK

SEQ ID NO: 6484 - protein, 63 aa, Homo sapiens; identical to SEQ ID NO: 6483

SEQ ID NO: 6485 - protein, 63 aa, Homo sapiens; identical to SEQ ID NO: 6483

SEQ ID NO: 6486 - protein, 63 aa, Homo sapiens; identical to SEQ ID NO: 6483

SEQ ID NO: 6487 - protein, 63 aa, Homo sapiens; identical to SEQ ID NO: 6483

SEQ ID NO: 6488 - protein, 63 aa, Homo sapiens; identical to SEQ ID NO: 6483

SEQ ID NO: 6489 - protein, 63 aa, Homo sapiens; identical to SEQ ID NO: 6483

SEQ ID NO: 6490 - protein, 63 aa, Homo sapiens; identical to SEQ ID NO: 6483

SEQ ID NO: 6491 - protein, 63 aa, Homo sapiens; identical to SEQ ID NO: 6483

SEQ ID NO: 6492 - protein, 63 aa, Homo sapiens; identical to SEQ ID NO: 6483

SEQ ID NO: 6493 - protein, 63 aa, Homo sapiens; identical to SEQ ID NO: 6483

SEQ ID NO: 6494 - protein, 63 aa, Homo sapiens; identical to SEQ ID NO: 6483

SEQ ID NO: 6495 - protein, 53 aa, Homo sapiens
MKKPQSENFGGGPRTWIDLLVVFPKVHVLEIFSLSYYSLKKKMLTVYLFSSIL

SEQ ID NO: 6496 - protein, 63 aa, Homo sapiens
  UNSURE 10: Xaa =  * ,Glu,Lys,Gln
MSVKGGGDFXQGDQEDLVDNFGSEHTPSGVPLCHPGWSGMVRSRLTATSASWVHAILLPQPPK

SEQ ID NO: 6497 - protein, 121 aa, Homo sapiens
MEAEVDKLELMFQKAESDLDYIQYRLEYEIKTNHPDSASEKNPVTLLKELSVIKSRYQTLYARFKPVAVEQKESKSRICATVKKTMNMIQKLQKQTDLELSPLTKEEKTAAEQFKFHMPDL

SEQ ID NO: 6498 - protein, 67 aa, Homo sapiens
MSLPLNPKPFLNGLTGKPVMVKLKWGMEYKGYLVSVDGYMNMQIFIYILGILKQSKILLFQLSEDLK

SEQ ID NO: 6499 - protein, 63 aa, Homo sapiens; identical to SEQ ID NO: 6483

SEQ ID NO: 6500 - protein, 99 aa, Homo sapiens
MSLPLNPKPFLNGLTGKPVMVKLKWGMEYKGYLVSVDGYMNMQLANTEEYIDGALSGHLGEVLIRCNNVRLYQRCGRRGRRWGNERIASFVGDFFYIYF

SEQ ID NO: 6501 - protein, 67 aa, Homo sapiens; identical to SEQ ID NO: 6498

SEQ ID NO: 6502 - protein, 60 aa, Homo sapiens
  UNSURE 20: Xaa =  * ,Gly
MAQRLRRLGLLGLPTSEWGXRVSPGVPLKSSAPGVEGGYPDHPVTIVNFNVDMLFVNYAC

SEQ ID NO: 6503 - protein, 63 aa, Homo sapiens; identical to SEQ ID NO: 6483

SEQ ID NO: 6504 - protein, 70 aa, Homo sapiens
  UNSURE 6: Xaa = Phe,Ile
MSGLGXITTCLSSSRMEGSSILIFHLPNFLPDLSHVFHLERKGTESLLHGQCMNFIGNLALSRLYAFLSF

SEQ ID NO: 6505 - protein, 63 aa, Homo sapiens; identical to SEQ ID NO: 6483

SEQ ID NO: 6506 - protein, 63 aa, Homo sapiens; identical to SEQ ID NO: 6483

SEQ ID NO: 6507 - protein, 53 aa, Homo sapiens
MHYAWLIFVVLVEMEFHHVGQAGLELLTSRDLPASASQNAGITGVSHYAWPWG

SEQ ID NO: 6508 - protein, 65 aa, Homo sapiens
  UNSURE 15: Xaa = Asp,Glu
MAGEKEKRYEPGCAXYLRKLVGEGSVCRERGAWADDARGAHYIPLEEGVCSFRGRQSTRWRSLDV

SEQ ID NO: 6509 - protein, 60 aa, Homo sapiens
MHIHFPIIYSRPKAFSLSMNLVIGVPDHLAHKTILIIHLRHFQCLFPYMKKELRDNYNTI

SEQ ID NO: 6510 - protein, 77 aa, Homo sapiens
  UNSURE 34: Xaa = Asp,Asn
MPARAAPWLAGASSPTYRRAEHSNATHKFTDTTXRCLNPDHILCHCKREGSTQHCQPTDSNNWNRLLLDICEFVGIV

SEQ ID NO: 6511 - protein, 55 aa, Homo sapiens
  UNSURE 38: Xaa = Asp,Glu
MKTGQSPKSSEMTTLARQLTRLRVTCPSCRKLLQGWRXNLSALRNADLSGSRIGL

SEQ ID NO: 6512 - protein, 78 aa, Homo sapiens [sequence omitted]

SEQ ID NO: 6513 - protein, 78 aa, Homo sapiens [sequence omitted]

SEQ ID NO: 6514 - protein, 57 aa, Homo sapiens
MKLNIISRDAGSGIMVNAKVKSSRMRSQRKARESHKWSTAANPLHRLPLALVLPGNS

SEQ ID NO: 6515 - protein, 56 aa, Homo sapiens [sequence omitted]

SEQ ID NO: 6516 - protein, 51 aa, Homo sapiens
MTGVGGLARMGRVIERALTSVPLCVLTEACVGPERRLCAWGSFPLYISPQP

SEQ ID NO: 6517 - protein, 127 aa, Homo sapiens
MARFALTVVRHGETRFNKEKIIQGQGVDEPLSETGFKQAAAAGIFLNNVKFTHAFSSDLMRTKQTMHGILERSKFCKDMTVKYDSRLRESKYGVVEGKALSELRAMAKAAREECPVFTPPGERRWTR

SEQ ID NO: 6518 - protein, 65 aa, Homo sapiens
  UNSURE 25: Xaa = Ala,Gly
  UNSURE 52: Xaa = Arg,Thr
MLGLDELGRSGCGHCTQADLRFGDXWSRPGTGQRQEHRRARVPPPAQSHGGXAVLEGACSEQCHL

SEQ ID NO: 6519 - protein, 54 aa, Homo sapiens
  UNSURE 2: Xaa = Ile,Leu
MXSLLTLHPLECHPGTTSRSLRCHWVPILSEAELGEGTQHSNFLQVTCLRGDDI

SEQ ID NO: 6520 - protein, 91 aa, Homo sapiens
  UNSURE 45: Xaa = Asn,Ser
  UNSURE 69: Xaa = Asp,Glu
  UNSURE 18: Xaa = Phe,Ile
MCKAGFAGDDAPRAVFPXHRRGAPDTRASWWAWARRTPTWATRPXSKRGILTLKYPIEHGIVTNWDDMXKIWAPHLLQRAARGPGRSTQCC

SEQ ID NO: 6521 - protein, 71 aa, Homo sapiens
  UNSURE 62: Xaa = Ala,Ser
  UNSURE 43: Xaa = Leu,Val
MEEEIAALVIDNGSGMCKAGFAGDDAPRAVFPSIVGRPRHQGXMVGMGQKDSYVGDEAQQQXWHPDPEVPH

SEQ ID NO: 6522 - protein, 83 aa, Homo sapiens
MAPPGCPGSCPNFAVVCSFLERYGPLLDLPELPFPELERVLQAPPPDVGNGEGTSRSGSRAAAMALKVTGKTRVELEVAVHRN

SEQ ID NO: 6523 - protein, 97 aa, Homo sapiens [sequence omitted]

SEQ ID NO: 6524 - protein, 55 aa, Homo sapiens
MCSVPVVAFESETTAHGEKNHTFLSLRPVWPLGTQCSCSSATCNFGDFCFAAADV

SEQ ID NO: 6525 - protein, 64 aa, Homo sapiens [sequence omitted]

SEQ ID NO: 6526 - protein, 82 aa, Homo sapiens
  UNSURE 19: Xaa = Ala,Asp
  UNSURE 6: Xaa = Ala,Ser
  UNSURE 25: Xaa = Ala,Val
  UNSURE 48: Xaa = Glu,Val
  UNSURE 13: Xaa = His,Pro,Gln
  UNSURE 5: Xaa = Ile,Lys,Met,Asn
  UNSURE 57: Xaa = Lys,Thr
MIIEXXTGNPYLXSSSDLXLLHKIXLKVGNLSPHLQNIFSKSPIFAGXVLPQVQHPXNARKKYPKLNGLLADIVHIHARTES

SEQ ID NO: 6527 - protein, 68 aa, Homo sapiens
  UNSURE 57: Xaa = Ala,Gly
  UNSURE 59: Xaa = Lys,Asn
MVAAKKRKMCFVLDSLWSLPMLWVSNQGKGPFCIAKCHNHEHYSTMVLPPGQAGWFXRXEMNDSTART

SEQ ID NO: 6528 - protein, 67 aa, Homo sapiens
  UNSURE 51: Xaa = Glu,Gly
MDDIFTQCREGNAVAVRLWLDNTENDLNQGDDHGFSPLHWACREGRSAVVXDVDHAGGTDQCNEPWG

SEQ ID NO: 6529 - protein, 71 aa, Homo sapiens [sequence omitted]

SEQ ID NO: 6530 - protein, 51 aa, Homo sapiens
MGSKIFCCCRKTSEGSSTTVGFHNPRMFEQHHPRSFMLYQKDIHASPMTTA

SEQ ID NO: 6531 - protein, 82 aa, Homo sapiens
MGREFGNLTRMRHVISYSLSPFEQRAYPHVFTKGIPNVLRRIRESFFRVVPQFVVFYLIYTWGTEEFERSKRKNPAAYENDK

SEQ ID NO: 6532 - protein, 75 aa, Homo sapiens
MGREFGNLTRMRHVISYSLSPFEQRAYPHVFTKGIPNVLRRIRESFFRVVPRECLGPAGGKGWTPAAAAVTAPPL

SEQ ID NO: 6533 - protein, 82 aa, Homo sapiens; identical to SEQ ID NO: 6531

SEQ ID NO: 6534 - protein, 55 aa, Homo sapiens
MVKPHVYQKYKKLTGPGGVWSQLLRRLRWKDDLNPGGGSCSKPRSRYCTPAWVTQ

SEQ ID NO: 6535 - protein, 60 aa, Homo sapiens
MTKGHKRLERAKVYPINVIQTSVSCSKEGELEKGVESSCGRVKKTSHHVFKLHPATSYEL

SEQ ID NO: 6536 - protein, 65 aa, Homo sapiens
MIHTELKAVRQFQKRKIQVERELDDLKENLRNTERIHQETLRRLESRFFEEKVQIIRVNLKCFVY

SEQ ID NO: 6537 - protein, 58 aa, Homo sapiens
  UNSURE 28: Xaa = Gly,Arg
MKHTKDRVGQNLPRCGIECKSYQEGLAXLPEMKPRAGTEIRFSELPTQMFPEVPRQLR

SEQ ID NO: 6538 - protein, 62 aa, Homo sapiens
MVFSNSSQNRPRCQRISGSCLPAHDLLIPKDTADSSFWIASNPDNHHWGNSQTSSLPSKNIK

SEQ ID NO: 6539 - protein, 66 aa, Homo sapiens [sequence omitted]

SEQ ID NO: 6540 - protein, 56 aa, Homo sapiens
MACGLFRKLWQHCWVQGDLMRWADSGDCQLMCLFSSPFPVPILQPPNHVGRKCLAL

SEQ ID NO: 6541 - protein, 56 aa, Homo sapiens; identical to SEQ ID NO: 6540

SEQ ID NO: 6542 - protein, 69 aa, Homo sapiens
MIAGEHRLDPATISLGVDQTDDHQQPTHSRIRKKRVSPTSVWFQPYFCILKTLVQRWTLCRMMPLHLGC

SEQ ID NO: 6543 - protein, 69 aa, Homo sapiens; identical to SEQ ID NO: 6542

SEQ ID NO: 6544 - protein, 99 aa, Homo sapiens
  UNSURE 17: Xaa = Glu,Lys
MKFLQSYISELTSSTSXIFQSLSVSLTEMPNAKCSVLSHCFNFLGKLSPVDVNGVGCPSLKCLIFKWPGKEGEETIALYPKIHYKNRVFTKKRCLFSSQ

SEQ ID NO: 6545 - protein, 69 aa, Homo sapiens
  UNSURE 4: Xaa =  * ,Gly
MIAXEHRLDPATISLGVDQTDDHQQPTHSRIRKKRVSPTSVWFQPYFCILKTLVQRWTLCRMMPLHLGC

SEQ ID NO: 6546 - protein, 54 aa, Homo sapiens
MVCLDHILFIHSSISEHLCSFQLWAVGCPATVAPSAQSRLFPPNQVYNVGHCAG

SEQ ID NO: 6547 - protein, 52 aa, Homo sapiens [sequence omitted]

SEQ ID NO: 6548 - protein, 53 aa, Homo sapiens [sequence omitted]

SEQ ID NO: 6549 - protein, 67 aa, Homo sapiens
MNKRLQSRTEDSDNLWWDAFATEFFEDDATLTLSFCLEDGPKRYNSAKYCEFSFQGHVSTKLLPRSR

SEQ ID NO: 6550 - protein, 133 aa, Homo sapiens
MAALLRAVRRFRGKAVWERPLHGLWCCSGQEDPKRWVGSSSPISKEKLPNAETEKFWMFYRFDAIRTFGFLSRLKLAQTALTVVALPPGYYLYSQGLLTLNTVCLMSGISGFADHAVLDELFLTETGWYPVSE

SEQ ID NO: 6551 - protein, 63 aa, Homo sapiens
  UNSURE 62: Xaa = Ala,Asp,Glu
  UNSURE 63: Xaa = Ala,Ser
  UNSURE 36: Xaa = Lys,Arg
MEVIELNKCTSGQSFEVILKPPSFDGVPEFNASLPXRRDPSLEEIQKKLEAAEERRKYQEAXX

SEQ ID NO: 6552 - protein, 51 aa, Homo sapiens
MNALQRCDHKPLKNMDVGQTQWLTPVILVLWKAKAGGLLEARSSRPAWTTW

SEQ ID NO: 6553 - protein, 59 aa, Homo sapiens
MEERFSISLIFIMKCLTLCPIRTMSAQDASYLLTLKTAHYFSFQSTHFCGRNAVNILNL

SEQ ID NO: 6554 - protein, 84 aa, Homo sapiens
  UNSURE 37: Xaa = Ile,Arg
MAAAATLRLSAQGTVTFEDVAVNFTWEEWNLLSEAQXCLYRDVTLENLALISSLDPALDGSADNTQTGNLGQSVLPSHPEQKTA

SEQ ID NO: 6555 - protein, 84 aa, Homo sapiens [sequence omitted]

SEQ ID NO: 6556 - protein, 83 aa, Homo sapiens
MTTNLDLKVSMLSFISGIISLLNYLTSRSPACDENVTVIPTERSRLGVGPVTTVSPAKDEGPRSEMESLSVREKNLPKSGLWW

SEQ ID NO: 6557 - protein, 88 aa, Homo sapiens
MQLDFQQFLMKLEKLTDIRPIPDKEFVETYIKAYYLTENDMERWIKEHREYSTKQLTNLVNVCLGSHINKKARQKLLAAIDDIDRPKR

SEQ ID NO: 6558 - protein, 50 aa, Homo sapiens
  UNSURE 45: Xaa = Ala,Asp,Gly,Val
  UNSURE 2: Xaa = Asp,Glu
MXSFTLNFSHYLFQKGKEFPNLAQGQCWSSCLKCRFLNASPKDSXPTDPF

SEQ ID NO: 6559 - protein, 55 aa, Homo sapiens
MVKSPIVPYFGDHPHFSRLCEGAFPTSSDTLDAHCLSVLLDTLNFNSCICQSFFR

SEQ ID NO: 6560 - protein, 55 aa, Homo sapiens
MQRDKTLNICANHYIMRMMELKPKQVVTVPGSGTPMLTSPTSTQAGAAGHLLPEC

SEQ ID NO: 6561 - protein, 139 aa, Homo sapiens [sequence omitted]

SEQ ID NO: 6562 - protein, 55 aa, Homo sapiens
MELIRREGRRMTAAQPSETTVGNMVRRVLKIIREEYGRLHGRSDESDQQESCTNC

SEQ ID NO: 6563 - protein, 84 aa, Homo sapiens
MENSSRGFCHQFGNTLAASQIYHPEMKRSLSRCLLSLSQTEKNLMDATSDFRPADMGGHQSHRGTPHFTALNSQMGSFVLFLTN

SEQ ID NO: 6564 - protein, 62 aa, Homo sapiens
MLSICTPDGFLSSKILQREGANLFIGKTETTLPPIFSPLFIKPLCIFHLPVTSRHLDSEIYL

SEQ ID NO: 6565 - protein, 114 aa, Homo sapiens [sequence omitted]

SEQ ID NO: 6566 - protein, 71 aa, Homo sapiens
MRDPNTKRSRGFGFVTYATVEEVDAAMNARPHKVDGRVVEPKRAVSREDSQRPGAHLTVKKIFVGGIKRRH

SEQ ID NO: 6567 - protein, 67 aa, Homo sapiens
  UNSURE 15: Xaa = Glu,Gln
MEVEQYRREREHEFXSKQQAAMGSQGNLSAEVEQATRRQVQGMQSSQQRNRERVEYGLTPHSPGIAT

SEQ ID NO: 6568 - protein, 78 aa, Homo sapiens [sequence omitted]

SEQ ID NO: 6569 - protein, 59 aa, Homo sapiens
MGSSRGSAPGRQRNPSLLPLREGVDGARDLEHGRNRDLKESQDTGTRTPRRTRRVSELL

SEQ ID NO: 6570 - protein, 67 aa, Homo sapiens
  UNSURE 26: Xaa = Ala,Pro,Ser,Thr
MRFGGGGRHRDLPPSPLLPPPQPRAXGRTRPPPQRRGVSTRTDRCRPARPGKVLNCVGYYINPERLQ

SEQ ID NO: 6571 - protein, 74 aa, Homo sapiens [sequence omitted]

SEQ ID NO: 6572 - protein, 68 aa, Homo sapiens
  UNSURE 29: Xaa = His,Asn
MIVSFLRPRSHVEPWSLALLPEAGVRWCXLGSLQPLPPRFKRFSCLTLPSSWDYRGHYFQSTEKKMEA

SEQ ID NO: 6573 - protein, 98 aa, Homo sapiens
MRTFVHFALDALMFPARRRAAVTRLSERLSLCFCLHSRLQDPAARPRPEQMGSCCVAQAGLELLDSDDPPASASQSAGITDGDGLPCCELPHGEEAHM

SEQ ID NO: 6574 - protein, 70 aa, Homo sapiens
MFPARRRAAVTRLSERLSLCFCLHSRLQDPAARPRPEQMEMGCHVVSCPMGKRLTCEELREASRKQPVKN

SEQ ID NO: 6575 - protein, 70 aa, Homo sapiens; identical to SEQ ID NO: 6574

SEQ ID NO: 6576 - protein, 75 aa, Homo sapiens
  UNSURE 28: Xaa = Leu,Val
MDEADAFLRKRATEEISKDLRATLNAFXYHMGQHSNKFMLVLASNLPEQFDCAINSRIDVMVHFDLPQQRSGSAW

SEQ ID NO: 6577 - protein, 54 aa, Homo sapiens [sequence omitted]

SEQ ID NO: 6578 - protein, 74 aa, Homo sapiens
MFLARRERSFHQVDWFLCGRPPPFPPGQHLVVAGESQSCQKGEHLYSETFCYTKVMFRNTNKLFSRIRLILWEN

SEQ ID NO: 6579 - protein, 58 aa, Homo sapiens; identical to SEQ ID NO: 5931

SEQ ID NO: 6580 - protein, 68 aa, Homo sapiens
MTQDRPLLAVQEALKKCFPVVEEQQGLWQSACGTASPSCPPSATWRNSCRPHRTCGLRMCRRFGPSQI

SEQ ID NO: 6581 - protein, 52 aa, Homo sapiens
  UNSURE 46: Xaa = Ala,Pro
MDKDPILWGQVLDMDHRRLHFYFLDITSHVTAKQKTVLGKSRSYSXLFPRVL

SEQ ID NO: 6582 - protein, 86 aa, Homo sapiens
MTQLCELINKSGELLAKNLSHLDTVLGALDVQEHSLGVLAVLFVKFSMPSVPDFETLFSQVQLFISTCNGEHIRYATDTFAGLCIS

SEQ ID NO: 6583 - protein, 103 aa, Homo sapiens
MMGSKMASASRVVQVVKPHTPLIRFPDRRDNPKPNVSEALRSAGLPSHSSVISQHSKGSKSPDLLMYQGPPDTAEIIKTLPQKYRRKLVSQEEMEFIQRGGPE

SEQ ID NO: 6584 - protein, 103 aa, Homo sapiens; identical to SEQ ID NO: 6583

SEQ ID NO: 6585 - protein, 117 aa, Homo sapiens
MCAHMSIVVEFWLEKDEFGRRDLVIGKCDAEPSSVHVAILTEAIPPKMNQFLYNLKENLQKVLPHMVESQVCPLIGEILGQLDVKLLKSLIEQEAAHEPTHHETSQPSACQAGESPS

SEQ ID NO: 6586 - protein, 53 aa, Homo sapiens
MKQMNLSSRKGGPQWRLVSRFTASGLKHLFPKLLGVLTADNSNLNSSLRTNFG

SEQ ID NO: 6587 - protein, 55 aa, Homo sapiens [sequence omitted]

SEQ ID NO: 6588 - protein, 91 aa, Homo sapiens [sequence omitted]

SEQ ID NO: 6589 - protein, 91 aa, Homo sapiens
  UNSURE 52: Xaa = Lys,Asn
MPVARSWVCRKTYVTPRRPFEKSRLDQELKLIGEYGLRNKREVWRVKFTLAXIRKAARELLTLDEKDPRRLFEGNACCGGWSALGCWMRAR

SEQ ID NO: 6590 - protein, 91 aa, Homo sapiens
MPVARSWVCRKTYVTPRRPFEKSRLDQELKLIGEYGLRNKREVWRVKFTLAKIRKAARELLTLDEKDPRRLFEGNACCGGWSVLGCWMRAR

SEQ ID NO: 6591 - protein, 73 aa, Homo sapiens
MAAAAGLGLQREAAEGKWSAWRMTEGGEGEEEGSGVRGLQEGRQSLCQTRQGIWKGLGTSPALPGPSGSFRSH

SEQ ID NO: 6592 - protein, 56 aa, Homo sapiens
MLCISHCFTSSWYYEDYIDDSTKPANLPLVEFHWTQSVFHFHCNTTKAIQYQAPSL

SEQ ID NO: 6593 - protein, 57 aa, Homo sapiens [sequence omitted]

SEQ ID NO: 6594 - protein, 61 aa, Homo sapiens
MPNLFKDGATLSPWLDYTGLELHGISTLPYLQESCSIRNSSELQISHVNDTVTFKKCLYCI

SEQ ID NO: 6595 - protein, 53 aa, Homo sapiens
  UNSURE 26: Xaa = His,Gln
MEYQDAVRMLNTLQTNAGYLEQVKRXRVTLRHSWKPWNCTWHGVGCRWRTWTG

SEQ ID NO: 6596 - protein, 67 aa, Homo sapiens
MPLPGYEPCISECLERKTSKLGGPCLLIIFQEFKTVISSFQMQLKLHHPVHLARFLQHILIATSRPF

SEQ ID NO: 6597 - protein, 54 aa, Homo sapiens
MLSEGQVSLSDCFPEHALQRPGVRVLTAVAGPFSALSGISLLKILCFRISSFHF

SEQ ID NO: 6598 - protein, 50 aa, Homo sapiens
MNFGRTHTCKLMVSSLVPLYAQLIVIFLKHTSYYVISLLKSLSSFPWPQN

SEQ ID NO: 6599 - protein, 62 aa, Homo sapiens
MAEVVLIFLRAEEITSEAVTAASLPLQGGAGRTSSLSSPHPTPRRDFDRVTSRPSSHSTAGL

SEQ ID NO: 6600 - protein, 142 aa, Homo sapiens
MAAVVAATALKGRGARNARVLRGILAGATANKASHNRTRALQSHSSPEGKEEPEPLSPELEYIPRKRGKNPMKAVGLAWAIGFPCGILLFILTKREVDKDRVKQMKARQNMRLSNTGEYESQRFRASSQSAPSPDVGSGVQT

SEQ ID NO: 6601 - protein, 50 aa, Homo sapiens [sequence omitted]

SEQ ID NO: 6602 - protein, 70 aa, Homo sapiens
  UNSURE 62: Xaa = Cys,Gly,Arg,Ser
MDQAAPVVVEPISDEDWYLFCGDTVEILEGKDAGKQGKVVQVIRQRNWVVVGGLNTHYRYIXKTMDYRGT

SEQ ID NO: 6603 - protein, 100 aa, Homo sapiens
MTPIPLERPSMRTRGRVCTGPQRTQPHSCSLQNKAKGAGILMRAAGNNPGSWVHTDCGEQRGGVEAAAAAQSLPRRSQVHRACATLGARGGAGLPPNPIC

SEQ ID NO: 6604 - protein, 64 aa, Homo sapiens
  UNSURE 8: Xaa = Arg,Ser
MVVIPTPXSFLRHFTLKLWSYFPNSWTFCAINQCFVFFLLRLPKGVSVALFNISSNIFTPQSRE

SEQ ID NO: 6605 - protein, 120 aa, Homo sapiens
  UNSURE 101: Xaa = Ile,Lys
MRAEKRKKNAPKEASRLKSILKLDGDVLMKDVQEIATVVVPKPKHCQEKMQCEVKDEKDDMKMETDIKRNKKTLLDQHGQYPIWMNQRQRKRLKAKREKRXGEKQSKSSESGKGFGLVDS

SEQ ID NO: 6606 - protein, 108 aa, Homo sapiens
  UNSURE 103,105: Xaa =  * ,Glu,Lys,Gln
  UNSURE 42: Xaa = Ile,Lys,Arg,Thr
MRAEKRKKNAPKEASRLKSILKLDGDVLMKDVQEIATVVVPXPKHCQEKMQCEVKDEKDDMKMETDIKRNKKTLLDQHGQYPIWMNQRQRKRLKAKREKRKGXSXAKQ

SEQ ID NO: 6607 - protein, 60 aa, Homo sapiens [sequence omitted]

SEQ ID NO: 6608 - protein, 64 aa, Homo sapiens
MPGSHKYAFHLYGFANVVFCVSFLSLGMMFSRFIHIVPCVSVIICFFNLSSLLGVKFVSKYFFL

SEQ ID NO: 6609 - protein, 55 aa, Homo sapiens
MYTCSFKKKSLGPGVVAHALISTLWEAERVDHLTSGVRDQPDQHGVTPSLLKIQN

SEQ ID NO: 6610 - protein, 80 aa, Homo sapiens
MSLRKQTPSDFLKQIIGRPVVVKLNSGVDYRGVLACLDGYMNIALEQTEEYVNGQLKNKYGDAFIRGNNVLYISTQKRRM

SEQ ID NO: 6611 - protein, 55 aa, Homo sapiens
MREMRECGERFCKSGLEVVIVQNPATWVHGTVRLFQHGKLKSGISLRKKLSLSEE

SEQ ID NO: 6612 - protein, 70 aa, Homo sapiens
MEEKRVTESKTLKLEHISAKKRKGEIQMKINHIHKYQGSKAGGFNSINLARPKMKPGNENEDTAIFSSRK

SEQ ID NO: 6613 - protein, 65 aa, Homo sapiens
MELSSMKICAAFQQAGLCLRLSEDAEEKDIRTGMALTARSNDRALGDGKGINLLTLASFPETTYP

SEQ ID NO: 6614 - protein, 83 aa, Homo sapiens
MGRRKSKRKPPPKKKMTGTLETQFTCPFCNHEKSCDVKMDRARNTGVISCTVCLEEFQTPITYLSEPVDVYSDWIDACEAANQ

SEQ ID NO: 6615 - protein, 51 aa, Homo sapiens
MAARGRYKCGVSLQELILVPEREKYALVGNEPFVPEAEGLGLGQHRDWRWL

SEQ ID NO: 6616 - protein, 73 aa, Homo sapiens [sequence omitted]

SEQ ID NO: 6617 - protein, 129 aa, Homo sapiens [sequence omitted]

SEQ ID NO: 6618 - protein, 106 aa, Homo sapiens
  UNSURE 81: Xaa = Glu,Gly
  UNSURE 80: Xaa = Glu,Lys
MSLWVDKYRPCSLGRLDYHKEQAAQLRNLVQCGDFPHLLVYGPSGAGKKTRIMCILRELYGVGVEKLRIEHQTITTPSKXXKLKLAPLQVTTTLKLILVMLEIVTE

SEQ ID NO: 6619 - protein, 98 aa, Homo sapiens
MGRNKKKKRDGDDRRPRLVLSFDEEKRREYLTGFHKRKVERKKAAIEEIKQRLKEEQRKLREERHQEYLKMLAEREEALEEADELDRLVTAKTESVAV

SEQ ID NO: 6620 - protein, 107 aa, Homo sapiens
  UNSURE 48: Xaa = Met,Arg
MAGGYGVMGDDGSIDYTVHEAWNEATNVYLIVILVSFGLFMYAKRNKXRIMRIFSVPPTEETLSEPNFYDTISKIRLRQQLEMYSISRKYDYQQPQNQADSVQLSLE

SEQ ID NO: 6621 - protein, 117 aa, Homo sapiens
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMYVF

SEQ ID NO: 6622 - protein, 58 aa, Homo sapiens
  UNSURE 29: Xaa = Ala,Gly
MKPGFSPRGVALAAEGALVTVVVVEAEGXLAGAEVEAEALEVVDEEEVEAAAAVEDTL

SEQ ID NO: 6623 - protein, 98 aa, Homo sapiens
MKPGFSPRGGGFGGRGGFGDRGGRGGRGGFGGGRGRGGGFRGRGRGGGGGGGGGGGGGRGHFVISIKANCIDSTASAEAVFASEVKKMQQENMKPQSS

SEQ ID NO: 6624 - protein, 55 aa, Homo sapiens
MLKLKKKVNENSLPVPLEKEQVSHGKHNCALPLQAAKQPALTPHGDVCSVLWLRI

SEQ ID NO: 6625 - protein, 97 aa, Homo sapiens
MPPNLTGYYRFVSQKNMEDYLQALNISLAVRKIALLLKPDKEIEHQGNHMTVRTLSTFRNYTVQFDVGVEFEEDLRSVDGRKCQAALGMNSPARAIS

SEQ ID NO: 6626 - protein, 81 aa, Homo sapiens
MSGREGGKKKPLKQPKKQAKEMDEEDKAFKQKQKEEQKKLEELKAKAAGKGPLAQVELRNLAKSKLFLVPEEMVTLYFICI

SEQ ID NO: 6627 - protein, 60 aa, Homo sapiens
MDEEDKAFKQKQKEEQKKLEELKAKAAGKGPLAQVELRNLAKSKLFLVPEEMVTLYFICI

SEQ ID NO: 6628 - protein, 81 aa, Homo sapiens; identical to SEQ ID NO: 6626

SEQ ID NO: 6629 - protein, 81 aa, Homo sapiens; identical to SEQ ID NO: 6626

SEQ ID NO: 6630 - protein, 81 aa, Homo sapiens
  UNSURE 36: Xaa = Asp,Glu,Val
MSGREGGKKKPLKQPKKQAKEMDEEDKAFKQKQKEXQKKLEELKAKAAGKGPLAQVELRNLAKSKLFLVPEEMVTLYFICI

SEQ ID NO: 6631 - protein, 60 aa, Homo sapiens
MDEEDKAFKQKQKEEQKKLEELKAKAAGKGPLAQVELRNLSKSKLFLVPEEMVTLYFICI

SEQ ID NO: 6632 - protein, 93 aa, Homo sapiens
  UNSURE 4: Xaa = Arg,Ser,Thr
MSDXRAELRRAGLDPEEAPEALYPVTSRSRSHRRSRSRSYSRDYRRRHSHSHSPMSTRRRHVGNRANPDPNCCLGVFGAELVHHRKRSKRSVL

SEQ ID NO: 6633 - protein, 50 aa, Homo sapiens [sequence omitted]

SEQ ID NO: 6634 - protein, 71 aa, Homo sapiens
  UNSURE 70: Xaa =  * ,Glu
MCISMCIESDTYELKLITASEKICWLGNIFTLFKIHKYSLPYPYPYQVTFLELTTVISFLCILPDILYIXK

SEQ ID NO: 6635 - protein, 113 aa, Homo sapiens [sequence omitted]

SEQ ID NO: 6636 - protein, 50 aa, Homo sapiens
MNGSKSLCKKFETYWEKPPSRLIVHIRRFRVSHGLRCQIVISICFVHVYI

SEQ ID NO: 6637 - protein, 81 aa, Homo sapiens [sequence omitted]

SEQ ID NO: 6638 - protein, 52 aa, Homo sapiens
MVTVRASLQSEFVCLILSDTSDAVKQGQSGSWIVTTHADIKQTLPSVQRAPQ

SEQ ID NO: 6639 - protein, 103 aa, Homo sapiens
  UNSURE 10: Xaa = Glu,Gln
  UNSURE 64: Xaa = Pro,Arg
MNQADFFFFXGVFKLQWALMEMERKTNKMTLLAPCVLQMWCRLCSELREKKEERTTPLSPNSLXTLFCQPSDWKQEGREACGDLSLDNRGKPDPRKISSINIM

SEQ ID NO: 6640 - protein, 119 aa, Homo sapiens
MEPLKVEKFATANRGNGLRAVTPLRPGELLFRSDPLAYTVCKGSRGVVCDRCLLGKKAWPDHKRECKCLKSCKPRYPPDFVRLLGRVVFKLMDGAPSESEKLYSFYDLESSDLQLFHHL

SEQ ID NO: 6641 - protein, 131 aa, Homo sapiens
MCSYIWRTTFFLHLRIYDVGMQLKSQQNEFQKVKKQLSHLQDELKIKYRQSYIFSQRLSEYKYFWNKTLSLLTFTKRELTSIKNEVYDNYQNWTSLKGAVFLQIKSISETALTEIDILNKSLTVSREIKYA

SEQ ID NO: 6642 - protein, 54 aa, Homo sapiens
MSDTSESGAGLTRFQAEASEKDSSSMMQTLLTVTQNVEVPETPKPQRHWRSQRM

SEQ ID NO: 6643 - protein, 70 aa, Homo sapiens
  UNSURE 62: Xaa = Pro,Arg
MSDTWSSIQAHKKQLDSLRERLQRRRSRTRGTWIYGIQRQHCLQPSVVTAQCLLHPPLGPKXRQLQQFLN

SEQ ID NO: 6644 - protein, 67 aa, Homo sapiens
MWSVGVIIYVSLSGTFPFNEDEDIHDQIQNAAFMYPPNPWKEISHEDVDLIQYNTYILGCLSSHCTA

SEQ ID NO: 6645 - protein, 134 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMGL

SEQ ID NO: 6646 - protein, 65 aa, Homo sapiens [sequence omitted]

SEQ ID NO: 6647 - protein, 75 aa, Homo sapiens
MADRKRVYKQVMVCESTVKTRRWCTVGGCLPSHHFFLFLSQGLALLPKLECSGGTLTHCDLHLSGSAILPPQPPE

SEQ ID NO: 6648 - protein, 109 aa, Homo sapiens
MEGSGEQPGPQPQHPGDHRIRDGDFVVLKREDVFKAVQVQRRKKVTFEKQWFYLDNVIGHSYGTAFEVTSGGSLQPKKKREEPTAETKEAGTDNRNIVDDGKSQKTYSR

SEQ ID NO: 6649 - protein, 57 aa, Homo sapiens
MHQTKGSSEDARVHGFLEDKFSTADTNIRTSMYLLGDTRTVLRTQNLEAKPPAFYAS

SEQ ID NO: 6650 - protein, 96 aa, Homo sapiens
MEALSRAGQEMSLAALKQHDPYITSIADLTGQVALYTFCPKANQWEKTDIEGTLFVYRRSASPYHGFTIVNRLNMHNLVEPVNKDLEFQLHEPFLL

SEQ ID NO: 6651 - protein, 98 aa, Homo sapiens
  UNSURE 64: Xaa =  * ,Trp
MAASAARGAAALRRSINQPVAFVRRIPWTAASSQLKEHFAQFGHVRRCILPFDKETGFHRGLGXVQFSSEEGLRNALQQENHIIDGVKVNLFLCQIHT

SEQ ID NO: 6652 - protein, 76 aa, Homo sapiens
  UNSURE 25: Xaa =  * ,Leu,Trp
MRFGMGENTKSKNFRNYLSCSLTAXMRKQSSDSPRYSRARDRTQGSRLSGQYTCHWKSWWHGKNVPFGVKQLWIHN

SEQ ID NO: 6653 - protein, 72 aa, Homo sapiens
MMHNSAGPVAHTQRPTQCKKTVFHTPMISSPTKQQHPFPSPLPTKLSIKTLASEFSAKLILVITPVLPLGWP

SEQ ID NO: 6654 - protein, 51 aa, Homo sapiens
MLPWQSSASNPTACSRSPGKNLWRPRGCMSTARPYHTDGSARPAPSLTSVP

SEQ ID NO: 6655 - protein, 61 aa, Homo sapiens
MTDYGEEQRNELEALESIYPDSFTVLSENPPSFTITVTSEAGENDETVQTTLKFTYKKIPR

SEQ ID NO: 6656 - protein, 61 aa, Homo sapiens; identical to SEQ ID NO: 6655

SEQ ID NO: 6657 - protein, 61 aa, Homo sapiens; identical to SEQ ID NO: 6655

SEQ ID NO: 6658 - protein, 61 aa, Homo sapiens; identical to SEQ ID NO: 6655

SEQ ID NO: 6659 - protein, 61 aa, Homo sapiens; identical to SEQ ID NO: 6655

SEQ ID NO: 6660 - protein, 61 aa, Homo sapiens; identical to SEQ ID NO: 6655

SEQ ID NO: 6661 - protein, 61 aa, Homo sapiens; identical to SEQ ID NO: 6655

SEQ ID NO: 6662 - protein, 61 aa, Homo sapiens; identical to SEQ ID NO: 6655

SEQ ID NO: 6663 - protein, 61 aa, Homo sapiens; identical to SEQ ID NO: 6655

SEQ ID NO: 6664 - protein, 61 aa, Homo sapiens; identical to SEQ ID NO: 6655

SEQ ID NO: 6665 - protein, 61 aa, Homo sapiens; identical to SEQ ID NO: 6655

SEQ ID NO: 6666 - protein, 60 aa, Homo sapiens
  UNSURE 18: Xaa = Ala,Asp,Gly,Val
  UNSURE 28: Xaa = Ala,Gly,Ser,Thr
  UNSURE 15: Xaa = His,Gln,Arg
  UNSURE 23: Xaa = Lys,Met,Arg,Thr
MSPHLFICPLTLPWXFRXSAKAXCCRRXQNSVRKGAAQRASEEWRPRLQVGVMAQTPTGI

SEQ ID NO: 6667 - protein, 53 aa, Homo sapiens
  UNSURE 44: Xaa = Cys,Phe
  UNSURE 36: Xaa = Glu,Lys
MARDIPRFPSRMKTSFPENTKCSPTSHPACIYQKRXHLMLAVCXWNQKLFSIL

SEQ ID NO: 6668 - protein, 69 aa, Homo sapiens
MDLKNIVPNEIRQTEVIEDYYLLYLNYGGQNTAIHILQEDVYTKDTHSTERVPWWGEGGEAETLKGVSY

SEQ ID NO: 6669 - protein, 103 aa, Homo sapiens
MQLISLQFHQRTHTGERPYTCDVCQKQFTQKSYLKCHKRSHTGEKPFECKDCKKVFTYRGSLKEHQRIHSGEKPYKCSKCPRAFSRLKLLRRHQKTHPEATSQ

SEQ ID NO: 6670 - protein, 65 aa, Homo sapiens
  UNSURE 49: Xaa = Asn,Ser
MEKPYREATWSGGDMRMCREGEESSCLIILPEPRHQPSLPTCSTSEDAXVPPGKWILWPQSRSCS

SEQ ID NO: 6671 - protein, 58 aa, Homo sapiens
MDHQEGQETLIISRQLTLTLRDTFSLGECGNAGGKMQLKISGTGHHPVPTRGCTRGED

SEQ ID NO: 6672 - protein, 96 aa, Homo sapiens
MSWHPQYRSSKFRHVFGKPASKENCYDSVPITRSVHDNHFCAVNPHFIAVVTECAGGGAFLVIPLHQVRTPPGPNSSLEAGQDRGKVERAWVSRKS

SEQ ID NO: 6673 - protein, 55 aa, Homo sapiens
  UNSURE 10: Xaa =  * ,Ala,Cys,Gly,Ser
  UNSURE 36: Xaa =  * ,Asp,Glu,Phe,Leu,Val,Tyr
  UNSURE 3: Xaa =  * ,Asp,Glu,Tyr
  UNSURE 7: Xaa =  * ,Gln
  UNSURE 21: Xaa =  * ,Glu,Gly,Trp
  UNSURE 25: Xaa =  * ,Ile,Leu,Met,Arg,Trp
  UNSURE 15: Xaa =  * ,Leu
  UNSURE 38: Xaa =  * ,Lys
  UNSURE 42: Xaa =  * ,Lys,Asn,Tyr
  UNSURE 26: Xaa =  * ,Phe,Ile,Lys,Leu,Asn,Tyr
  UNSURE 28: Xaa = Ala,Asp,Asn,Thr
  UNSURE 8: Xaa = Ala,Cys,Gly,Ser,Trp
  UNSURE 29: Xaa = Ala,Ile,Met,Thr,Val
  UNSURE 37: Xaa = Ala,Leu,Ser,Val
  UNSURE 24: Xaa = Ala,Phe,Leu,Ser,Val
  UNSURE 17: Xaa = Ala,Val
  UNSURE 2: Xaa = Arg,Ser
  UNSURE 23: Xaa = Arg,Ser,Thr
  UNSURE 11: Xaa = Asn,Ser,Thr,Tyr
  UNSURE 6,33: Xaa = Asp,Glu,Gly,Lys,Asn,Arg,Ser
  UNSURE 13: Xaa = Asp,Glu,His,Leu,Gln,Val
  UNSURE 40: Xaa = Asp,Glu,Ile,Lys,Asn,Val
  UNSURE 4,31: Xaa = Asp,Glu,Lys,Asn
  UNSURE 16,22: Xaa = Asp,Ile,Asn,Val
  UNSURE 9: Xaa = Cys,Ser
  UNSURE 43: Xaa = Glu,Gly,Lys,Arg
  UNSURE 19: Xaa = Gly,Trp
  UNSURE 32: Xaa = His,Ile,Lys,Leu,Asn,Gln
  UNSURE 35: Xaa = His,Lys,Asn,Pro,Gln,Thr
  UNSURE 5: Xaa = His,Pro,Gln
  UNSURE 12: Xaa = Ile,Leu,Met
  UNSURE 27: Xaa = Leu,Gln
  UNSURE 18: Xaa = Leu,Pro
  UNSURE 39: Xaa = Lys,Asn
  UNSURE 41: Xaa = Lys,Asn,Thr
  UNSURE 20: Xaa = Lys,Leu,Met,Gln
  UNSURE 34: Xaa = Phe,Leu,Pro,Ser
  UNSURE 14: Xaa = Pro,Ser
MXXXXXXXXXXXXXXXXXXXXXXXXXXXXCXXXXXXXXXXXXXQNIIIYGTILVL

SEQ ID NO: 6674 - protein, 121 aa, Homo sapiens
MNSSEVDSVMSSINPNTSGILLEGFLNIVRKKKEAQRYRNEVRHIFTAFDTYYRGFLTLEDFKKAFRQVAPKLPERTVLEVFSQSLILPTVHLLCHSDLSVGAMRPSFFRIILSAMKNSIC

SEQ ID NO: 6675 - protein, 55 aa, Homo sapiens
MGRVIRGQRKGAGSVFRAHVKHRKGAALAARLDFAERHGYIKGIRELCHRYLPQP

SEQ ID NO: 6676 - protein, 61 aa, Homo sapiens [sequence omitted]

SEQ ID NO: 6677 - protein, 51 aa, Homo sapiens
MLPESWIWTSFWTAYDKDEDPYSSQLKLDRIFKSNEASSLDISTGFALRRN

SEQ ID NO: 6678 - protein, 56 aa, Homo sapiens; identical to SEQ ID NO: 6275

SEQ ID NO: 6679 - protein, 85 aa, Homo sapiens
  UNSURE 75: Xaa = Arg,Thr
  UNSURE 85: Xaa = Asp,Asn
MISSHCNLHLPDSSDSPLSASQVAGITGIHYHAWLIFVFLVETGFHHVGQAGLQLLTSGDTPTSASQSAGIIGVXLCPASFVYLX

SEQ ID NO: 6680 - protein, 56 aa, Homo sapiens
MLSPEAERVLRYLVEVEELAEEVLADKRQIVDLDTKRNQNREGLRACRRISASLKM

SEQ ID NO: 6681 - protein, 65 aa, Homo sapiens
MEGHFVPRRPRHPREDVKRNDPFRVITGWRWSFMTKMKVNMMWKIQRWKQQAKDAGAERWNLGYS

SEQ ID NO: 6682 - protein, 54 aa, Homo sapiens
  UNSURE 38: Xaa = Glu,Gly
MAPPSGMIRVTAGRGSFEWRPAGGDPNRRAGRRPFSRXGPIWRKSSRLVKLGGR

SEQ ID NO: 6683 - protein, 91 aa, Homo sapiens [sequence omitted]

SEQ ID NO: 6684 - protein, 77 aa, Homo sapiens
MSNNSKSYLCFIIHHCEPLSPCFFIFAYLEREGFNFNLLKLLNSGFSLQDEEFHCILFRTSSLSDFPCALCFLVKLI

SEQ ID NO: 6685 - protein, 90 aa, Homo sapiens
  UNSURE 63: Xaa = Ile,Met
MLIPQLKESLQTLMKVAAQNLIQNTNIDNGQKSSDGPIQRFDKCLEEFYALCDQLELCLRLAXSACHRVVTVPSTLQRWCPQPPSPTHAA

SEQ ID NO: 6686 - protein, 59 aa, Homo sapiens
MAASQQQASALPQLLVYRVLVRLAARVPSSSRNRQHNWWALPERPPAATATGLRSCAAL

SEQ ID NO: 6687 - protein, 86 aa, Homo sapiens
MQEKFRHNIAYFPQIVSVAARMLKVARLLEVPVMLTEQYPQGLGPTVPELGTEGLRRWQDLLQHGACPAAGAGQSAPAALCAALWH

SEQ ID NO: 6688 - protein, 71 aa, Homo sapiens
MVFEVFEVFLEFTCWRLQLTERPGLDCASCSSRTKDISWKCMRPRICDRNGSSHVRYAPWKDLEIRNLSEH

SEQ ID NO: 6689 - protein, 79 aa, Homo sapiens
MCPENGSCVPDGPGLLQCVCADGFHGYKCMAPGLVLTAYVLRDSGSHHSIRLHSALGDPAPKSQDFMNYIGLTIDLRSI

SEQ ID NO: 6690 - protein, 97 aa, Homo sapiens
MKWCQEGRFWLHIMKPSLNTCFFTNRRPSVEVSEPFSLEIFKRWVDNCPSQALCKEIYHGRAMETELLIQGQSSKWQSWGVSPGSFVPESVLLVTLL

SEQ ID NO: 6691 - protein, 50 aa, Homo sapiens [sequence omitted]

SEQ ID NO: 6692 - protein, 136 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYIKVKYDSV

SEQ ID NO: 6693 - protein, 66 aa, Homo sapiens
MYSFVTLHIDEVWTFSVPITQVMNIVPKRKKGLPQWLKENGTRVRQFLLGLGEPANSFTYNQEQTD

SEQ ID NO: 6694 - protein, 76 aa, Homo sapiens
MDIRPNHTIYINNMNDKIKKEELKRSLYALFSQFGHVVDIVALKTMKMRGQAFVIFKELGLIHKCLETATRISILW

SEQ ID NO: 6695 - protein, 70 aa, Homo sapiens
  UNSURE 26: Xaa = Ile,Met
MTVGKSSKMLQHIDYRMRCILQDGRXFIGTFKAFDKHMNLILCDCDEFRKIKCVRGESLSFWPHCLFVKL

SEQ ID NO: 6696 - protein, 66 aa, Homo sapiens
MEVDAPGVDGRDGLRERRGFSEGGRQNFDVRPQSGANGLPKHSYWLDLWLFILFDVVVFLFVYFLP

SEQ ID NO: 6697 - protein, 59 aa, Homo sapiens [sequence omitted]

SEQ ID NO: 6698 - protein, 110 aa, Homo sapiens
  UNSURE 61: Xaa = Phe,Ile
MFSLPLNCSPDHIRRGSCWGRPQDLKIAAPAWNSKCHPGAGAAMARQHARTLWYDRPRYVXMEFCVEDSTDVHVLIEDHRIVFSCKNADGVGLYNEIEFYAKSELQGLPG

SEQ ID NO: 6699 - protein, 65 aa, Homo sapiens
MLSALPGWGPAHLQRPLLGPASCLGILRPAMTAHSFALPVIIFTTFWGLVGIAGPWFVPKDPTAE

SEQ ID NO: 6700 - protein, 68 aa, Homo sapiens
MGNLCGCIQGDSKKPSKKRVKRKPYSTTKVTSGSTFNGTYSGITHWLLEKDSTGNLELNCWLLSGEPP

SEQ ID NO: 6701 - protein, 54 aa, Homo sapiens
  UNSURE 24: Xaa = Asp,Glu,Gly
  UNSURE 2: Xaa = Leu,Gln
MXAHQHPFLQQLAKTGGWAMFPSXHLAHSSWTERKLPLKRGWGSFPGGVQARRK

SEQ ID NO: 6702 - protein, 61 aa, Homo sapiens
MKVMFSFGNTDRRFKTGQFKCQLQTKENNGRENTGHSEIGAASELSRKMFLMNLRKTIAPP

SEQ ID NO: 6703 - protein, 60 aa, Homo sapiens
MVAHAVVPSSWDWRSPPPCLANFLYFQWRWGFCHVGQAVLELLSSGDPTVSASKVLGLQA

SEQ ID NO: 6704 - protein, 75 aa, Homo sapiens
MSDNEDNFDGDDFDDVEEDEGLDDLENAEEVSIQPQAPTSAAQAPNRLTGRPGECRDPPLWGRPQPTRSESPHHT

SEQ ID NO: 6705 - protein, 104 aa, Homo sapiens
MTWRMPKRKARRMSRSSPLGATAANQKRITTPYMTKYERARVLGTRALQIAMCAPVMVELEGETDPLLIAMKELKARKIPIIIRRYLPDGSYEDWGVDELIITD

SEQ ID NO: 6706 - protein, 104 aa, Homo sapiens; identical to SEQ ID NO: 6705

SEQ ID NO: 6707 - protein, 104 aa, Homo sapiens; identical to SEQ ID NO: 6705

SEQ ID NO: 6708 - protein, 104 aa, Homo sapiens; identical to SEQ ID NO: 6705

SEQ ID NO: 6709 - protein, 55 aa, Homo sapiens
MKDFHFSESRSRRGNFLEFLRMPNHIFITLLWKSMPLHRKSNSGTTKNFQWECLV

SEQ ID NO: 6710 - protein, 52 aa, Homo sapiens [sequence omitted]

SEQ ID NO: 6711 - protein, 53 aa, Homo sapiens
MACECMASASRTHLLFPCSGQTPAGPCVCAPCCSLQLPARVPAKTSTLGKSLR

SEQ ID NO: 6712 - protein, 52 aa, Homo sapiens
MTTLVLDNGAYNAKIGYSHENVSVIPNCQFRSKTARLKTFTANQIDEIKDPS

SEQ ID NO: 6713 - protein, 64 aa, Homo sapiens
MFPVSSGCFQEQQETNKSLTLLRCSQRDTSPLMDGQTWAGSVSLNHPPLPQLPTTDTSDDTPGK

SEQ ID NO: 6714 - protein, 83 aa, Homo sapiens
MSGPNGDLGMPVEAGAEGEEDGFGEAEYAAINSMLDQINSCLDHLEEKNDHLHARLQELLESNRQTRLEFQQQLGEAPSDASP

SEQ ID NO: 6715 - protein, 69 aa, Homo sapiens
MKWTQHVKTILSRSLAVKENRECIISRAWWLTPIIPALWEAKAARSPKVLKNIQTQSRQATFATTWRFV

SEQ ID NO: 6716 - protein, 142 aa, Homo sapiens
  UNSURE 78: Xaa = Pro,Thr
MSLRCGDAARTLGPRVFGRYFCSPVRPLSSLPDKKKELLQNGPDLQDFVSGDLADRSTWDEYKGNLKRQKGERLRLPXWLKTEIPMGKNYNKLKNTLRNLNLHTVCEEARCPNIGECWGGGEYATATATIMVGPASTSMALV

SEQ ID NO: 6717 - protein, 52 aa, Homo sapiens
MWTSLQGCRITWQQAFFKASNPLRRERECMPRIFHNLTPEVISHMSVWFHLM

SEQ ID NO: 6718 - protein, 55 aa, Homo sapiens [sequence omitted]

SEQ ID NO: 6719 - protein, 72 aa, Homo sapiens; identical to SEQ ID NO: 6446

SEQ ID NO: 6720 - protein, 60 aa, Homo sapiens
  UNSURE 49: Xaa =  * ,Leu
MIGAFLKNSLISSEGIKSCFWNLQHQISLQETNRLGCNTVGETDINFFXNIKLPACNPSY

SEQ ID NO: 6721 - protein, 77 aa, Homo sapiens
  UNSURE 38: Xaa = Asp,His,Asn,Tyr
  UNSURE 67: Xaa = Leu,Val
MPVVPALWEAEGGGSRGQEIETILANMVKPLSTKNTKXYPGVVVGACSPSYLGVPRQENFVNLGGGXAVSRDRATAL

SEQ ID NO: 6722 - protein, 84 aa, Homo sapiens [sequence omitted]

SEQ ID NO: 6723 - protein, 111 aa, Homo sapiens
  UNSURE 3: Xaa = Ala,Pro
  UNSURE 2: Xaa = Ala,Ser
  UNSURE 5: Xaa = Lys,Thr
  UNSURE 66: Xaa = Ser,Trp
MXXFXGTLKRLIGDAAKNQVAMNPTNTVFDAKRLIGRRFDDAVVQSDMKHWPFMVVNDAGRPKVQXIIQGRDQKLLSRGGVFYGSDKDEGNCRSLPWEDCYQCCGHSASLL

SEQ ID NO: 6724 - protein, 50 aa, Homo sapiens
MEIPPTNYPASRAALVAQNYINYQQGTPHRVFEVQKVKQASMGGYSRKRT

SEQ ID NO: 6725 - protein, 53 aa, Homo sapiens
  UNSURE 38: Xaa = His,Gln
  UNSURE 39: Xaa = Phe,Ser
MKFHNVCLLEAYNWVKARRPVIRPNVGFWRQLIDYERXXLGSRQLKWYRHLMA

SEQ ID NO: 6726 - protein, 56 aa, Homo sapiens [sequence omitted]

SEQ ID NO: 6727 - protein, 58 aa, Homo sapiens
  UNSURE 21: Xaa = Cys,Phe
MNHVSLVLPRLECSGTILAHXGLCLGFKRFCCLSLPSMDYRTNGRKDFWKQLLVSDPL

SEQ ID NO: 6728 - protein, 50 aa, Homo sapiens [sequence omitted]

SEQ ID NO: 6729 - protein, 51 aa, Homo sapiens
MEMDGSISSRGPHPPSPSPRSCMILHSSIIQFWVINMKRLIDLIVKKVGKC

SEQ ID NO: 6730 - protein, 89 aa, Homo sapiens
MFPERVRSAAGATFDLSLFVAQKMYRFSRAALWIGTTSFMILVLPVVFETEKLQMEQQQQLQQRQILLGPNTGLSGGMPGALPSLPGKI

SEQ ID NO: 6731 - protein, 89 aa, Homo sapiens; identical to SEQ ID NO: 6730

SEQ ID NO: 6732 - protein, 64 aa, Homo sapiens [sequence omitted]

SEQ ID NO: 6733 - protein, 53 aa, Homo sapiens
  UNSURE 6: Xaa = Pro,Arg
MPGIIXYCAAPHSCPPGPHLRPLEAEDLTLLPSSPATWDPHLCCLLPFLRGSA

SEQ ID NO: 6734 - protein, 55 aa, Homo sapiens
MKRSEGTSSRCRGHQLWDTLSFLSGPASWDRPGQQGWCCFLQWPQVSPRRCWPGP

SEQ ID NO: 6735 - protein, 55 aa, Homo sapiens; identical to SEQ ID NO: 6734

SEQ ID NO: 6736 - protein, 118 aa, Homo sapiens
  UNSURE 7: Xaa = Lys,Thr
MWRLRCXAKDGTHVLQGLSSRTRVRELQGQIAAITGIAPGGQRILVGYPPECLDLSNGDTILEDLPIQSGDMLIIEEDQTRPRSSPAFTKRGASSYVRETLPVLTRTVVPSRQLLPLY

SEQ ID NO: 6737 - protein, 72 aa, Homo sapiens
  UNSURE 70: Xaa =  * ,Cys,Trp
  UNSURE 71: Xaa = Ala,Asp,Glu
  UNSURE 55: Xaa = Ala,Asp,Glu,Gly,His,Ile,Lys,Leu,Met,Asn,Pro,Gln,Arg,Ser,Thr,Val
  UNSURE 64: Xaa = Gly,Arg
  UNSURE 42: Xaa = Gly,Trp
MNIAFYTSRTDDILLHQDVDLVCISIPPPLTRQISVKALGIXEECGLREGSNIGXCFREGDSSXYYRSSXXR

SEQ ID NO: 6738 - protein, 69 aa, Homo sapiens
MLNSMNLLSDAVLDCPCCISIISLFSFSLYYYNCSFYMKARKLKLEEHLSATCQFCVSVLYVCVNFPLK

SEQ ID NO: 6739 - protein, 104 aa, Homo sapiens [sequence omitted]

SEQ ID NO: 6740 - protein, 69 aa, Homo sapiens
MGSGTFQFSRNIVVSLGGYISSFGTKTSEPTQHKVMRMGSRNFSSGSLKITHPGRYHQPRYETTPAVLW

SEQ ID NO: 6741 - protein, 140 aa, Homo sapiens [sequence omitted]

SEQ ID NO: 6742 - protein, 64 aa, Homo sapiens; identical to SEQ ID NO: 6313

SEQ ID NO: 6743 - protein, 58 aa, Homo sapiens [sequence omitted]

SEQ ID NO: 6744 - protein, 70 aa, Homo sapiens
  UNSURE 63: Xaa =  * ,Ser,Tyr
MTLMASETGKERRKTEACAHCCSMCTKSSRAEGPSLQPRSEVGTENSPTAQRCGRAQRSSQSXWRKGSRD

SEQ ID NO: 6745 - protein, 71 aa, Homo sapiens
  UNSURE 36: Xaa = Gly,Val
MKSEAKDGERESLQTAFKKLRVDASGSVASLSVGEXTGVRAPVRTATDDTKPKTTCASKDSWHGSTRKSSR

SEQ ID NO: 6746 - protein, 60 aa, Homo sapiens
MGSVRGAPSRGPLECDALLAAGGRLLPGDSTVWDPAGERDHWCLLRRLQEKTGHTSLRLH

SEQ ID NO: 6747 - protein, 67 aa, Homo sapiens
MYYNIAMDLKEIFQTTKYTSEKEEGTPWNEDCGKEKPEEIQDPAALTSDAEQPSGSRSLFLIQTLKT

SEQ ID NO: 6748 - protein, 104 aa, Homo sapiens
MKSCQKMEGKPENESEPKHEEEPKPEEKPEEEEKLEEEAKAKGTFRERLIQSLQEFKEDIHNRHLSNEDMFREVDEIDEIRRVRNKLIVMRWKVNRNHPYPYLM

SEQ ID NO: 6749 - protein, 77 aa, Homo sapiens; identical to SEQ ID NO: 6140

SEQ ID NO: 6750 - protein, 104 aa, Homo sapiens
  UNSURE 98: Xaa =  * ,Asp,Glu,Tyr
  UNSURE 92: Xaa = Asn,Ser
MEPEREGTERHPRKVRESRQAPNKLVGAAEAMKAGWDLEESQPEAKKARLSTILFTDNCEVTHDQLCELLKYAVLGKSNVPKPSWCQLFHQXHLNNVXFLFCRE

SEQ ID NO: 6751 - protein, 136 aa, Homo sapiens
  UNSURE 35: Xaa = Arg,Ser
MSSEPPPPPQPPTHQASVGLLDTPRSRERSPSPLXGNVVPSPLPTRRTRTFSATVRASQGPVYKGVCKCFCRSKGHGFITPADGGPDIFLHISDVEGEYVPVEGDEVTYKMCSIPPKNEKLQAVEVVITHLAQAQA

SEQ ID NO: 6752 - protein, 113 aa, Homo sapiens
MKGLYFQQSSTDEEITFVFQEKEDLPVTEDNFVKLQVKACALSQINTKLLAEMKMKKDLFPVGREIAGIVLDVGSKVSFFQPDDEVVEVLSRLGAVAHVCNPSTLGGQGGRIT

SEQ ID NO: 6753 - protein, 112 aa, Homo sapiens [sequence omitted]

SEQ ID NO: 6754 - protein, 61 aa, Homo sapiens [sequence omitted]

SEQ ID NO: 6755 - protein, 86 aa, Homo sapiens
MAADLNLEWISLPRSWTYGITRGGRVFFINEEAKSTTWLHPVTGEAVVTGHRRQSTDLPTGWEEAYTFEGARYYIKQGLAVAQAGA

SEQ ID NO: 6756 - protein, 68 aa, Homo sapiens
  UNSURE 65: Xaa = Cys,Ser
  UNSURE 66: Xaa = Pro,Arg
MSGHSLARTLLLYLRNMTFLFQRMMMMMTNRNYRKEKALTEENGDALSFSAFPISRKARGRPSAXXVW

SEQ ID NO: 6757 - protein, 69 aa, Homo sapiens
MYVGTMGGRVCFLSWFFPCYFPIEVNACLYFLSKRSRWQNRKLKSPVLGFKKPKNFREIKGFSVMDRLP

SEQ ID NO: 6758 - protein, 117 aa, Homo sapiens
  UNSURE 92: Xaa = Ala,Val
  UNSURE 94: Xaa = Asn,Thr
  UNSURE 96: Xaa = His,Asn
  UNSURE 91: Xaa = Lys,Arg
  UNSURE 93: Xaa = Phe,Leu
  UNSURE 95: Xaa = Pro,Ser
MGGCPVRKRRRNGSKEGNHHSTQPKRNKRNPIFQDSQDTEVFSWSDNERSSSRINIPERASGPEGNLNQIVTEPDANFPQFLHEGYVPMPXXXXXXINQTLKEAHFNSLQQRGQAPT

SEQ ID NO: 6759 - protein, 91 aa, Homo sapiens [sequence omitted]

SEQ ID NO: 6760 - protein, 139 aa, Homo sapiens
  UNSURE 4: Xaa =  * ,Trp
  UNSURE 3: Xaa = Asp,Glu
  UNSURE 8,37: Xaa = Glu,Gln
  UNSURE 32: Xaa = Gly,Arg
MAXXQEVXITEEKPLLPGQTPEAAKEAELAAXILLDXGQTHSVETPYGSVTFTVYGTPKPKRPAILTYHDVGLNYKSCFQPLFQFEDMQEIIQNFVRVHVDAPGMEEGAPVFPLDIRPISGPACRHDPLRPAVPKFLLQ

SEQ ID NO: 6761 - protein, 56 aa, Homo sapiens; identical to SEQ ID NO: 6178
  UNSURE 26: Xaa = Ser,Thr

SEQ ID NO: 6762 - protein, 202 aa, Homo sapiens
  UNSURE 133: Xaa = Ala,Gly
MPERVAPSAQVQQVAARGGAGGGGGGGGGWGGAGGKCCDAVPGRGRRVEAEYQFPSGKAAMAIFSVYVVNKAGGLIYQLDSYAPRAEAEKTFSYPLDLLLKLHDERVLVAFGQRDGIRVGHAVLAINGMDVNXRYTADGKEVLEYLGNPANYPVSIRFGRPRLTSNEKLMLASMFHSCELFDQNLKLALEVAEKAGTFGPGS

SEQ ID NO: 6763 - protein, 56 aa, Homo sapiens; identical to SEQ ID NO: 6178
  UNSURE 26: Xaa = Ser,Thr

SEQ ID NO: 6764 - protein, 52 aa, Homo sapiens
MLSLSRCSLCIFENFLKCSLEQGEVSNLHLFGIEYNPECVTFVLHKGNQPHS

SEQ ID NO: 6765 - protein, 55 aa, Homo sapiens
MFNRYFVFKTGIQHSQPSSDTLLLEVLKQVKVSDMVEDKLDLPEEDITARVNVYV

SEQ ID NO: 6766 - protein, 89 aa, Homo sapiens [sequence omitted]

SEQ ID NO: 6767 - protein, 111 aa, Homo sapiens
  UNSURE 105: Xaa = Ala,Pro
  UNSURE 108: Xaa = Gly,Val
  UNSURE 87: Xaa = Phe,Val
  UNSURE 104: Xaa = Pro,Ser
MISQFFILSSKGDPLIYKDFRGDSGGRDVAELFYRKLTGLPGDESPVVMDYGYVQTTSTEMLRNFIQTEAVVSKPFSLFDLSSVGLXGAETQQSKVAPQQCSQXXRPXQSL

SEQ ID NO: 6768 - protein, 89 aa, Homo sapiens [sequence omitted]

SEQ ID NO: 6769 - protein, 68 aa, Homo sapiens
MDTSRVQPIKLARVTKVLGRTVSQGQCTQVRGIHGRHEPIHHPQCKRPRARGRRAHPFGVRARSPELR

SEQ ID NO: 6770 - protein, 58 aa, Homo sapiens
MVQQNYCFLRCMCSKSQYTHLYNFFLQNLIPNLIFLKIAHVSHVYNMLKYFNCDLKTE

SEQ ID NO: 6771 - protein, 115 aa, Homo sapiens
  UNSURE 85: Xaa = Ile,Asn
MSGGLAPSKSTVYVSNLPFSLTNNDLYRIFSKYGKVVKVTIMKDKDTRKSKGVAFILFLDKDSAQNCTRAINNKQLFGRVIKASXAIDNGRAAEFIRSETTLINLSVMNVGKVDT

SEQ ID NO: 6772 - protein, 97 aa, Homo sapiens [sequence omitted]

SEQ ID NO: 6773 - protein, 68 aa, Homo sapiens [sequence omitted]

SEQ ID NO: 6774 - protein, 54 aa, Homo sapiens
MISQFFILSSKGDPLIYKDFRGDSGGRDVAELFYRKLTGLPGDESPVVMRQRLQ

SEQ ID NO: 6775 - protein, 78 aa, Homo sapiens
  UNSURE 51: Xaa = Ala,Pro
MLSLQQLSGKKQSRVALKERTVSIVLSQEIERKFTSLLLSSSRCLYLGGCXFCLQMGQVAEGWLKQQTHLNSPILQSL

SEQ ID NO: 6776 - protein, 61 aa, Homo sapiens
MLKTASGPSALINNPGHGLTDSFHPESEDHGGAILNSAQRRLPGILMSRSHCSQCDKHSSN

SEQ ID NO: 6777 - protein, 88 aa, Homo sapiens [sequence omitted]

SEQ ID NO: 6778 - protein, 56 aa, Homo sapiens; identical to SEQ ID NO: 6178
  UNSURE 26: Xaa = Ile,Asn,Ser,Thr

SEQ ID NO: 6779 - protein, 135 aa, Homo sapiens
MVLESVARIVKVQLPAYLKRLPVPESITGFARLTVSEWLRLLPFLGVLALLGYLAVRPFLPKKKQQKDSLINLKIQKENPKVVNEINIEDLCLTKAAYCRCWRSKTFPACDGSHNKHNELTGDNVGPLILKKKEV

SEQ ID NO: 6780 - protein, 57 aa, Homo sapiens
MMILQLNNLQMSGREACGGLGVCQQHPTGGAEGESGVSKNRTEPSDKTSRKRGNEAG

SEQ ID NO: 6781 - protein, 69 aa, Homo sapiens
MLSQLGSARTDLSKAFLSRDSSSPLPFNSSSNRYNSCDSCSIKWLWQQQQHKQLSYIIIGIQAASQKVK

SEQ ID NO: 6782 - protein, 108 aa, Homo sapiens [sequence omitted]

SEQ ID NO: 6783 - protein, 83 aa, Homo sapiens
MACAQTGSGKTAAFLLPILAHMMHDGITASRFKELQEPECIIVAPTRELVNQIYLEARKFSFGTCVRAVVIYGGTSWDIQFDK

SEQ ID NO: 6784 - protein, 55 aa, Homo sapiens
MMEGVVTKGHGYWVKFEIVGQLYFQASELRQNIHRKVSSVIFFSPKLRFHEIIYI

SEQ ID NO: 6785 - protein, 50 aa, Homo sapiens
  UNSURE 27: Xaa =  * ,Trp
  UNSURE 11: Xaa = Ala,Gly
  UNSURE 35: Xaa = Lys,Arg
MQMLKLDKENXNRPRRAGRSRPKKQSXRTAASSWXEEQQALQKKLKGTEG

SEQ ID NO: 6786 - protein, 63 aa, Homo sapiens
MINFGEEPPESKIEKKYALYRGRSATNQHCPHLILRLPHCPVTQITRAQTPRILPSNAANRPR

SEQ ID NO: 6787 - protein, 54 aa, Homo sapiens
MDFGFQNILFLAIMSAFYLHIILEYSSANSKRPRLSFKNRGKIPWKNGTEIFVS

SEQ ID NO: 6788 - protein, 70 aa, Homo sapiens
MPVVPALGRPRWADHLRSGVRDQPGQPGEAPPSLLKIQKLAGYGGGCLWSQLLGRLRRENHLSPGGGRLQ

SEQ ID NO: 6789 - protein, 59 aa, Homo sapiens
  UNSURE 3: Xaa = Asp,Glu
MRXKGLFGFHNYLLILCLPDFKIKLFAISFFFSSHKTFGHLQSLFLKSYAVIQTVYSFC

SEQ ID NO: 6790 - protein, 85 aa, Homo sapiens
MWNTGASDDAVSCSVMLEVLRVLSTSSEALHHAVIFLFNGAEENVLQASHGFITQHPWASLIRAFINLEAAGVGGKELVFQTAYD

SEQ ID NO: 6791 - protein, 62 aa, Homo sapiens
MGISRDNWHKRRKTGGKRKPYHKKRKYELGRPAANTKIGPRRIHTVRVRGGNKKYRALRLYS

SEQ ID NO: 6792 - protein, 50 aa, Homo sapiens [sequence omitted]

SEQ ID NO: 6793 - protein, 63 aa, Homo sapiens
MIERIWCTRRTWPEQAERYDEMVESMKKVAGMDVELTVEERKPPMLLAYKKCDWEARRSLLGE

SEQ ID NO: 6794 - protein, 86 aa, Homo sapiens
  UNSURE 10: Xaa = Ala,Pro
MSWFRRPNWXKQAERYDDMAACMKSVTEQGAELSNEERNLLSVAYKNVVGARSHLGGSSQVLNKRRKVLRKNSRWLENTEKKLRRS

SEQ ID NO: 6795 - protein, 95 aa, Homo sapiens
MTELPPTHPIRLGLALNFSVFYYEILNSPDRACLAKAAFDDAIAELDTLSEESYKDSTLIMQLLRDNLTLWTSDMQGDGEEQNKEALQDVEDENQ

SEQ ID NO: 6796 - protein, 98 aa, Homo sapiens [sequence omitted]

SEQ ID NO: 6797 - protein, 76 aa, Homo sapiens
MNTETCAIPTNTLLFSSFIAVTQRKPKTATYSGSQELLKCFPQWLKHFTFPPAMHKSSSFSTFLPIFIFCFFLELL

SEQ ID NO: 6798 - protein, 208 aa, Homo sapiens [sequence omitted]

SEQ ID NO: 6799 - protein, 73 aa, Homo sapiens
MKKKTHKVKEDKKKKKTKNFNPPTRRNWESNYFGMPLQDLVTAEKPIPLFVEKCVEFIEDTGLCTEDSTVSAE

SEQ ID NO: 6800 - protein, 62 aa, Homo sapiens; identical to SEQ ID NO: 6791

SEQ ID NO: 6801 - protein, 93 aa, Homo sapiens
  UNSURE 24: Xaa = Ala,Pro
  UNSURE 27: Xaa = His,Gln
  UNSURE 17: Xaa = Ser,Thr
MEELVGLREGFSGDPVXLQELWGXCPXIRRAIQGGLEWLKQKVFRLGEDWYFLMTLGVLMALVSYAMNFAIGCVVRGFSQSITPSSGVLESRS

SEQ ID NO: 6802 - protein, 86 aa, Homo sapiens
MSQLKRREYICPFLTFVSFKPSKNWMMPDYISEGGSLLGLWTQMLISSEKTLTDMPEIMFYQLSGHPLTQSSGDIKLAITPRKRND

SEQ ID NO: 6803 - protein, 61 aa, Homo sapiens
MDHITLWMDHIWLIHMPTSGCFLGIMTNTDMRLVFFANGLLKGVLKGYDTAICTFHCLESS

SEQ ID NO: 6804 - protein, 114 aa, Homo sapiens
  UNSURE 106: Xaa = Ser,Thr
MAVADLALIPDVDIDSDGVFKYVLIRVHSAPRSGAPAAESKEIVRGYKWAEYHADIYDKVSGDMQKQGCDCECLGGGRISHQSQDKKIHVYGYSMVSRSPVPPCRXPVPASRPT

SEQ ID NO: 6805 - protein, 97 aa, Homo sapiens
MAGELQGTQAPSLRRTGLTSQDSGVNPNNSARGREAMASGSNWLSGVNVVLVMAYGSLVFVLLFIFVKRQIMRFAMKSRRGPHVPVEQCPQGLERGD

SEQ ID NO: 6806 - protein, 93 aa, Homo sapiens
  UNSURE 17: Xaa = Gly,Arg,Trp
  UNSURE 6: Xaa = His,Gln
  UNSURE 84: Xaa = Phe,Ile,Leu,Val
  UNSURE 8,16: Xaa = Ser,Thr
MAGELXGXQAPSLRRXXLTSQDSGVNPNNSARGREAMASGSNWLSGVNVVLVMAYGSLVFVLLFIFVKRQIMRFAMKSRRGPHXPVGTMPPRT

SEQ ID NO: 6807 - protein, 62 aa, Homo sapiens
MRTQLRHTSRKSPLSSPQCCVMQIPFTACLPASLPPSLFPFFLPSFFECYFFPSLNCNTDIW

SEQ ID NO: 6808 - protein, 129 aa, Homo sapiens
  UNSURE 120: Xaa = Ala,Gly
  UNSURE 129: Xaa = Gly,Ser
  UNSURE 111: Xaa = Lys,Thr
  UNSURE 65: Xaa = Phe,Leu
MGISRDNWHKRRKTGGKRKPYHKKRKYELGRPAANTKIGPRRIHTVRVRGGNKKYRALRLDVGNXSWGSECCTRKTRIIDVVYNASNNELVRTKTLVKNCIVLIDSNTVPXVVRVPLCAXPGPQEGSQX

SEQ ID NO: 6809 - protein, 64 aa, Homo sapiens
  UNSURE 61: Xaa = Ala,Pro
MAVSARRNLEAGGRGARAALQVSCALLSPQDKEKKKKESILDLSKYIDKTIRVKFQGGREXVES

SEQ ID NO: 6810 - protein, 101 aa, Homo sapiens
MLPRRIKHKGELSLVCIAEQRISSLQFASLREPHPDLVEMTLHDLDFKLDTVIREDLSCHLWGEDTMLYEKKSEREAVVKSEVTFPRSPKWCSETCSHRWM

SEQ ID NO: 6811 - protein, 98 aa, Homo sapiens
  UNSURE 96: Xaa = His,Gln
  UNSURE 88: Xaa = Met,Arg
MQKQGCDCECLGGGRISHRVRTRRFTCTAIPWPMVLPSTPFQLRKSKPSTPTTRSPGLTTATEHSQPGACCLQQPLQSPRLCLHSSCXAGLLLLRXLW

SEQ ID NO: 6812 - protein, 125 aa, Homo sapiens
MAVADLALIPDVDIDSDGVFKYVLIRVHSAPRSGAPAAESKEIVRGYKWAEYHADIYDKVSGDMQKQGCDCECLGGGRISHQSQDKKIHVYGYSMAYGPAQHAISTEKIKAKYPDYEVTWANDGY

SEQ ID NO: 6813 - protein, 56 aa, Homo sapiens; identical to SEQ ID NO: 6275

SEQ ID NO: 6814 - protein, 99 aa, Homo sapiens [sequence omitted]

SEQ ID NO: 6815 - protein, 71 aa, Homo sapiens [sequence omitted]

SEQ ID NO: 6816 - protein, 56 aa, Homo sapiens; identical to SEQ ID NO: 6275

SEQ ID NO: 6817 - protein, 56 aa, Homo sapiens; identical to SEQ ID NO: 6275

SEQ ID NO: 6818 - protein, 77 aa, Homo sapiens
  UNSURE 32: Xaa = Ala,Thr
  UNSURE 35: Xaa = Ile,Val
MVLAFLSKIRLECSGMISAHCNLHLPDSLASXSRXAGITGVHHHARLTFLFLTGTGFHHVGQAGLELLTNMEEPRLY

SEQ ID NO: 6819 - protein, 51 aa, Homo sapiens
MSHLLYTPKWLKTQIPPSGIFNSSQGYQKSCFWTHNKPWSSKFGIKEMRRG

SEQ ID NO: 6820 - protein, 56 aa, Homo sapiens; identical to SEQ ID NO: 6275

SEQ ID NO: 6821 - protein, 55 aa, Homo sapiens
  UNSURE 13: Xaa = Ala,Pro
  UNSURE 15: Xaa = Glu,Gln
MQWRDLGSPQPPXSXGSSDSPASASQVAGITEHEMMPQLITNSAEAVTDTIIFIS

SEQ ID NO: 6822 - protein, 71 aa, Homo sapiens
  UNSURE 52: Xaa = Met,Arg
MVPTLWARTTDAPHLSLVPPRTTAALRRENNTQRGHRLKTQTRREDGHVNNXQRLKFCAGNQGMPRATRSG

SEQ ID NO: 6823 - protein, 124 aa, Homo sapiens
MAAVLQRVERLSNRVVRVLGCNPGPMTLQGTNTYLVGTGPRRILIDTGEPAIPEYISCLKQALTEFNTAIQEIVVTHWHRDHSGGIGDICKSINNDTTYCIKKLPRNPQRGRNYRKSESNNMFI

SEQ ID NO: 6824 - protein, 69 aa, Homo sapiens
MRSLGLTEEQLRQQLTEWQDLHLKENVPPSLLLLSRTFYLIDVKPKPIEIPLSGRMKTLYSRHQLHHHP

SEQ ID NO: 6825 - protein, 57 aa, Homo sapiens
MDCQKGGNMANGSCLDLKSEESSSAHFDSDGIYQSMFVDMINPKEKVRLMNRRTGVL

SEQ ID NO: 6826 - protein, 103 aa, Homo sapiens
MGQQSSVRRLKRSVPCESNEANEANEANKTMPETPTGDSDPQPAPKKMKTSESSTILVVRYRRNVKRTSPEELVNDHARENRINPDQMEEEEFIEITTERPKK

SEQ ID NO: 6827 - protein, 53 aa, Homo sapiens
MRLSKTKKHVSRAYGGSMCAKCVRDRIKRAFLIEEQKIVVKVLKAQAQSQKAK

SEQ ID NO: 6828 - protein, 57 aa, Homo sapiens
MVLLESEQFLTELTRLFQKCRTSGSVYITLKKYDGRTKPIPKKGTVEGFEPQTTSVC

SEQ ID NO: 6829 - protein, 80 aa, Homo sapiens
MSVPGPSSPDGALTRPPYCLEAGEPTPGLSDTSPDEGLIEDLTIEDKAVEQLAEGLLSHYLPDLQRSKQALQELTTKLYC

SEQ ID NO: 6830 - protein, 74 aa, Homo sapiens
  UNSURE 43: Xaa =  * ,Lys
  UNSURE 42: Xaa =  * ,Phe,Ile,Lys,Leu,Met,Asn,Tyr
MKRENKSFLRLMGAGKKEHTGRLVIGDHKSTSHFPNRGKKTXXINEELESQYQQNYGTVNLSGKISATLWTWLQ

SEQ ID NO: 6831 - protein, 51 aa, Homo sapiens
MGGSGFLRLPPLKQSKLSIMEHSYPKAKAFSTLQEMKASVTHPATVEIEQH

SEQ ID NO: 6832 - protein, 63 aa, Homo sapiens
  UNSURE 23: Xaa = Ile,Lys,Met,Asn,Arg,Ser
MTFKASLGTSYVPDTAIGSGDNXSVQETTVSKKQDFPSKSLLGKPARPADKHSCTGGEPAEAA

SEQ ID NO: 6833 - protein, 55 aa, Homo sapiens [sequence omitted]

SEQ ID NO: 6834 - protein, 100 aa, Homo sapiens
MPKKFQGENTKSAAARARRAEAKAAADAKKQKELEDAYWKDDDKHVMRKEQRKEEKEKRRLDQLERKKETQRLLEEEDSKLKGGKAPRVATSSKVTRAQI

SEQ ID NO: 6835 - protein, 82 aa, Homo sapiens
  UNSURE 71: Xaa =  * ,Ala,Cys,Asp,Glu,Phe,Gly,His,Ile,Lys,Leu,Asn,Pro,Gln,Arg,Ser,Thr,Val,Tyr
  UNSURE 70: Xaa =  * ,Asp,Glu,His,Lys,Asn,Gln,Tyr
  UNSURE 67: Xaa = His,Gln
MFIAALFTIAKTWNQPKCPTMIDWIKKMWHIYAMEYYAAIKKDDFMSFVGTWMKLETIILSKLSQGXKTXXPHVLTHSNLYL

SEQ ID NO: 6836 - protein, 71 aa, Homo sapiens [sequence omitted]

SEQ ID NO: 6837 - protein, 54 aa, Homo sapiens
MDGEPTWCPGKPVYTKEMPTGSGKLPNPSVILQQRPLLLARFETMFNLATSMSQ

SEQ ID NO: 6838 - protein, 66 aa, Homo sapiens
MWGQVRRKKLGASKNLVTQNPDPTRRNTGSHFMASCLCDGPCSWGTLRLGGPRDPVGSVALNLSQH

SEQ ID NO: 6839 - protein, 148 aa, Homo sapiens
MGPEAGLLHSSDDAGGAPATRNCLPDHSGHRPTPPRSHRHHRQENLGSIKPSSRSTKATSTTMAGDGRRAEAVREGWGVYVTPRAPIREGRGRLAPQNGGSSDAPAYRTPPSRQGRREVRFSDEPPEVYGDFEPWWPKKGPRWENEPG

SEQ ID NO: 6840 - protein, 99 aa, Homo sapiens
METAVRGMPLECPPRPERLNAYEREVMVNMLNSLSRNQQLPRITPRCGCVDPLPGRLPFHGYESACSGRHYCLRGMDYYASGAPCTDRRLRLGAGSNRL

SEQ ID NO: 6841 - protein, 89 aa, Homo sapiens
MQVDLGCNFFVDTVVPDTSRIYVALGYGFFLELTLAEALKFIDRKSSLLTELSNSLTKDSMNIKAHIHMLLEGLRELQGLQNFPEKPHH

SEQ ID NO: 6842 - protein, 125 aa, Homo sapiens
MATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTYGTHRFS

SEQ ID NO: 6843 - protein, 51 aa, Homo sapiens
MLGLPLGWLRIMKDRSSASLCGSSFWTPSLWELVFDFKWHVALPCFSDLEK

SEQ ID NO: 6844 - protein, 56 aa, Homo sapiens
MLQELNFGAYLGLPAFLLPLNQEDNTNLARVLTNHIHTGHHSSMFWMRVPWWHQRT

SEQ ID NO: 6845 - protein, 65 aa, Homo sapiens
  UNSURE 31: Xaa =  * ,Leu,Ser
  UNSURE 22: Xaa = Lys,Asn
  UNSURE 65: Xaa = Phe,Ile,Leu,Val
MPPWRPAAPGPPRTPVGRGWRXTPFPCDSAXGAPRCPTEHAPSRPSRCGFWSSCHLLGFGGHQGX

SEQ ID NO: 6846 - protein, 135 aa, Homo sapiens
MATKCGNCGPGYSTPLEAMKGPREEIVYLPCIYRNTGTEAPDYLATVDVDPKSPQYCQDELHHSGWNTCSSCFGDSTKSRTKLVLPSLISSRIYVVDVGSEPGPQSCTRSLSPRTSMPSANWPFSTPATAWPAGK

SEQ ID NO: 6847 - protein, 58 aa, Homo sapiens [sequence omitted]

SEQ ID NO: 6848 - protein, 56 aa, Homo sapiens
  UNSURE 45: Xaa = Ala,Pro
  UNSURE 44: Xaa = Lys,Arg
MPPRLDNFCIFSRDGVSPCWSSWSPTPDLKSSARVGLRKCWDYXXEPPHSTPNHPF

SEQ ID NO: 6849 - protein, 52 aa, Homo sapiens
MKISFRSLVSRIIYQSQREKSAIFLSKSLEKQSFCLVIERSQQSCSVKDQRW

SEQ ID NO: 6850 - protein, 56 aa, Homo sapiens
  UNSURE 46: Xaa = Lys,Arg
MAAVGSLLGRLRQSTVKATDLHSAACTHPPGELTAAGPHSLVCTAXLMHDSTPCCW

SEQ ID NO: 6851 - protein, 112 aa, Homo sapiens
MAAVGSLLGRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSE

SEQ ID NO: 6852 - protein, 78 aa, Homo sapiens
MAAVGSLLGRLRQSTVKATGPALRRLHTSSWRADSSRASLTRVHRQAYARLYPVLLVKQDGSTIHIRYREPRRMLAMP

SEQ ID NO: 6853 - protein, 77 aa, Homo sapiens; identical to SEQ ID NO: 6140

SEQ ID NO: 6854 - protein, 61 aa, Homo sapiens
  UNSURE 53: Xaa =  * ,Arg
MKLFPQKRGSRQVVSSPLKIIVADKYRECNKLEKSLSLGTKPVVPLRDRPGKXASGWRMGG

SEQ ID NO: 6855 - protein, 86 aa, Homo sapiens
MPLIRNGQILAVFVRKTDGSCRLTMDSQILSKVMSTTASAMPDMVLIHIVKFQNQKMIQKDCSGCLVSEEIVYPVWIVSYFLSTKL

SEQ ID NO: 6856 - protein, 111 aa, Homo sapiens
MAFPEPKPRPPELPQKRLKTLDCGQGAVRAVRFNVDGNYCLTCGSDKTLKLWNPLRGTLLRTYSGHGYEVLDAAGSFDNSSLCSGGGDKAVVLWDVASGQSCANSGATQGR

SEQ ID NO: 6857 - protein, 79 aa, Homo sapiens [sequence omitted]

SEQ ID NO: 6858 - protein, 104 aa, Homo sapiens
  UNSURE 76: Xaa = Ile,Asn,Thr
  UNSURE 75: Xaa = Phe,Leu
MASWLYWGTWVNPVGSMYIQKIVNQTYLFIGSILICATVLQMKSNEHICSKQAKLCTFGLWENWKIAVYLIYIYXXSVGLWENWEIAVSLHIFYFCFAKSAFIK

SEQ ID NO: 6859 - protein, 56 aa, Homo sapiens
MQEDCLRQIVRDQPGQRGVTSSLQKISWVWWCTPVVPATWEAEAGGLLGTGGLRLQ

SEQ ID NO: 6860 - protein, 59 aa, Homo sapiens
  UNSURE 38: Xaa = Gly,Trp
MPDKAKLAERATSHLCNLPPPAGRFVFASCEEPRRHHXHKSTHLYLFVWNITHVCFYNK

SEQ ID NO: 6861 - protein, 54 aa, Homo sapiens
MAAVAAASAELLIIGWYIFRVLLQVFRYSLQKLAYTVSRTGRQVLGERRQRAPN

SEQ ID NO: 6862 - protein, 64 aa, Homo sapiens [sequence omitted]

SEQ ID NO: 6863 - protein, 60 aa, Homo sapiens
MGFKKNVPNQNNLICIRLSTYPNSVIVTDLNYYYFLTYHQECSGRLGAVAHACNPSTLVG

SEQ ID NO: 6864 - protein, 72 aa, Homo sapiens
  UNSURE 69: Xaa = His,Gln
  UNSURE 72: Xaa = Ile,Lys,Leu,Pro,Gln,Arg,Thr
MVEKQESENSCNKEEEPVFTRQDSNRSEKEATPVVHETEPESGSQPRPAVLSGYFKQFQKSLPPRFQRXRNX

SEQ ID NO: 6865 - protein, 132 aa, Homo sapiens
MAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERYRVEYEALCKVEAEQNEFIDQFIFQK

SEQ ID NO: 6866 - protein, 53 aa, Homo sapiens
  UNSURE 48: Xaa = Lys,Gln
MTSRKKVLLKVIILGDSGVGKTSLMNQYVNKKFSNQYKATIGADFLTXGGDGG

SEQ ID NO: 6867 - protein, 109 aa, Homo sapiens
MPTGKQLADIGYKTFSTSMMLLTVYGGYSAVSESTTISSGAGPSARPQKNRRPQESCRTGGLFLLSREAQGMLWRDFTCHHFQVNRTRALMVFKPCWKKVPMVSLVLPV

SEQ ID NO: 6868 - protein, 57 aa, Homo sapiens
MPTGKQLADIGYKTFSTSMMLLTVYGGYLCSVRVYHYFQWRRAQRQAAEEQKTSGIM

SEQ ID NO: 6869 - protein, 57 aa, Homo sapiens; identical to SEQ ID NO: 6868

SEQ ID NO: 6870 - protein, 87 aa, Homo sapiens
  UNSURE 42: Xaa = Arg,Ser
  UNSURE 85: Xaa = Arg,Thr
MPGFSRAPRWVALPPQDTGLGPPLQNRFEAKQWHVAVQLSRXLSRDPIQDLTFYVVVIVLPPEAPLGCDHFSDFYFDENILMTLXSF

SEQ ID NO: 6871 - protein, 146 aa, Homo sapiens
MAEPASVAAESLAGSRARAARTVLGQVVLPGEELLLPEQEDAEGPGGAVERPLSLNARACSRVRVVCGPGLRRCGDRLLVTKCGRLRHKEPGSGSGGGVYWVDSQQKRYVPVKGDHVIGIVTAKSGDIFKVDVGGSEPASFVLLVI

SEQ ID NO: 6872 - protein, 94 aa, Homo sapiens
  UNSURE 77: Xaa = Asp,Glu
MGWTNARLCCQHPTPEMSLPPPHRTCKKAAPEPCSLPISPPIKNISWSRLTKPKCGLQSSCSSITKESKGGFGTEAXSHLHIQPLPVQTPVVFQ

SEQ ID NO: 6873 - protein, 53 aa, Homo sapiens
  UNSURE 5: Xaa = Asp,Glu
MQVPXCLSPASTPVNDHRSLIHNHCAWRLEYGVVNGIQKGRSTVAWDFLVLLL

SEQ ID NO: 6874 - protein, 129 aa, Homo sapiens
  UNSURE 121: Xaa =  * ,Gly,Arg
  UNSURE 127: Xaa =  * ,Leu,Ser,Trp
MHTSLPDIYAAGDICTTSWQLSPVWQQMRLWTQARQMGWYAAKCMAAASSGDSIDMDFSFELFAHVTKFFNYKVVLLGKYNAQGLGSDHELMLRCTKGQEYIKVVMQNGRMMGAFLIGETXFRRNIXKT

SEQ ID NO: 6875 - protein, 71 aa, Homo sapiens
  UNSURE 64: Xaa = Ile,Asn,Ser,Thr
MNPKIQETQRAPRRINIDSGQVQWLTPIIPALWEAEVGGSQGHEIKTSLTNMVKPVSTKNTKIXWAQWHAL

SEQ ID NO: 6876 - protein, 73 aa, Homo sapiens
MAASMHGQPSPSLEDAKLRRPMVIEIIEKNFDYLRKEMTQNIYQMATFGTTAGFSGIFSNFLFRRCFKVNMML

SEQ ID NO: 6877 - protein, 88 aa, Homo sapiens
MTGSGVDARTASSGSSVWEGQLQSLVLSEYASTEMSLHALYMHQLHKQQAQAEPERHVWHRGRVMRVEKAPLMKGERAPGPPVYPSLC

SEQ ID NO: 6878 - protein, 52 aa, Homo sapiens
  UNSURE 28: Xaa =  * ,Lys
MRMYYFYNKRKFLKEKKLKKKKASLVRXGMVFSSLRHVNDKGLFKKQKNTAI

SEQ ID NO: 6879 - protein, 51 aa, Homo sapiens
MVLQMRKQSPEKGSDLLGTTVLFTQATFQASAMCCPQDGEGTILNILPLIS

SEQ ID NO: 6880 - protein, 59 aa, Homo sapiens
  UNSURE 40: Xaa = Ala,Asp,Glu,Val
MPMSVEEGPECQGPVVDRRCPRCGHEGMAYHTRQMRSADXGQTVFYTCTNCKFQEKEDS

SEQ ID NO: 6881 - protein, 93 aa, Homo sapiens
MKRQGKVVPEPMRCIYGEGYVRSCDAEEHSYFQATAGQEGNHHDFVPFRIGISSVKQKQSQNEGSSGVMGTADDIKSLKLRIVNCLWVGLESS

SEQ ID NO: 6882 - protein, 104 aa, Homo sapiens
  UNSURE 13: Xaa = Asp,His
MDTTTGLGTLLKXPRTEQCGRAFQVREGAGAVRQCRAGHHAPAPRLLETLTWLSETQESFLVASSEYPCSSNLNECHNLYFFYILQLSEKVNFDKFPATGLFCA

SEQ ID NO: 6883 - protein, 64 aa, Homo sapiens [sequence omitted]

SEQ ID NO: 6884 - protein, 112 aa, Homo sapiens
MKRIPQNPRYQHIKSRLDTGNSMTKYTEKLEEIKKNYRYKKDELFKRLKVTTFAQLIIQVASLSDQTLEVTAEEIQRLEDNDSAASDPDAETTARTNGKGIQVSSRRALSSS

SEQ ID NO: 6885 - protein, 126 aa, Homo sapiens
MSVMDLANTCSSFQSDLDFCSDCGSVLPLPGAQDTVTCIRCGFNINVRDFEGKVVKTSVVFHQLGTAMPMSVEEGPECQGPVVDRRCPRCGHEGMAYHTRQMRSADEGQTVFYTCTNCKFQEKEDS

SEQ ID NO: 6886 - protein, 66 aa, Homo sapiens
  UNSURE 21: Xaa = Glu,Gln
  UNSURE 22: Xaa = Leu,Arg
MTQHNQHLQTENTQPRAQALXXADPKSSLQACSLVPGPREHRFAALTFILPCTERSRCLFPGLRGK

SEQ ID NO: 6887 - protein, 67 aa, Homo sapiens [sequence omitted]

SEQ ID NO: 6888 - protein, 54 aa, Homo sapiens
  UNSURE 12: Xaa = Ala,Gly
  UNSURE 42: Xaa = Ala,Pro,Ser,Thr
  UNSURE 8: Xaa = Asn,Thr
MNFQENVXLAMXLVHHPDLHLFLQQGSAVRRHRTSPHKSPAXPSAIALRPDKCN

SEQ ID NO: 6889 - protein, 117 aa, Homo sapiens
MKPGKAGLEEPLEQIHKIRITLSSKNVKNLEKVCTDLVRGAKDKRLRVKGPVRMPTKVLKITTRKAPCGEGTNTWDRFELRVHKRVIDLFSSPDVVKQITSITIEPGVEVEVTIADS

SEQ ID NO: 6890 - protein, 78 aa, Homo sapiens
MPVHSRGDKKETNHHDEMEVDYAENEGSSSEDEDTESSSVSEDGDSSEMDDEDCERRRMECLDEMSNLEKQFTDLKDQ

SEQ ID NO: 6891 - protein, 50 aa, Homo sapiens
MDISTRSKDPGSAERTAQKRKFPSPPHSSNGHSPQTHQQAPLKRKRNLAY

SEQ ID NO: 6892 - protein, 57 aa, Homo sapiens [sequence omitted]

SEQ ID NO: 6893 - protein, 75 aa, Homo sapiens
  UNSURE 51: Xaa =  * ,Ala,Glu,Gly,Lys,Leu,Met,Pro,Gln,Arg,Ser,Thr,Val,Trp
  UNSURE 25: Xaa =  * ,Tyr
  UNSURE 8: Xaa = Ala,Glu
  UNSURE 30: Xaa = Ala,Gly
  UNSURE 50: Xaa = Ala,Ser,Thr
  UNSURE 34: Xaa = Arg,Thr
  UNSURE 44: Xaa = Glu,Lys
  UNSURE 40: Xaa = Glu,Val
  UNSURE 59: Xaa = His,Asn
  UNSURE 18: Xaa = Ile,Thr
  UNSURE 37: Xaa = Lys,Arg
  UNSURE 21,29: Xaa = Lys,Gln
  UNSURE 7: Xaa = Lys,Thr
  UNSURE 47: Xaa = Phe,Leu
MARSRLXXTSTSRVQVIXLPXPPEXLVLXXPATXPGXFFXFLVXTGXHCXXPGQSRTPXLVIRPPWPPKVLGLQA

SEQ ID NO: 6894 - protein, 61 aa, Homo sapiens
MLTGRHMVRDVSCKNCNSKLGWIYEFATEDSQRYKEGRVILERALVRESEGFEEHVPSDNS

SEQ ID NO: 6895 - protein, 76 aa, Homo sapiens
MFGVYDNIGILGNFEKHPKELIRGPIWLRGWKGNELQRCIRKRKMVGSRMFADDLHNLNKRIRYLYKHFNRHGKFR

SEQ ID NO: 6896 - protein, 95 aa, Homo sapiens
  UNSURE 28: Xaa =  * ,Ser,Tyr
MAAEAFGANWERSTRFLEHGQRRQEQAXIRGFESYGSSSYGGAGGYTQSPGGFGSPAPSQAEKKSRARAQHIVPCTISQLLSATLVDEVFRIGNV

SEQ ID NO: 6897 - protein, 100 aa, Homo sapiens [sequence omitted]

SEQ ID NO: 6898 - protein, 53 aa, Homo sapiens [sequence omitted]

SEQ ID NO: 6899 - protein, 69 aa, Homo sapiens
MMGTYGNLLSLVGEWLSKLWYIHTMGYDSTIKRNCPDFTTMQYMHDFKLPNLMSSPGWSGGTNHRPLTS

SEQ ID NO: 6900 - protein, 54 aa, Homo sapiens
MVASGCCHPRGLRKASLETWRGPDLRAASRSCHSTSWFPLRMWLYPSPRRSGTV

SEQ ID NO: 6901 - protein, 70 aa, Homo sapiens
  UNSURE 42: Xaa = Gly,Ser
MIFFSFETVCSVAQDGVQCSGAILQPPPLEFKRFSCLSLPSXWDYRRAPPHPDDLFKCKMPSTQKIKESA

SEQ ID NO: 6902 - protein, 89 aa, Homo sapiens
MKEIGSNCLNNEFNFFKRHICDANKEGMFLFRAARKLRQFLKMNSTGDFDLHLLKVSEGTTILLNCTGQVKGRKPAALGEANQQQFGRK

SEQ ID NO: 6903 - protein, 63 aa, Homo sapiens
  UNSURE 15: Xaa = Lys,Gln
MLNRLVQTQVREERXRKHILAAHQIIHSYTESMVQKKLTEGEQDEASNAAMLLEKETQNENNS

SEQ ID NO: 6904 - protein, 62 aa, Homo sapiens [sequence omitted]

SEQ ID NO: 6905 - protein, 62 aa, Homo sapiens
MIRSKFRVPRILHVLSAHSQASDKNFTAENSEVVVSSRTDVSPMKSDLLLPPSKPGCNNVLN

SEQ ID NO: 6906 - protein, 54 aa, Homo sapiens [sequence omitted]

SEQ ID NO: 6907 - protein, 73 aa, Homo sapiens [sequence omitted]

SEQ ID NO: 6908 - protein, 61 aa, Homo sapiens [sequence omitted]

SEQ ID NO: 6909 - protein, 75 aa, Homo sapiens
MRAEACLTDLQQGCGYHVLSRGCRWAVGLDLAAAMDSSSKYGNFERYHQETKVHQKHPENYQVYENGSGSKICPS

SEQ ID NO: 6910 - protein, 91 aa, Homo sapiens
MPSPPLANSNHESPVNQLGNMQNMRLGPSFILTGIFLGNGRTEASPFFTDEFALSKIFPEYKRNLFGKFQTNILCKVSYTSERSSWKLPDT

SEQ ID NO: 6911 - protein, 93 aa, Homo sapiens
MPSPPLANSNHESPVNQLGNMQNMRLGASFILTGIFLGNGRTEASPFFTDEFALSKIFPEYKRNLFGKFQTNMAFSLELDPPSLLLSVVLFMF

SEQ ID NO: 6912 - protein, 153 aa, Homo sapiens
MEPLYQAGSILMTVNTLQGKKMIESGLQSGDFSLSQSWPSCLPPPADLEILQQKVAGVQRELEDFKKEALKSIHYLEDAFCEMNGALVQQEEQAARVRQRLREEEDRGIVRNKVLTFLLPREKQLREHCKRLEDLLLDRGRDALRATKKSQAD

SEQ ID NO: 6913 - protein, 212 aa, Homo sapiens
MRHQGTQKSDVPPLTTKGKKATGNIDHKEKSTEINHEIPHCVNKLPKQEDSKRKYEDLSGEEKHLEVQILLENTGRQKDKKEDQEKKNIFVKEEQELPPKIIEVIHPERESNQEDVLVREKFKRSMQRNGVDDTLGKGTAPYTKGPLRQRRHYSFTEATENLHHGLPASGGPANAGNMRYSHSTGKHLSNREEMELEHSDSGYEPHLVSLPE

SEQ ID NO: 6914 - protein, 54 aa, Homo sapiens
MHFKIHQPCISKLSGWLRTLHGFSPEPKSCPSDESWSVVHSLSGKKMIFTPCME

SEQ ID NO: 6915 - protein, 105 aa, Homo sapiens
  UNSURE 48: Xaa = Asp,Glu
  UNSURE 47: Xaa = Cys,Phe,Ser,Tyr
  UNSURE 49: Xaa = Ile,Lys,Met,Asn,Arg,Ser,Thr
  UNSURE 50: Xaa = Ser,Thr
MEKKVVFSTISLGKCSVLDNITTDKILIDVFDGPPLYDDVKVQFFFXXXXLHTMTIAHFTSGCTHLLLKITGFIYQKMNWIIYINKKHGEFIHQILPWRYFLARK

SEQ ID NO: 6916 - protein, 52 aa, Homo sapiens
  UNSURE 10: Xaa = Pro,Thr
MQSQRYSNVXASHNLSWGIQLPPRVNTGIPDDSLPLSYRAACCYIPLKSLQS

SEQ ID NO: 6917 - protein, 62 aa, Homo sapiens
  UNSURE 2: Xaa = Cys,Gly
  UNSURE 62: Xaa = His,Gln
MXQQDNNGNVGPLTNRVKQIAIAFQYHQNIFNNSSSKDLLCSNSLTRTSPSNTEDNNEMFSX

SEQ ID NO: 6918 - protein, 88 aa, Homo sapiens [sequence omitted]

SEQ ID NO: 6919 - protein, 72 aa, Homo sapiens
MHSRQIMQLNEQLKAVYEFQDLKDTIERAKNEADLLLEDLQEEIDLQSSVLNASIAGLLRKHQEILSHIIIC

SEQ ID NO: 6920 - protein, 68 aa, Homo sapiens
MAPAGMSGAQDNSCLYQEIAPSFQRLPCPRYLMSCPWQFSTPDVGLTPIRLPFLCGKTEPRRDISQKP

SEQ ID NO: 6921 - protein, 69 aa, Homo sapiens
MTCPCGWRLSRVAQEAQGPGVACKGREQLFSRKDPKGSKAKGAICFPTDSEDKQEKCPVSPILLVLIFQ

SEQ ID NO: 6922 - protein, 69 aa, Homo sapiens
  UNSURE 61: Xaa = Pro,Arg
MTCPCGWRLSRVAQEASRAGVACKGREQLFSRKDPKGSKAKGAICFPTDSEDKQEKCPVSXILLVLIFQ

SEQ ID NO: 6923 - protein, 57 aa, Homo sapiens [sequence omitted]

SEQ ID NO: 6924 - protein, 113 aa, Homo sapiens
  UNSURE 97: Xaa = Pro,Gln
MSPELSGIHSIYSAWVTSVNITDCKPPSISGAAHQGPTAPGRMVRILANGEIVQDDDPRVRTTTQPPRGSIPRQSFFNRGHGAPPGVLAPASSRQVXGWVLLSPPSMTSTGSW

SEQ ID NO: 6925 - protein, 121 aa, Homo sapiens [sequence omitted]

SEQ ID NO: 6926 - protein, 70 aa, Homo sapiens
  UNSURE 38: Xaa = Gln,Arg
MDSHSSDYSATLKADPETKIHLQVIHLQGKLSSVGGKXKTVESTEPWTVTQRMSTRSSLLCHSVLKIFLR

SEQ ID NO: 6927 - protein, 57 aa, Homo sapiens [sequence omitted]

SEQ ID NO: 6928 - protein, 79 aa, Homo sapiens
  UNSURE 71: Xaa = Ala,Pro
  UNSURE 70: Xaa = Asp,Glu
MRYNEKELQALSRQPAEMAAELGMRGPKKGSVLKRRLVKLVVNFLFYFRTDEAEPVGALLLERCRVVREXXRHLLHQLH

SEQ ID NO: 6929 - protein, 57 aa, Homo sapiens
MVSHCVTQAGLKPLAPSNLPASASQSAGITGMSHHASPCELICKNGTMKTPRPTHLP

SEQ ID NO: 6930 - protein, 99 aa, Homo sapiens
  UNSURE 97: Xaa = Pro,Thr
MEGVCGRLPRTPRRALFLLELEPAPGVFLGARALPLNGLCLQTICCADHEPSPQCQTDSSSGPAVPLGPLRKAQKPGTPNRVQLLPTALLGAAHLVXCV

SEQ ID NO: 6931 - protein, 118 aa, Homo sapiens
MAAIGVHLGCTSACVAVYKDGRAGVVANDAGDRVTPAVVAYSENEEIVGLAAKQSRIRNISNTVMKVKQILGRSSSDPQAQKYIAESKCLVIEKNGKLRYEIDTGEEQNLLTQKMLPD

SEQ ID NO: 6932 - protein, 75 aa, Homo sapiens
  UNSURE 74: Xaa = Glu,Gln
MADGQVAELLLRRLEASDGGLDSAELAAELGMEHQAVVGAVKSLQALGEVIEAELRSTKHWELTAEGEEIAREXP

SEQ ID NO: 6933 - protein, 104 aa, Homo sapiens
MQFDHNAGQSRASLSHSSHSSQSSSKERAPLFTPSHPQQTDRTGPSPGSPGTNRKKKWFTDEPDNAYPRNIQIKPMSTHMANQINQYKSTSSLIPPIREVEDEC

SEQ ID NO: 6934 - protein, 84 aa, Homo sapiens
MVVSFDPSREYVVDIRITWGDFTKHLCLGFFGANRKKNEELCTMVTKEPQHDFRPSAPSITCFTMSDPVWRSPPSAGEPGRRSP

SEQ ID NO: 6935 - protein, 57 aa, Homo sapiens [sequence omitted]

SEQ ID NO: 6936 - protein, 57 aa, Homo sapiens
  UNSURE 55: Xaa = Phe,Val
MSSGGSPGCLRLAEGCPNHRAWVRWNKRQPHSAFLIASHLFLSVLVWFNSFRVGXGK

SEQ ID NO: 6937 - protein, 59 aa, Homo sapiens
MNMYIIKSLYFGLSETDYLFSSPHDGSLSCFQLLKFHNYPQIWMCPSKGLAMSTSPAES

SEQ ID NO: 6938 - protein, 81 aa, Homo sapiens
  UNSURE 61: Xaa =  * ,Cys,His,Lys,Asn,Pro,Gln,Arg,Ser,Thr,Trp,Tyr
  UNSURE 63: Xaa = Asn,Ser
  UNSURE 60: Xaa = Glu,Val
  UNSURE 68: Xaa = His,Pro,Gln,Arg
  UNSURE 57: Xaa = Ile,Lys,Met
  UNSURE 65: Xaa = Met,Val
  UNSURE 78: Xaa = Pro,Ser
  UNSURE 62: Xaa = any one of the twenty amino acids
MSVGFIGAGQLAFALAKGFTAAGVLAAHKIMASSPDMDLATVSALRKMGVKLTPHNXETXXXXDXLFXAVKHTSSPSXWMK

SEQ ID NO: 6939 - protein, 70 aa, Homo sapiens
MEEKGSSMTDGAPLVKIKQSLTKLKQETVEMDIRIGIVEHTLLQSKLKEKSNMTRNMHATVIPEPATGFY

SEQ ID NO: 6940 - protein, 50 aa, Homo sapiens
  UNSURE 5: Xaa =  * ,Gly
  UNSURE 8: Xaa = Glu,Gly
  UNSURE 13: Xaa = Gly,Arg
  UNSURE 12: Xaa = Ile,Leu,Met
MPSDXGLXEERXXALVHTRWSRSPTPRELATKPKVQQPRLKRRFHFSQTT

SEQ ID NO: 6941 - protein, 65 aa, Homo sapiens
MIAGPVECGERGGSFFPRGPCQGLLQSQWVPSPKPSSPGGKRFSSPWERGSWKWLWAFLGEALTE

SEQ ID NO: 6942 - protein, 74 aa, Homo sapiens [sequence omitted]

SEQ ID NO: 6943 - protein, 62 aa, Homo sapiens
MISAHCNLHLPDSLASASRVAGITGVHHHARLTFLFLTGTGFHHVGQAGLELLTNMEEPRLY

SEQ ID NO: 6944 - protein, 80 aa, Homo sapiens [sequence omitted]

SEQ ID NO: 6945 - protein, 65 aa, Homo sapiens
  UNSURE 65: Xaa = Arg,Thr
  UNSURE 62: Xaa = Asn,Ser,Thr
  UNSURE 54: Xaa = Asp,His
  UNSURE 12: Xaa = Gln,Arg
MIISRHLPSVSXLPFHPQLHPQQMIISRHLPSVCGGRFHPQRMIISRHLPSVSXSPSTLSSXLSX

SEQ ID NO: 6946 - protein, 69 aa, Homo sapiens
MLPVIRSTTGGDSVQTCTNPLDTFFPFDPCVLKRSKKFIDPIYQVWEDMSAEELQEFKKPMKKLFWRIM

SEQ ID NO: 6947 - protein, 59 aa, Homo sapiens
MRGCVGAQVEGGDLGVQTAGKPGSPSSTPSSPSTHLPNWDILKLFTPKRKKNVIFRYIL

SEQ ID NO: 6948 - protein, 59 aa, Homo sapiens; identical to SEQ ID NO: 6947

SEQ ID NO: 6949 - protein, 59 aa, Homo sapiens; identical to SEQ ID NO: 6947

SEQ ID NO: 6950 - protein, 59 aa, Homo sapiens; identical to SEQ ID NO: 6947

SEQ ID NO: 6951 - protein, 59 aa, Homo sapiens; identical to SEQ ID NO: 6947

SEQ ID NO: 6952 - protein, 59 aa, Homo sapiens; identical to SEQ ID NO: 6947

SEQ ID NO: 6953 - protein, 66 aa, Homo sapiens
MLHPRPESEIGRPATPPHRGIRSSHPEWPVRRLNCDFEAVSATRQPSSEQDSGFLKAVIGGPLQRC

SEQ ID NO: 6954 - protein, 53 aa, Homo sapiens
MGVKMNSADFLPDSSPFSVFRLLHHVLVPGSVKGLLFGWKKPLEKLLKSHVHK

SEQ ID NO: 6955 - protein, 66 aa, Homo sapiens
MFSSRATHFLPPIADSTSLRTKEPDTSFNPETLQPYSSAKIPKTSCLGSNTLFTTINSLFCFVYVI

SEQ ID NO: 6956 - protein, 156 aa, Homo sapiens
METVNEPETGEVSKDAVIVKQEKNNEYCLQDIDDKLSESAEDDGEDDTNDEDDDEDSNPKKNTQAPLELMAEFLRAEMAREYQLAKKLCQMILIYEPENPEAKEFFTLIEEMLLMEKTQNHEQDGENSDEDSSGESKGESDEELSDESSDEGEDGS

SEQ ID NO: 6957 - protein, 72 aa, Homo sapiens
MLIHTDLENTGITSHMWWRGNQDDYQLVRKLGRGKYSEVFEAINITNNEKVVVKILKVSTRDNFRGIWNIDF

SEQ ID NO: 6958 - protein, 59 aa, Homo sapiens
MSASQTYWCLASSKAVLTTASAESWTHWATSCQCWLPSGRATMSCRLMATAAATPAWEE

SEQ ID NO: 6959 - protein, 91 aa, Homo sapiens
  UNSURE 25: Xaa = Arg,Thr
MISAAQLLDELMGRDRNLAPDEKRXTCGGTTRAFVNIISVVFVLRNCSQIHVLILMYLEEEITLEMSANFWKMTSGWRSSSKRNRAEQPVP

SEQ ID NO: 6960 - protein, 76 aa, Homo sapiens
  UNSURE 25: Xaa = Arg,Thr
MISAAQLLDELMGRDRNLAPDEKRXTCGGTTRAFVNIISVVFVLRNCSQIHVLILVRVKKFMMKIYENSMRRALVS

SEQ ID NO: 6961 - protein, 55 aa, Homo sapiens
  UNSURE 45: Xaa = Lys,Asn
MKVGYERDFLRYLQSLLAEVERRIRRGHARLALSQNQQSSGAAGXQAKMKKKFRF

SEQ ID NO: 6962 - protein, 110 aa, Homo sapiens
  UNSURE 99: Xaa = Ala,Glu,Val
  UNSURE 5,11: Xaa = Asp,Glu
MIESXNLNQEXIIKELCLCNGLSYEMVGQEGSDTSKLEMFFLGYPRIVGLSLFPNLTSLTIVAQDIKEISGLEPCLQLKELWIAECCIEVSVNIKPHMXYFILNYLALEK

SEQ ID NO: 6963 - protein, 50 aa, Homo sapiens [sequence omitted]

SEQ ID NO: 6964 - protein, 70 aa, Homo sapiens
MVSNHMCFLQLFLLFWPNNPKNPYHSTKLDHHLCTHFDYEYTTTLHFCLHHVFQETRLLLSRVNLSVKKM

SEQ ID NO: 6965 - protein, 60 aa, Homo sapiens
MNVGTMFNLRMANCPRSLNLFGAYQLREKFEDAAKPSPANPSTPPTSILMGIVLGCAEDL

SEQ ID NO: 6966 - protein, 70 aa, Homo sapiens [sequence omitted]

SEQ ID NO: 6967 - protein, 54 aa, Homo sapiens [sequence omitted]

SEQ ID NO: 6968 - protein, 50 aa, Homo sapiens
MPTNSQKREIVISNKNVGRAQWLTPVIPALWEARVGGSLESRSSRPTLAI

SEQ ID NO: 6969 - protein, 104 aa, Homo sapiens
MLWVQRKRRRKETSECPSDKDKSPESHKAKNESWIKSHFSRLSEEKLALDNNASASGNATQTESGSEEVSSTVHIETFTTRHGEVGSALHRESFTAGRRHLGPQ

SEQ ID NO: 6970 - protein, 68 aa, Homo sapiens [sequence omitted]

SEQ ID NO: 6971 - protein, 65 aa, Homo sapiens
MAPVLPSVLKLPVRSLTYFSARKGKRKTVKAVIDRFLRLHCGLWVRRKAGYKKKLWKKTPARRSD

SEQ ID NO: 6972 - protein, 84 aa, Homo sapiens
  UNSURE 49: Xaa = Asp,His
MASGLVRLLQQGHRCLLAPVAPKLVPPVRGVKKGFRAAFRFQKELERQXFCGARRRPCAVQRSRTGITMQKYKLLDIGYRKTFP

SEQ ID NO: 6973 - protein, 78 aa, Homo sapiens
MGRMAGLQSDFTLNHSGWGLFLILPHKATIVETWLCSCDEARQRNGFWDQSESSMYVYVTRPNLRAFSHVLFSQNHWG

SEQ ID NO: 6974 - protein, 66 aa, Homo sapiens [sequence omitted]

SEQ ID NO: 6975 - protein, 55 aa, Homo sapiens
  UNSURE 51: Xaa = Ala,Asp,Gly,Val
  UNSURE 50: Xaa = Lys,Pro,Gln,Arg,Thr
MKGFKGQLSRQVADQMWQSGKRQASRAFRLYANIDILRPYFDVEPAQVRXXSWSP

SEQ ID NO: 6976 - protein, 94 aa, Homo sapiens
  UNSURE 44: Xaa = Gly,Trp
  UNSURE 42: Xaa = His,Asn
  UNSURE 48: Xaa = Lys,Thr
  UNSURE 47: Xaa = Pro,Ser
MSSYTRKEPGGGTKSLDCKIEESAETPALEDSSSSPVDSQQXSXQVXXDIENTERDMREMKNLLSKLRETMPLPLKNQGESCHFSLRQRMFLMG

SEQ ID NO: 6977 - protein, 75 aa, Homo sapiens [sequence omitted]

SEQ ID NO: 6978 - protein, 56 aa, Homo sapiens
MMALCTKFLQTIIICIVCSAIYLAVNHVLHCDISYSEPLCMCLCSALNYSMPVPYS

SEQ ID NO: 6979 - protein, 56 aa, Homo sapiens; identical to SEQ ID NO: 6178
  UNSURE 26: Xaa = Ser,Thr

SEQ ID NO: 6980 - protein, 123 aa, Homo sapiens
  UNSURE 122: Xaa = Ala,Pro,Ser,Thr
  UNSURE 99: Xaa = Gly,Trp
MASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVXLRMGNGALHGDHQRFSTFAGFLXL

SEQ ID NO: 6981 - protein, 141 aa, Homo sapiens
MNARGLGSELKDSIPVTELSASGPFESHDLLRKGFSCVKNELLPSHPLELSEKNFQLNQDKMNFSTLRNIQGLFAPLKLQMEFKAVQQVQRLPFLSSSNLSLDVLRGNDETIGFEDILNDPSQSEVMGEPHLMVEYKLGLL

SEQ ID NO: 6982 - protein, 141 aa, Homo sapiens; identical to SEQ ID NO: 6981

SEQ ID NO: 6983 - protein, 56 aa, Homo sapiens
MLSIKCHLTCFAHLIFITLSSFSRNDFWQLTGSTLSVHTVPNSALSTLLGFSTTIL

SEQ ID NO: 6984 - protein, 76 aa, Homo sapiens
MREDGSLATFLGRRHLLLRRCGIPKELTVLIGIAEKAGDMKAIVEVTSGRGDLIVAHKRTGIVNHITSLKNLIVII

SEQ ID NO: 6985 - protein, 76 aa, Homo sapiens; identical to SEQ ID NO: 6984

SEQ ID NO: 6986 - protein, 64 aa, Homo sapiens
MQLKYHEKAADKGVYIIGSSGFDSIPADLGVIYTRNKMNGTLTAVESFLTIHSGPEGLSIHDGT

SEQ ID NO: 6987 - protein, 70 aa, Homo sapiens
MGDIPAAVNAFQEAASLLGKKYGETANECGEAFFFLWEITSGVRKNGEWCVGKRLGRCACGRGRRRKNRR

SEQ ID NO: 6988 - protein, 81 aa, Homo sapiens
  UNSURE 70: Xaa = Glu,Gly
MSGCRVFIGRLNPAAREKDVERFFKGYGRIRDIDLKRGFGFVEFEDPRDADDAVYELDGKELCSERVTIXHARARSRGWKR

SEQ ID NO: 6989 - protein, 124 aa, Homo sapiens
MGEFKVHRVRFFNYVPSGIRCVAYNNQSNRLAVSRTDGTVEIYNLSANYFQEKFFPGHESRATEALCWAEGQRLFSSGLNGEIMEYDLQALNIKYAMDAFGGPIWSMAASPVALNFWLVVKMDL

SEQ ID NO: 6990 - protein, 68 aa, Homo sapiens
MEFIVLLAPKRSSSRLLCDTSDYFKHWGDCDWLGHFSSHIVNVWEGRKNFRGVPFVAKASSKQSYELT

SEQ ID NO: 6991 - protein, 55 aa, Homo sapiens; identical to SEQ ID NO: 6534

SEQ ID NO: 6992 - protein, 58 aa, Homo sapiens
MSIPLTWGQVEQSCGQLHLPQPFLKDPGPQKSQDPVFKDCSALPPHPVSNNRTFQQRF

SEQ ID NO: 6993 - protein, 64 aa, Homo sapiens
MFLQYYLNEQGDRVYTLKKFDPMGQQTCSAHPARFSPDDKYSRHRITIKKRFKVLMTQQPRPVL

SEQ ID NO: 6994 - protein, 64 aa, Homo sapiens
MFLQYYLNEKGDRVYTLKKFDPMGQQTCSAHPARFSPDDKYSRHRITIKKRFKVLMTQQPRPVL

SEQ ID NO: 6995 - protein, 64 aa, Homo sapiens; identical to SEQ ID NO: 6993

SEQ ID NO: 6996 - protein, 66 aa, Homo sapiens
MFLQYYLNEQGDRVYTLKEQKFDPMGQQTCSAHPARFSPDDKYSRHRITIKKRFKVLMTQQPRPVL

SEQ ID NO: 6997 - protein, 99 aa, Homo sapiens
  UNSURE 63: Xaa =  * ,Glu,Gly
  UNSURE 56: Xaa =  * ,Leu,Trp
  UNSURE 57: Xaa = Asn,Thr
  UNSURE 50,52: Xaa = Cys,Phe,Leu,Arg,Trp
  UNSURE 68: Xaa = Glu,Val
  UNSURE 58: Xaa = His,Ile,Leu,Asn
  UNSURE 55: Xaa = His,Lys,Asn,Gln
  UNSURE 49: Xaa = Ile,Asn
  UNSURE 62: Xaa = Leu,Arg
  UNSURE 53,60: Xaa = Leu,Arg,Trp
  UNSURE 65: Xaa = Lys,Gln
  UNSURE 67: Xaa = Phe,Ser
MLPLWLILRPERNLGNCEHQRPSPGQSLGHVGTTFGKVVVKHFPAHTWXXNXXGXXXXSXVXXPXFXXDSGMELEAVILSTLTQEQKTKHCMFPLISES

SEQ ID NO: 6998 - protein, 52 aa, Homo sapiens [sequence omitted]

SEQ ID NO: 6999 - protein, 191 aa, Homo sapiens
MKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 7000 - protein, 79 aa, Homo sapiens [sequence omitted]

SEQ ID NO: 7001 - protein, 115 aa, Homo sapiens
MKWFPEHRTIKLKKRTEGTEERGTVLEHHTSTSEEIRKEGGGCSHGSSTRPALQPTSPSHQVKGIFQLDQPDGLTVHSHTIQLRKGDTLNICSRITPTNIFNIKPLKKSSKEIEA

SEQ ID NO: 7002 - protein, 54 aa, Homo sapiens
MQFFRLSTARLLASETVIRNCLSSLQVDTQEQNLRGTSLWSINITTVFGRHKFK

SEQ ID NO: 7003 - protein, 54 aa, Homo sapiens [sequence omitted]

SEQ ID NO: 7004 - protein, 78 aa, Homo sapiens
MSESELGRKWDRCLADAVVKIGTGFGLGIVFSLTFFKRRMWPLAFGSGMGLGMAYSNCQHDFQAPYLLHGKYVKEQEQ

SEQ ID NO: 7005 - protein, 65 aa, Homo sapiens [sequence omitted]

SEQ ID NO: 7006 - protein, 69 aa, Homo sapiens
MDAPRQVVNFGPGPAKLPHSVLLEIQKELLDYKGVGISVLEMSHRSSDFAKIIKYRESCAGIASCSRQL

SEQ ID NO: 7007 - protein, 94 aa, Homo sapiens
MAQKEPRTIKISLPGGQKIDAVAWNTTPYQLARQISSTLADTAVAAQVNGEPYDLERPLETDSDLRFLTFDSPEGKQCSGTPAPMSWGQQLNNS

SEQ ID NO: 7008 - protein, 51 aa, Homo sapiens [sequence omitted]

SEQ ID NO: 7009 - protein, 89 aa, Homo sapiens
  UNSURE 54: Xaa =  * ,Gly
  UNSURE 70: Xaa = Cys,Phe,Ser,Tyr
MASFPPRVNEKEIVRLRTIGELLAPAAPFDKKCGRENWTVAFAPDGSYFAWSQXHRTVKLVPWSSAFRTXSCMAPRMYQFKQFKIAKTK

SEQ ID NO: 7010 - protein, 140 aa, Homo sapiens [sequence omitted]

SEQ ID NO: 7011 - protein, 126 aa, Homo sapiens
  UNSURE 46: Xaa = Ile,Val
  UNSURE 116: Xaa = Lys,Arg
MAPGEVTITVRLIRSFEHRNFKPVVYHGVNLDQTVKEFIVFLKQDXPLRTNLPPPFRNYKYDALKIIHQAHKSKTNELVLSLEDDERLLLKEDSTLKAAGIASETEIAFFCEEDYXNYKANPISSW

SEQ ID NO: 7012 - protein, 84 aa, Homo sapiens
MAVWPEVSQNRLTRGLLLPNYQLRGSVPKREKRPKRKHQHLFTPSERHSVCLDCLLEISLSGKQWRNVISFNCFCTTKTLFWVN

SEQ ID NO: 7013 - protein, 60 aa, Homo sapiens
MWAARSSNVCSQPAGRDQGWTEEYGLCCRLFVVPNCCIKQGVISCIAMHEWIPSKLCQAA

SEQ ID NO: 7014 - protein, 92 aa, Homo sapiens
  UNSURE 68: Xaa = Lys,Met,Arg,Thr
MLRHLMYKIKSTGPITVAEYMKEVLTNPAKGYYVYRDMLGEKGDFITSPEISQIFGELLGIWFISEWXATGKSTAFQLVELGPGRGTSWEIF

SEQ ID NO: 7015 - protein, 91 aa, Homo sapiens
MDSVAFEDVAVSFTQEEWALLDPSQKNLYRDVMQETFKNLTSVGKTSKVQNIEDEYKNPRRNLRGSFALVAQAGVQWRDLGSLQPPPPRFN

SEQ ID NO: 7016 - protein, 57 aa, Homo sapiens
MGGYCIEFPAGLIDDGETQKQLLSGSLKKKLATKGTLPNVLQRSVWTQACQTVLYTS

SEQ ID NO: 7017 - protein, 95 aa, Homo sapiens
MEGGFGSDFGGSGSGKLDPGLIMEQVKVQIAVANAQELLQRMTDKCFRKCIGKPGGSLDNSEQKCIAMCMDRYMDAWNTVSRAYNSRLQRERANM

SEQ ID NO: 7018 - protein, 72 aa, Homo sapiens
MPVIPALWEARTEECLSSGIQDQPGQHGETCLYKNYKKLARIRAAPNLLVVRKMAASKLVLNNCLKVKASNW

SEQ ID NO: 7019 - protein, 95 aa, Homo sapiens; identical to SEQ ID NO: 7017

SEQ ID NO: 7020 - protein, 87 aa, Homo sapiens
MEQVKVQIAVANAQELLQRMTDKCFRKCYRETWGLPGQLRAEVHRHVHGPLHGRLEHRVSRLQLAAAAGNEPTCDRRARATPPCSFP

SEQ ID NO: 7021 - protein, 95 aa, Homo sapiens; identical to SEQ ID NO: 7017

SEQ ID NO: 7022 - protein, 59 aa, Homo sapiens
  UNSURE 4: Xaa = Ala,Ser
MKLXKVVPQQMNLNANWRDQQSPAYRHKSLTTPRSHCLFQRSKEGLLKWLHCFIETRSS

SEQ ID NO: 7023 - protein, 85 aa, Homo sapiens
MTYYDHADFHHSVKSPELYETEPTNKDISAPVDAVPEAQAARQKKISFNFSEIMASTGWNSELKLLRILQDTDDEDEEDQSSGAE

SEQ ID NO: 7024 - protein, 71 aa, Homo sapiens
MGQQPTSSKLSKVSISGDLRILPCPSASGKECPFLRVPPSPCPPACLPLPTTTICSALESPVVLDEKGTLK

SEQ ID NO: 7025 - protein, 108 aa, Homo sapiens
  UNSURE 92: Xaa = His,Gln
MAGEQKPSSNLLEQFILLAKGTSGSALTALISQVLEAPGVYVFGELLELANVQELAEGANAAYLQLLNLFAYGTYPDYIANKESLPELSTAXAEQAEASYHRELGIKE

SEQ ID NO: 7026 - protein, 55 aa, Homo sapiens [sequence omitted]

SEQ ID NO: 7027 - protein, 62 aa, Homo sapiens
MFQLNWAIFYCLKNLSETCISNLSRKKPKNQGVQCCRSELFSFLSPSMFKITLVYPLRRAEV

SEQ ID NO: 7028 - protein, 61 aa, Homo sapiens
  UNSURE 48: Xaa = Gln,Arg
  UNSURE 41: Xaa = Gly,Val
  UNSURE 39: Xaa = Ile,Val
  UNSURE 14: Xaa = Phe,Val
MTAGAMAGILEHSXMYPVDSVKTRMQSLSPDPKAQYTSXYXALKKIMXTEASGGPCEASTS

SEQ ID NO: 7029 - protein, 55 aa, Homo sapiens
MSTLGDYFFLPSARQKTAVGIWFLFAYFHPQLCQKRKQCLKQFTKISIWNHQEWN

SEQ ID NO: 7030 - protein, 55 aa, Homo sapiens [sequence omitted]

SEQ ID NO: 7031 - protein, 66 aa, Homo sapiens
  UNSURE 27: Xaa = His,Gln
MSQDNDTLMRDILGHELAAMRLQKLEXSGGCLKRSSDRSARSSSWFRPILTLPRGFGALVCGRSAF

SEQ ID NO: 7032 - protein, 60 aa, Homo sapiens
MSIEVHGKHEERQDEHGFISREFHRKYRIPADVDPLTITSSLSSDGVLTVNGPRKQVSGP

SEQ ID NO: 7033 - protein, 65 aa, Homo sapiens
  UNSURE 59: Xaa = Phe,Ile
MPFGWLGGSHSKVRESSVGFTIFKDEGALGTYSENLQSTQRFLNVSTCIKLTFHRARTXQGFEFQ

SEQ ID NO: 7034 - protein, 98 aa, Homo sapiens
MPSEKTFKQRRTFEQRVEDVRLIREQHPTKIPVIIERYKGEKQLPVLDKTKFLVPDHVNMSELIKIIRRRLQLNANQAFFLLVNGHSMVSVSTPMRGV

SEQ ID NO: 7035 - protein, 58 aa, Homo sapiens
MSQDCHETIWILYSGSFISSICISLNCPSFWNTEMLMHMPLPMEGHKDEFPPGSTTGC

SEQ ID NO: 7036 - protein, 77 aa, Homo sapiens
  UNSURE 36: Xaa = Gly,Arg
MAWALQAADTCPEVKMVGLEGSDKLTILRGCPGLPXAPGPRERQAPMEREENVAPLDLLGRQDHLGPTEHLGSPSRA

SEQ ID NO: 7037 - protein, 52 aa, Homo sapiens
MKLPNMIHIQRLLRNQCGKCKTKGESILNHSSKNMVSIKKTRISEKSPKLCS

SEQ ID NO: 7038 - protein, 131 aa, Homo sapiens
MPPKGKSGSGKAGKGGAASGSDSADKKAQGPKGGGNAVKVRHILCEKHGKIMEAMEKLKSGMRFNEVAAQYSEDKARQGGDLGWMTRGSMVGPFQEAAFALPVSGMDKPVFTDPPVKTKFGYHIIMVEGRK

SEQ ID NO: 7039 - protein, 68 aa, Homo sapiens
MGWRRKRVPQRGRKAPPPQLHGNINNLYFPIRWRDRLHWDSPNPAAECQRPRSDVGLPKARARPDHVG

SEQ ID NO: 7040 - protein, 61 aa, Homo sapiens
MFFPTRGGSDHVSSMEAFKSRPAEAASLSELGRHNPHRSAWSTELHTHGASGRWAAAGALF

SEQ ID NO: 7041 - protein, 57 aa, Homo sapiens
MAKLIQKKLQGEVEKYQQLQKDLSKSMSGRQKLEAQLTENQYRERGTGPAGWVQRGL

SEQ ID NO: 7042 - protein, 77 aa, Homo sapiens
MSVAFVPDWLRGKAEVNQETIQRLLEENDQLIRCIVEYQNKGRGNECVQYQHVLHRNLIYLATIADASPTSTSKAME

SEQ ID NO: 7043 - protein, 85 aa, Homo sapiens
MEFDLGAALEPTSQKPGVGAGHGGDPKLSPHKVQGRSEAGAGPGPKASNFRGLGKGRRLTAAPPSSKDTTALPTPAAAPAIRTRM

SEQ ID NO: 7044 - protein, 62 aa, Homo sapiens
  UNSURE 7: Xaa =  * ,Tyr
MPEATKXRWSPESPGPAGSRGMSSLHRGCRAAMPPSTWPERTSSTLSEDGMKPSKKRFSAAA

SEQ ID NO: 7045 - protein, 88 aa, Homo sapiens
MTTGKNSLWSIKQTTTTMNLVVSSRHTESESLDIEDRRKNTKLRIIIQNLKCFMNHFILKLEVRCKETNLSLRILKVNLESTKININS

SEQ ID NO: 7046 - protein, 91 aa, Homo sapiens
MSAWELTHLSGKEGMASQPTEAHWGHRTSPQSRDSPSRKSDQALRGHGLRTRSREDTVTNPWLIWQVWEAARPVASPAPPDLCLQLSCSLG

SEQ ID NO: 7047 - protein, 50 aa, Homo sapiens
MFSSCSQKIFLNRKSDDYRVGCDFPLSITNLLCGKRYAHYYHLEDVVKNM

SEQ ID NO: 7048 - protein, 58 aa, Homo sapiens
  UNSURE 11: Xaa = Leu,Val
MALCALTRALXSEPGAPDRRRPCPESVPRRPDDEQWPPPTALCLDVAPLPPSSYFCGP

SEQ ID NO: 7049 - protein, 50 aa, Homo sapiens [sequence omitted]

SEQ ID NO: 7050 - protein, 54 aa, Homo sapiens
  UNSURE 52: Xaa = Asp,Glu
MSHEAAPQPQPRARGDGFAQQHPSGLFLCLRCVFEKMRRSQTCILNWNGSKXKV

SEQ ID NO: 7051 - protein, 54 aa, Homo sapiens [sequence omitted]

SEQ ID NO: 7052 - protein, 74 aa, Homo sapiens
MGAKSVGPLQYASHMEPQVCLHASEAQEGLQKFKVVRAGVHAPEEVGPREQVCGGARAPLRPQNRSPLRPLRTP

SEQ ID NO: 7053 - protein, 66 aa, Homo sapiens
MYTNPPTFLKTVLERWLSRRTDRRAYRRQKKKQMKIHIIQKKKKTTMHVYGGCTFCESDMFLSFTQ

SEQ ID NO: 7054 - protein, 56 aa, Homo sapiens
MGTFQRSSLGEGAGSASPWRLRAAGPGSSSPPVEARAPSETTLANVNAEPRRCCHG

SEQ ID NO: 7055 - protein, 109 aa, Homo sapiens
  UNSURE 21: Xaa =  * ,Glu
  UNSURE 11: Xaa = Ala,Pro
MARDLIGPALXPGFKARGTAXDEERDPSPVAGPALPPNYKSSSSDSSDSDEDSSSLYEEGNQESEEDDSGPTARKQRKNQDDDDDDDDGFLDQPFLLDLKSRMILLQGP

SEQ ID NO: 7056 - protein, 58 aa, Homo sapiens
MLPSFLSLWPWEKEAICSAGVSCSLPTFPMLKAQPSVDAQVDVDGSTKSRGPAQLLAT

SEQ ID NO: 7057 - protein, 74 aa, Homo sapiens [sequence omitted]

SEQ ID NO: 7058 - protein, 63 aa, Homo sapiens
MCFVKQLLEGSMLLESHHHSLISSTQGHKHCGRPQDLCLGKPGIVQGFSPCDSLNMASWEGKD

SEQ ID NO: 7059 - protein, 59 aa, Homo sapiens
MQLHPVADSSPAGAKWTETEIEMLRAAVKRFGDDLNHISCVIKERTVAQIKATVKRKTA

SEQ ID NO: 7060 - protein, 68 aa, Homo sapiens
MRTSRISFVGKESLFKDVHWPSREELLLQLKIGLELTGDLALDGRKRCSCRFGSSHTGGRGKLAVCSS

SEQ ID NO: 7061 - protein, 57 aa, Homo sapiens [sequence omitted]

SEQ ID NO: 7062 - protein, 59 aa, Homo sapiens
MLYCHSGHTQVVQYLNGEAARLVRAALLKCDDFHMPSFSFSLSFFFLFWPNVEDVELCF

SEQ ID NO: 7063 - protein, 102 aa, Homo sapiens
MARWRRPAAGTAVQRQEEIREGLRDRGAAEQEHGLNFQRLLDTSTYKEAFRKDMIRWGEEKRQADPGFFCRKIVEGISQPIWLVSDTRRVSDIQWFREAYGA

SEQ ID NO: 7064 - protein, 105 aa, Homo sapiens
  UNSURE 82: Xaa = Asp,Ile,Asn,Val
  UNSURE 60: Xaa = Asp,Val
  UNSURE 62: Xaa = Glu,Lys
  UNSURE 63: Xaa = Phe,Ile
  UNSURE 19: Xaa = Phe,Leu,Val
MKLLTRSRLFSRDFIPSKXAPKVKATAAPAGAPPQPQDLEFTKYTKWLGDCFFGKLIPRXQXXGLSIKAGSRYEDFSNLGTXPFAASYIQSDDKRSFIFQDNPWN

SEQ ID NO: 7065 - protein, 96 aa, Homo sapiens
MAESEDRSLRIVLVGKTGSGKSATANTILGEEIFDSRIAAQAVTKNCQKASREWQGRDLLVVDTPGLFDTKESLDTTCKKSAAASSPPAQGPMLLS

SEQ ID NO: 7066 - protein, 81 aa, Homo sapiens
MKESGMEQTHHLPKKAEGETVPLLRDTMTLMPVSMKGTEKSTTSDRSSLMMATEGFDDLPKLPRVPLSAYDTAADRRNVPE

SEQ ID NO: 7067 - protein, 64 aa, Homo sapiens
MKESGMEQTHHLPKKAEGETVPLLRDTMTLMPVSMKGTEKSTTSDRSSLMMATEGFDDLPKLPR

SEQ ID NO: 7068 - protein, 58 aa, Homo sapiens [sequence omitted]

SEQ ID NO: 7069 - protein, 83 aa, Homo sapiens
  UNSURE 49: Xaa = Ala,Val
MASTPMGNEGEKKSSWPSQAAPSLRGGPASLSRSEEYLSQISAELMEEXLCTACCHLNPVPIKKKQSQDQATQISKRAFFTKT

SEQ ID NO: 7070 - protein, 76 aa, Homo sapiens
  UNSURE 13: Xaa = Pro,Ser,Thr
MASCPKTFSAARXGAGGSAGQHPGPRIPARSRGERCGEDRPRARRTGSGPDAQAQIPSSFFGSIFKSRQRSIPSLS

SEQ ID NO: 7071 - protein, 133 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVWISVNTFLFLVYLLYKRCALKMLVYNN

SEQ ID NO: 7072 - protein, 58 aa, Homo sapiens
  UNSURE 3: Xaa = Asp,Glu
MRXERDALTVGAPQERSRGAAETTNLQFGEGFCAGETTRVLPPERTPCGLVSGPAMSA

SEQ ID NO: 7073 - protein, 63 aa, Homo sapiens; identical to SEQ ID NO: 6483

SEQ ID NO: 7074 - protein, 65 aa, Homo sapiens
MNVSTFLAYDQPTISYCGVHHELLSHKSFETNAQEDTMETHLETELDLSTITTAGRISDHKQQLA

SEQ ID NO: 7075 - protein, 97 aa, Homo sapiens
MSLADELLADLEGQQKRRKEEAMGQEEEPAIEDVQEETQLDLSGDSVKTIAKLWDSKMFAEIMMKIEEYISKQAKASEVMGPVEAALNTASSWMPTT

SEQ ID NO: 7076 - protein, 65 aa, Homo sapiens
  UNSURE 13: Xaa = Ala,Thr
  UNSURE 14: Xaa = Ile,Met
MNVSTFLAYDQPXXSYCGVHHELLSHKSFETNAQEDTMETHLETELDLSTITTAGRISDHKQQLA

SEQ ID NO: 7077 - protein, 79 aa, Homo sapiens
MEESDRPCEISEIDDNPKISENPRRSPTHEKNTMGAQEAHIYVKTVAGSEEPVHDRYRPTIEMERRRGLWWLVPGLSLE

SEQ ID NO: 7078 - protein, 152 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKWQEQ

SEQ ID NO: 7079 - protein, 90 aa, Homo sapiens [sequence omitted]

SEQ ID NO: 7080 - protein, 65 aa, Homo sapiens; identical to SEQ ID NO: 7074

SEQ ID NO: 7081 - protein, 114 aa, Homo sapiens
MELAFTEFGREAGLVIKTRSTELSILNIEDMKRKELTEEVKKGDQEEPSKCYPGIQVKTVFQSGNEQCPVTLRVRLESECRLFSFEIYMPQRGSREPISGQLSVFVCQLQHQKA

SEQ ID NO: 7082 - protein, 61 aa, Homo sapiens
  UNSURE 3: Xaa = Asp,Glu
  UNSURE 53: Xaa = Cys,Phe,Ser,Tyr
  UNSURE 48: Xaa = Ile,Asn,Ser,Thr
MAXWAKPMKRSCSAWWPPSSRRRSLLTGHVPVEKILIHCGFWFRRHPXDSLDXEDHMRQCI

SEQ ID NO: 7083 - protein, 111 aa, Homo sapiens
MLRGVLGKTFRLVDYTIQYGCIAHCAFEYVGGVVMCSGPSMEPTIQNSDIVFAENLSRHFYGIQRGDIVIAKSPSDPKSNICKRVIGLEGDKILTTSPSDFFKSHSYVFGN

SEQ ID NO: 7084 - protein, 54 aa, Homo sapiens
MVGNGDGEMALMAQPPEMGYLGGTSFQVEAVLGHGRGCSIGVSAAYIQVQDYVC

SEQ ID NO: 7085 - protein, 54 aa, Homo sapiens
MMNADMDDLSARVDAVKEENLKLKSENQVLGQYIENLMSASSVFQTTDTKSKRK

SEQ ID NO: 7086 - protein, 82 aa, Homo sapiens
MMNADMDAVDAENQVELEEKTRLINQVLELQHTLEDLSARVDAVKEENLKLKSENQVLGQYIENLMSASSVFQTTDTKSKRK

SEQ ID NO: 7087 - protein, 127 aa, Homo sapiens
MISKGVRVVTHYPAVDGEGEQETGDVGNAAGRDLALEGPGPDSTPRHRSPADLVRPRVLRAPVPHALGARADPHAAPTPAGLLLMPSSAKDSRALSGRPRFSAESTRKSPGGRRGAERGRQYLGDDL

SEQ ID NO: 7088 - protein, 80 aa, Homo sapiens
MEHHTDWVNDIVLCCNGKTLISASSDTTVKVWNAHKGFCMSTLRTHKDYVKALAYAKDKELVAAGLDRQIFLWDVNTLTA

SEQ ID NO: 7089 - protein, 67 aa, Homo sapiens [sequence omitted]

SEQ ID NO: 7090 - protein, 170 aa, Homo sapiens
  UNSURE 11: Xaa = Arg,Ser
MAASVLNTVLXRLPMLSLFRGSHRVQVPLQTLCTKAPSEEDSLSSVPISPYKDEPWKYLESEEYQERYGSRPVWADYRRNHKGGVPPQRTRKTCIRRNKVVGNPCPICRDHKLHVDFRNVKLLEQFVCAHTGIIFYAPYTGVCVKQHKRLTQAIQKAGIMVLLIYHIPQG

SEQ ID NO: 7091 - protein, 121 aa, Homo sapiens
MAASVLNTVLRRLPMLSLFRGSHRVQVPLQTLCTKAPSEEDSLSSVPISPYKDEPWKYLESEEYQERYGSRPVWADYRRNHKGGVPPQRTRKTCIRRNKVVGNPCPICRDHKLHVDFRESV

SEQ ID NO: 7092 - protein, 56 aa, Homo sapiens
MARVTSGNLQLWQKGKTHVLHGGRRERERACKCGKDNYTYNIIRSHENSLTIMRPA

SEQ ID NO: 7093 - protein, 51 aa, Homo sapiens [sequence omitted]

SEQ ID NO: 7094 - protein, 84 aa, Homo sapiens
  UNSURE 57: Xaa =  * ,Ala,Glu,Lys,Leu,Met,Pro,Gln,Ser,Thr,Val
  UNSURE 56: Xaa = Ile,Met
MLGPGSNRRRPTQGERGPGSPGEPMEKYQVLYQLNPGALGVNLVVEEMETKVKHVXXQVECMDDHYASQALEEQWGLTILPRLV

SEQ ID NO: 7095 - protein, 88 aa, Homo sapiens [sequence omitted]

SEQ ID NO: 7096 - protein, 99 aa, Homo sapiens
MEPEQMLEGQTQVAENPHSEYGLTDNVERIVENEKINAEKSSKQKVDLQSLPTRAYLDQTVVPILLQGLAVLAKERPPNPIEFLASYLLKNKAQFEDRN

SEQ ID NO: 7097 - protein, 76 aa, Homo sapiens
MEPEQMLEGQTQVAENPHSEYGLTDNVERIVENEKINAEKSSKQKVDLQSLPTRAYLDQTVVPILLQGLAVLAKER

SEQ ID NO: 7098 - protein, 120 aa, Homo sapiens
  UNSURE 118: Xaa = Asn,Tyr
MEPEQMLEGQTQVAENPHSEYGLTDNVERIVENEKINAEKSSKQKVDLQSLPTRAYLDQTVVPILLQGLAVLAKERVLQQRENTAVKYNLKNSANFSQHCFWTFLRVGSGHLQWLNKXHR

SEQ ID NO: 7099 - protein, 143 aa, Homo sapiens [sequence omitted]

SEQ ID NO: 7100 - protein, 72 aa, Homo sapiens [sequence omitted]

SEQ ID NO: 7101 - protein, 82 aa, Homo sapiens
MEPAAFQALYSAEKPKLEDEHLVFFCQMGKRGLQATQAGPGVLDTLGLATTLEPIENGWRKRVRAGGSLLIATPWPLNGHLN

SEQ ID NO: 7102 - protein, 70 aa, Homo sapiens
MEQTEVLKPRTLADLIRILHQLFAGDEVNVEGGAGHHGSLRERPHRVGNVRQVRPVQVYPKSCGSRKWKI

SEQ ID NO: 7103 - protein, 95 aa, Homo sapiens
MPPSCAYGNPKTLAGRDMSSWTSRGTHQLKKTQGAGCQSMLAEEHTNRPEAIDWWNDAYFDQGGQTRVRAAERPNSRGKPSPFWLPHLLRATVTQ

SEQ ID NO: 7104 - protein, 62 aa, Homo sapiens
MPSQVLSTTKMLCHCKCYFPSLFTIPLTTEYNFLKNKYFNKWKFNLGDSHSFDKYILHQALS

SEQ ID NO: 7105 - protein, 55 aa, Homo sapiens
  UNSURE 11: Xaa = Ile,Leu,Pro,Thr
MFLSCLSVDNXLDSHVKDLSWESQGHLGMFDRCVPENKPSDICYIDAELSGDSGL

SEQ ID NO: 7106 - protein, 68 aa, Homo sapiens [sequence omitted]

SEQ ID NO: 7107 - protein, 68 aa, Homo sapiens [sequence omitted]

SEQ ID NO: 7108 - protein, 55 aa, Homo sapiens
  UNSURE 27: Xaa = Cys,Phe
  UNSURE 53: Xaa = Met,Arg
MTVEADPANMFNWTTEEVETCDKGALXQETILIIKAGTETAILATKGCIPEGXRP

SEQ ID NO: 7109 - protein, 53 aa, Homo sapiens
MYPVFYNLTSYIFTHVYENVTFKNGCLIFYCMNMPQFNYFSLWILGCSNLSPL

SEQ ID NO: 7110 - protein, 60 aa, Homo sapiens
MAVTALAARTWLGVWGVRTMQARGFGSDQSENVDRGAGSIREAGGAFGKREQAEEERYFR

SEQ ID NO: 7111 - protein, 75 aa, Homo sapiens
MAVTALAARTWLGVWGVRTMQARGFGSDQSENVDRGAGSIREAGGAFGKREQAEEERYFRALGATFCFFAVEAVV

SEQ ID NO: 7112 - protein, 100 aa, Homo sapiens
MSTGARAPSGKPVGPSERESRLKRNDISDITGYALRSLWGEGLKLNPEPPCPCRAQSREQLAALKKHHEEEIVHHKKEIERLQKEIERHKQKIKMLKHDD

SEQ ID NO: 7113 - protein, 60 aa, Homo sapiens; identical to SEQ ID NO: 7110

SEQ ID NO: 7114 - protein, 106 aa, Homo sapiens
MAVTALAARTWLGVWGVRTMQARGFGSDQSENVDRGAGSIREAGGAFGKREQAEEERYFRAQSREQLAALKKHHEEEIVHHKKEIERLQKEIERHKQKIKMLKHDD

SEQ ID NO: 7115 - protein, 106 aa, Homo sapiens; identical to SEQ ID NO: 7114

SEQ ID NO: 7116 - protein, 74 aa, Homo sapiens
MAVTALAARTWLGVWGVRTMQARGFGSDQSENVDRGAGSIREAGGAFGKREQAEEERYFRAQSREQLAALKKHH

SEQ ID NO: 7117 - protein, 75 aa, Homo sapiens
  UNSURE 10: Xaa = Gly,Arg
MSTGARAPSXEAGGAFGKREQAEEERYFRAQSREQLAALKKHHEEEIVHHKKEIERLQKEIERHKQKIKMLKHDD

SEQ ID NO: 7118 - protein, 80 aa, Homo sapiens
MKKFVSHATCHDSLGLQEQESYLIMGQTSDLWRIKSDYSYVLGKETFLILWPADGDASKKELRDQLEEFLEYMRTHGCQS

SEQ ID NO: 7119 - protein, 104 aa, Homo sapiens
  UNSURE 64: Xaa = His,Gln
MSTLLISSSDALLEELERSTLQDSDEYSNPAPLPLDQHSRKETNLDETSEILSIQDNTSPLPAXSCILPISRSSMSTVKPKSQRNHHRLLKRQQLLSWMSSLLT

SEQ ID NO: 7120 - protein, 53 aa, Homo sapiens [sequence omitted]

SEQ ID NO: 7121 - protein, 68 aa, Homo sapiens
  UNSURE 35: Xaa = Cys,Gly
MAAPWPRVHLCRSLGPVTKESRRRRRPLPPVGPGXREKLPLDVQKSPVVDNVGNKLCNFLWHSVVKNK

SEQ ID NO: 7122 - protein, 90 aa, Homo sapiens
MALRYPMAVGSNKGHKVTKNVSKPRHSRRRGRLDQTHQVRAGHDSGGVWLCPYERRAMELLKVSKDKRAPQIYQEKGGDAHPRQEEAGRS

SEQ ID NO: 7123 - protein, 112 aa, Homo sapiens
MEGLLSPMRTKMTEGRRCQVHLLDDRKLELLVQPKLLAKELLDLVASHFNLKEKEYFGIAFTDETGPQIYQEKGGDAHPRQEEAGGAEQRTGRHEESCCQERLSPSPALSLK

SEQ ID NO: 7124 - protein, 101 aa, Homo sapiens [sequence omitted]

SEQ ID NO: 7125 - protein, 63 aa, Homo sapiens
MSIGLENPFQARGPRGLAAAGPGSHCIPPGTVLVWHTRTEKPKMKQEEQLQRQGRGSDPAIEV

SEQ ID NO: 7126 - protein, 61 aa, Homo sapiens [sequence omitted]

SEQ ID NO: 7127 - protein, 86 aa, Homo sapiens
MYLDIFRVSVQETPCCSNRRSWVLASFARDGLLFSLPSSVLFITPVIVSLVKQPLCCRPRMCVSGADVTPSLFSHPCIHTLFHFLK

SEQ ID NO: 7128 - protein, 67 aa, Homo sapiens [sequence omitted]

SEQ ID NO: 7129 - protein, 51 aa, Homo sapiens
MTLHHSKYCLYFKSVYILPPYSSFPENPSPHFKLFFWSLLKLTANNTTLNS

SEQ ID NO: 7130 - protein, 65 aa, Homo sapiens
MLRHSPSLWELVEEHVPLRERREVKRILGGGGGGPEPGAAGGGGDVTGTAPRGSILSSPQLPPHL

SEQ ID NO: 7131 - protein, 69 aa, Homo sapiens
  UNSURE 46: Xaa =  * ,Tyr
MGRMHAPGKGLSQSALPYRRSVPTWLKLTSDDVKEQIYKLAKKGLXSFTDRCNPERFTWCCTSTFCDRQ

SEQ ID NO: 7132 - protein, 73 aa, Homo sapiens
  UNSURE 70: Xaa =  * ,Cys,Phe,Leu,Ser,Trp,Tyr
  UNSURE 73: Xaa =  * ,Lys,Gln,Arg
  UNSURE 6: Xaa = Cys,Gly
  UNSURE 72: Xaa = Cys,Tyr
  UNSURE 69: Xaa = Ile,Lys,Arg,Thr
  UNSURE 71: Xaa = Leu,Met,Val
MLRVLXLLRPWSPFGPAAALPTGRPGAQRSKCAPWRVRTKAVGSMRTGLESVLVSGITVSSRGQHTANXXXXX

SEQ ID NO: 7133 - protein, 64 aa, Homo sapiens
MIVSFNFSTVHKSCPAKDWKVHKGKCYWIAETKKSWNKSQNDCAINNSYLMVIQDITAMVRFNI

SEQ ID NO: 7134 - protein, 63 aa, Homo sapiens; identical to SEQ ID NO: 6483

SEQ ID NO: 7135 - protein, 96 aa, Homo sapiens
  UNSURE 89: Xaa = Lys,Asn
MDKKSTHRNPEDARAGKYEGKHKRKKRRKQNQNQHRSRHRSVTSFSSDDPMFPSSSSSSSGSQTDSSIEDAAKGKIKKKRREKTNKWEXRKVSNCE

SEQ ID NO: 7136 - protein, 94 aa, Homo sapiens
MDKKSTHRNPEDARAGKYEGKHKRKKRRKQNQNQHRSRHRSVTSFSSDDPMFPSSSSSSSGSQTDSSIEDAAKGKIKKKRREKTNKWEKRKDKI

SEQ ID NO: 7137 - protein, 64 aa, Homo sapiens
  UNSURE 29: Xaa = Lys,Asn
MEGAGAGSGFRKELVSRLLHLHFKDDKTXKQQSAACGRPRQKTRSVWTWTSWRSSWTSRDLSRG

SEQ ID NO: 7138 - protein, 51 aa, Homo sapiens
MCILRAIIVDCWKIGFCGWAWWLTPVIPALWEAGVSRSLEVRSSRPDWPTW

SEQ ID NO: 7139 - protein, 55 aa, Homo sapiens
MRILTLCQLPKLEIIESSNWKGRYHPRFQLSTHCKIPSGTSQIDEFSSALLEYSQ

SEQ ID NO: 7140 - protein, 52 aa, Homo sapiens
MVSRVQLPPEIQLAQRLAGNEQVTRDRAVRKLRKYIVARTQRAAVVLRTTSC

SEQ ID NO: 7141 - protein, 83 aa, Homo sapiens
  UNSURE 42: Xaa = Asp,Glu
MLVERKVNGLVPRLMPVIAAHWEAQVGASLEGSSILDRAVIXHNLLSASKLYNNITFEELGALLEIPAAKAEKIASQMITEDV

SEQ ID NO: 7142 - protein, 108 aa, Homo sapiens
MDMRGIFLAFGPDFKSNFRAAPIRSVDVYNVMCNVVGITPLPNNGSWSRVMCMLKGRAALPRLSGPATVPWPDSSLPACITDHIACLRKKHHQQSGPPKPDDFHFMCE

SEQ ID NO: 7143 - protein, 59 aa, Homo sapiens
MGRWFNITSPSSPLLCPILAFIVSPLKGCELHGEVPMCFEEGLPQFIFNRYFLNNYCKD

SEQ ID NO: 7144 - protein, 51 aa, Homo sapiens
  UNSURE 43: Xaa = Arg,Ser
MVNGTWTGKGLFVWESFMAKAVTPPSKTCVFLAECCWRWPLEXLSQINLLT

SEQ ID NO: 7145 - protein, 81 aa, Homo sapiens
MAAGTSSYWEDLRKQARQLENELDLKLVSFSKLCTSYSHSSTRDGRRDSSDTTPLLNGSSQDRMFETMRLRLNNFWQGLQG

SEQ ID NO: 7146 - protein, 56 aa, Homo sapiens
  UNSURE 41: Xaa = Ala,Thr
  UNSURE 22: Xaa = Asp,Glu
  UNSURE 40: Xaa = His,Gln
  UNSURE 15: Xaa = Ile,Leu
MLIDGSDSHQTFPCXLCKDSRXSRAKPCHSSIRRAKSFIXXEEQADHAATALVFTF

SEQ ID NO: 7147 - protein, 89 aa, Homo sapiens
  UNSURE 55: Xaa = Leu,Val
MVIVFCLVTFATVPFKTMWKPQVCGQHRWNDILCFLRLPSTRHISLVLQMSAQVXVTSFSCCPGKSVCAGLERLHSSGDYSHLHFLHMH

SEQ ID NO: 7148 - protein, 86 aa, Homo sapiens
  UNSURE 72: Xaa = Lys,Asn
MAVPGCNKDSVRAGCKKCGYPGHLTFECRNFLRVDPKRDIVLDVSSTSSEDSDEENEELNKLQALQEKRINXKRKRKKKKAKKKSN

SEQ ID NO: 7149 - protein, 143 aa, Homo sapiens
  UNSURE 137: Xaa = Ile,Leu
  UNSURE 14: Xaa = Ile,Met,Arg,Ser
MEDHQHVPIDIQTXKLLDWLVDRRHCSLKWQSLVLTIREKINAAIQDMPESEEIAQLLSGSYIHYFHCLRILDLLKGTEASTKNIFGRYSSQRMKDWQEIIALYEKDNTYLGKVARPGSPGIHGEAHSQSSEIPGLXGGTVCE

SEQ ID NO: 7150 - protein, 51 aa, Homo sapiens
MRRFWNQILIWRSDRQSAWAISMRRRRVRLLVWRWSHYRRAWAPGVGHERK

SEQ ID NO: 7151 - protein, 51 aa, Homo sapiens
  UNSURE 48: Xaa = Asp,His,Asn,Tyr
  UNSURE 31: Xaa = Phe,Ile,Leu,Val
MRRFWNQILIWRSDRQSAWAISMRRRRVRLXVWRWSHYRRAWAPGVGXERK

SEQ ID NO: 7152 - protein, 51 aa, Homo sapiens; identical to SEQ ID NO: 7150

SEQ ID NO: 7153 - protein, 82 aa, Homo sapiens
MASSDVKPTSVSHAKKWSEEIENLYRFQQAGYRDETEYRQVKQVSMVDRWPETGYVKKLQRRDNTFYYYNKQRDVMTKKSTK

SEQ ID NO: 7154 - protein, 53 aa, Homo sapiens
MWTQTRIKTGHLPLRSLQSAGLRINTCSKREERSQGRSCQMDLISMKNRSPKD

SEQ ID NO: 7155 - protein, 89 aa, Homo sapiens
MKTGLSQCFNLTRAVSWSTPRSLLVPYDSPHQMTLAKSRFLCGQDWLADWWKVGWTKGGHVSSQHQFCTSSASVLVGVPVSPGPGWARA

SEQ ID NO: 7156 - protein, 80 aa, Homo sapiens
MMSWDFTFTHHSLTSSSRAISRPASFIHGRCPTEVHYFLSSMLYFHSTLPMFSYVWIYKYYHVTVACSIQYSHMLHRLVA

SEQ ID NO: 7157 - protein, 99 aa, Homo sapiens
  UNSURE 39: Xaa = Lys,Arg
MAQGQRKFQAHKPAKSKTAAAASEKNRGPRKGGRVIAPXKARVVQQQKLKKNLEVGIRKKIEHDVVMKASSSLPKKLALLKAPAKKKGAAAATSSKTPS

SEQ ID NO: 7158 - protein, 102 aa, Homo sapiens
  UNSURE 91: Xaa =  * ,Glu,Gly,Gln,Arg,Trp
  UNSURE 92: Xaa =  * ,Ser
  UNSURE 90: Xaa = Ala,Asp,His,Pro
  UNSURE 41: Xaa = Ala,Gly
  UNSURE 55: Xaa = Lys,Gln
MSVPCKPAVRGGAGLDAALHFNPRLDTSEVVFNSKEQGSWXREERGPGVPFQRGXPFEVLIIASDDGFKAVVGDAQYHHFRHRLPLARVXXXRWAGTCSWTP

SEQ ID NO: 7159 - protein, 50 aa, Homo sapiens [sequence omitted]

SEQ ID NO: 7160 - protein, 72 aa, Homo sapiens
MIDNPHYCLSRQKTDSVRKCFKWVILISAITKTTTKKQIFLLISYQQKKGMRCTGIPSTVILKMSVFKAFVF

SEQ ID NO: 7161 - protein, 62 aa, Homo sapiens
MVPMASRICGQKISLKANLAYINQTKISVDNMLMNNTTKFILKRQCVRRAFILQAQLERHLL

SEQ ID NO: 7162 - protein, 110 aa, Homo sapiens
MAKSLLKTASLSGRTKLLHQTGLSLYSTSHGFYEGEVKKTLQQFPGRSIDLQKEDNGIGILTLNNPSRMNAFSGVMMLQLLEKVIELENWTEGKGSLSVGQKILSLQDLI

SEQ ID NO: 7163 - protein, 53 aa, Homo sapiens [sequence omitted]

SEQ ID NO: 7164 - protein, 53 aa, Homo sapiens
MAHFRSMSKPPGSREPQHDSWPLFASDTKSSTVHYFTCPAPLHNRKRGLTLKK

SEQ ID NO: 7165 - protein, 74 aa, Homo sapiens
MSIGVPIKVLHEAEGHIVTCETNTGEVYRGKLIEAEDNMNCQMSNITVTYRDGRVAQLEQVYIRGSKIRFLILP

SEQ ID NO: 7166 - protein, 93 aa, Homo sapiens
MWASLSLDHPSAKENQALRLIEMREENGNVPKTEQAGSLKPLRDTGKSNLKEKKMNINKLCPGLGGECMTPDVMLLQQNQSLLWKPRNGNRRI

SEQ ID NO: 7167 - protein, 84 aa, Homo sapiens
MQYPFRKLLRPSTESCCVAQARVQWCHLGSLQPPLPGFKQFSCHSLPSSWDYRCAPPCLTNFCIFSRDRVSPCWPGWSRTPDLK

SEQ ID NO: 7168 - protein, 147 aa, Homo sapiens
MGGCMHSTQDKSLHLEGDPNPSAAPTSTCAPRKMPKRISISKQLASVKALRKCSDLEKAIATTALIFRNSSDSDGKLEKAIAKDLLQTQFRNFAEGQETKPKYREILSELDEHTENKLDFEDFMILLLSITVMSDLLQNIRNVKIMK

SEQ ID NO: 7169 - protein, 77 aa, Homo sapiens [sequence omitted]

SEQ ID NO: 7170 - protein, 69 aa, Homo sapiens
  UNSURE 63: Xaa = Arg,Ser
  UNSURE 19: Xaa = Ile,Lys
MLGFAFRDKRWWIYFACSXDSQGVRAAYCQILLLFYVSVYSLSFSYLLDHFCSLPKPLLFGTXSQIPHF

SEQ ID NO: 7171 - protein, 62 aa, Homo sapiens
  UNSURE 20: Xaa = Arg,Ser
MSNMEKHLFNLKFAAKELSXSAKKCDKEEKAEKAKLKRPFRRATWKLRGYTPKMPSARRTRR

SEQ ID NO: 7172 - protein, 67 aa, Homo sapiens
METVRAHHTPPSLPHLLAELVECSGQEQVLCGVTIGDSSESIPHQLSDQSWLPNLSVLQVWFDVFNL

SEQ ID NO: 7173 - protein, 66 aa, Homo sapiens
  UNSURE 53: Xaa =  * ,Leu
  UNSURE 24: Xaa =  * ,Lys,Arg,Trp
  UNSURE 25: Xaa = Phe,Ile,Leu,Val
MIFPFLRDMAVLTPREFLICKLEXXLLCLTELKFRSFCLISETKGNNTPIQKXINLLEVFVFNISI

SEQ ID NO: 7174 - protein, 55 aa, Homo sapiens
MLPIFFSATEQLPWYNKKDEYLLFIESGEPEKEPGKKQLEKVRGKPRVCVILQAN

SEQ ID NO: 7175 - protein, 77 aa, Homo sapiens
MRYSCIHTPACLQFINLPFKTKELQKKMDFTEPCVPKVLSQSAVFIVQTDYKKCFPFELYSLQKCFYTFSNFRNRII

SEQ ID NO: 7176 - protein, 93 aa, Homo sapiens
MYQNLWDTAKAVFRRKFIALNAHRRKQERSKIDTLTSQLKELEKQDETSSKASRRQEITKIRAELKEIQTRKTPQKISESRSWLFEKINKIDC

SEQ ID NO: 7177 - protein, 60 aa, Homo sapiens
MCLGTLRPTNDSALMEQPSVWGKVLEVHSFRKPLTSLYHALSEKLRIRKEQDPQETLMSG

SEQ ID NO: 7178 - protein, 73 aa, Homo sapiens [sequence omitted]

SEQ ID NO: 7179 - protein, 73 aa, Homo sapiens
MTRVLLSGLQQTRRLIRIHNSCQCRGASVTFTLIIIPGRRSQQLLVTTIRDFIFTSYEELSGTFLITGCHIIL

SEQ ID NO: 7180 - protein, 59 aa, Homo sapiens
  UNSURE 59: Xaa = Cys,Trp
MDGDPDTPKPVSFTVKETVCPRTTQQSPEDCDFKKDGLVKRCMGTVTLNQARGSFDISX

SEQ ID NO: 7181 - protein, 73 aa, Homo sapiens; identical to SEQ ID NO: 7179

SEQ ID NO: 7182 - protein, 54 aa, Homo sapiens [sequence omitted]

SEQ ID NO: 7183 - protein, 78 aa, Homo sapiens
MPGDAGGPGHLGLKEFGFRGTEGRLLLLQDCGVHVQVAEGGAPQSSISRWTASACCPRSSPGYGAWLQPRLRCSEKAL

SEQ ID NO: 7184 - protein, 50 aa, Homo sapiens
  UNSURE 40: Xaa = Asn,Thr
  UNSURE 39,43: Xaa = Glu,Gly
MSLSILCILMFMYIKCSVVLKTMKEIKASLDYFKEQSGXXLTXVNIRVEI

SEQ ID NO: 7185 - protein, 96 aa, Homo sapiens
MSISDVAHVACEPRERRWRDHPPDVVAWKRPQTKIQFPGEFLTPPTPPITFLANIRHWINPKKESIHSIQGSIVSPHTAATNGGYSRKKDGGFFST

SEQ ID NO: 7186 - protein, 72 aa, Homo sapiens
MCVHSLFKYLSKFNYFVQYACLPSIWLAGDIVMNRHGLLWNLQHGFHASWCYSAPKHTDMQLLDILVCAGHC

SEQ ID NO: 7187 - protein, 74 aa, Homo sapiens
MDDYTSAIEVQPNFEVPYYNRGLILYRLGYFDDALEDFKKVLDLNPGFQDATLSLKQTILDKEEKQRRNVAKNY

SEQ ID NO: 7188 - protein, 51 aa, Homo sapiens [sequence omitted]

SEQ ID NO: 7189 - protein, 53 aa, Homo sapiens
MTQSVVVQVGQCGNQIGCCFWDLALREHAAVNQKGIYDEAISSFFRNVDTRQS

SEQ ID NO: 7190 - protein, 53 aa, Homo sapiens; identical to SEQ ID NO: 7189

SEQ ID NO: 7191 - protein, 74 aa, Homo sapiens
MMADMYNRMTSACHRKCVPPHYKEAELSKGESVCLDRCVSKYLDIHERMGKKLTELSMQDEELMKRVQQSSGPA

SEQ ID NO: 7192 - protein, 52 aa, Homo sapiens
MMADMYNRMTSACHRKCVPPHYKEAELSKGESVCLDRCVSNYLDIHERMGKS

SEQ ID NO: 7193 - protein, 50 aa, Homo sapiens
MRMKKRRRRRRKMTLMGVKVLMNQILNQMKKPIIKQTWQTLLVKLQLSKS

SEQ ID NO: 7194 - protein, 59 aa, Homo sapiens
  UNSURE 30: Xaa = Ala,Gly
MPGLSSAHPRSPRNFPGLSPLESGWKGATXGSAPLGAERGKLLKRRWGLGEDINQHGQP

SEQ ID NO: 7195 - protein, 54 aa, Homo sapiens
METVARDGGSLGVSGNCAFEFPQAAGGKLRLRQEREGPTDKVAWPEACFVFWFL

SEQ ID NO: 7196 - protein, 97 aa, Homo sapiens
MALLGRSVRAGYRKTRRHIHDPRHRSNLCLTPPLPARDGKQTETGSSECSLEGLLENLLEGCEDMFGNLFAENIFSPVHHSQLAEELKRQEISKRER

SEQ ID NO: 7197 - protein, 113 aa, Homo sapiens
MDSRIPYDDYPVVFLPAYENPPAWIPPHERVHHPDYNNELTQFLPRTITLKKPPGAQLGFNIRGGKASQLGIFISKVIPDSDAHRAGLQEGDQVLAVNDVDFQDIEHSKAERS

SEQ ID NO: 7198 - protein, 80 aa, Homo sapiens
  UNSURE 74: Xaa =  * ,Trp
MWRAEGKWLPKTSRKSVSQSVFCGTSTYCVLNTVPPIEDDHGNSNSSHVKIFLPKKLLECLPKCSSLPKERHRXNTNERS

SEQ ID NO: 7199 - protein, 55 aa, Homo sapiens [sequence omitted]

SEQ ID NO: 7200 - protein, 51 aa, Homo sapiens
  UNSURE 50: Xaa =  * ,Arg
  UNSURE 49: Xaa =  * ,Cys,Trp
MVQPWGAGEASGQTITPPRPHPQGEPLKPGAAGEVEGFSFITTLPFCRXXS

SEQ ID NO: 7201 - protein, 142 aa, Homo sapiens
  UNSURE 142: Xaa = His,Gln
MSVRTLPLLFLNLGGEMLYILDQRLRAQNIPGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPAILQQVDGTLRX

SEQ ID NO: 7202 - protein, 61 aa, Homo sapiens
MYPSLFRCPNKDGPFHLDTCDQPHLVSHHQHPARSCGQWGIQTNRRSMGTEQTSLSSSSNL

SEQ ID NO: 7203 - protein, 115 aa, Homo sapiens
  UNSURE 53: Xaa = Asn,Tyr
  UNSURE 79: Xaa = Cys,Phe,Gly,Val
  UNSURE 32: Xaa = Gly,Arg
  UNSURE 78,84: Xaa = Gly,Val
  UNSURE 82: Xaa = Ile,Thr
  UNSURE 83: Xaa = Lys,Thr
MVAAKKDEKVAGVGSNSRLQLVMKSGEVRPGXTRQTLKDDQTRQSEIRSFSLXNCPSFEVPKGNLKIELLCYGWLKLXXPSXXXAIILKLGHSMRKNTTECAHWLIIDPGDSEHH

SEQ ID NO: 7204 - protein, 96 aa, Homo sapiens
MVAAKKTKKSLESINSRLQLVMKSGKYVLGYKQTLKMIRQGKAKLVILANNCPALSGNNIELGTACGKYYRVCTLAIIDPGDSDIIRSMPEQTGEK

SEQ ID NO: 7205 - protein, 83 aa, Homo sapiens [sequence omitted]

SEQ ID NO: 7206 - protein, 51 aa, Homo sapiens
MLAKTGVHHYSGNNIELGTACGKYYRVCTLAIIDPGDSDIIRSMPEQTGEK

SEQ ID NO: 7207 - protein, 55 aa, Homo sapiens [sequence omitted]

SEQ ID NO: 7208 - protein, 58 aa, Homo sapiens
  UNSURE 58: Xaa = Cys,Trp
MVAAKKTKKSLESINSRLQLVMKSGKYVLGYKQTLKMIRQGKAKLVILANNCPALRKX

SEQ ID NO: 7209 - protein, 51 aa, Homo sapiens
MIQKMEHASRLHPQEPCLKDGKALFPTKTTESPLAKVNRDQCFTSEVVSKA

SEQ ID NO: 7210 - protein, 51 aa, Homo sapiens
MASSSPPRPRVSCSCLCLIAAPGLTFYGFVFYWFVFIFSGILNKSIAVRYP

SEQ ID NO: 7211 - protein, 106 aa, Homo sapiens
  UNSURE 26: Xaa =  * ,Arg
  UNSURE 27: Xaa =  * ,Glu
  UNSURE 23: Xaa = Ala,Gly,Pro,Arg
  UNSURE 40: Xaa = Ala,Pro
  UNSURE 7: Xaa = Asn,Tyr
  UNSURE 56: Xaa = Asp,Glu
  UNSURE 13: Xaa = Cys,Trp
  UNSURE 3: Xaa = His,Gln
  UNSURE 12: Xaa = Ile,Asn
  UNSURE 42: Xaa = Ile,Ser
  UNSURE 61: Xaa = Leu,Val
  UNSURE 8: Xaa = Lys,Arg
  UNSURE 22: Xaa = Pro,Arg
MVXKSTXXRSTXXTECCEGNKXXEPXXATFVFYRVVISEXGXAWYMAALVRVISTXLPTGXSVNFKQKASFLVNHSPRSPVWLRELAAMLDVVERAARSYRKMVNT

SEQ ID NO: 7212 - protein, 116 aa, Homo sapiens
MGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 7213 - protein, 78 aa, Homo sapiens
  UNSURE 29: Xaa = Glu,Lys
MAPKAAKGAKPEPAPAPPPPGAKPEEDKXDGKEPSDKPQKAVQDHKEPSDKPQKAVQPKHEGHEEGVSPLPVGIKRQQ

SEQ ID NO: 7214 - protein, 67 aa, Homo sapiens
MIRKPDTLQAGGDPGERPSQALLTPVALDFPCLDSPQAWLSALDWSATRTTSPSLASVPSVMWLSSA

SEQ ID NO: 7215 - protein, 67 aa, Homo sapiens; identical to SEQ ID NO: 7214

SEQ ID NO: 7216 - protein, 68 aa, Homo sapiens
  UNSURE 8: Xaa = Gly,Arg,Trp
MFSKIGPXVELLTSGDPTTSTSRSAGIMDVSHCPCPRWYHLQSLIRKNNMSTECNSRSGILCPSVFSS

SEQ ID NO: 7217 - protein, 58 aa, Homo sapiens
MPGIYEVLKNQNTEQNLLGDELLSFSLQHHRHITSTYTHTEKILKRHNNHGKWRLLDC

SEQ ID NO: 7218 - protein, 93 aa, Homo sapiens
MLGSVVERLAVVLEQGRRNSDVKLTVCEPWNLHSEKMKDIDIGKEYIIPSPGYRSVRERTSTSGTHRDREDSKFRRLDRVRVSLCHPDCSAVA

SEQ ID NO: 7219 - protein, 58 aa, Homo sapiens
MLFKFLLTDISQLEMILVCESLPPSNWCPGSTEILLSLNRILSSTKTYAIVNSPNEEG

SEQ ID NO: 7220 - protein, 86 aa, Homo sapiens
MRWPWKQPGRLPSLLVPSPERKVERPAGDQGRTESPGLVNSWAPRSLVFLEHAYLSQREGHGPCRARDPIFCSRREQRREHRDSCC

SEQ ID NO: 7221 - protein, 61 aa, Homo sapiens [sequence omitted]

SEQ ID NO: 7222 - protein, 75 aa, Homo sapiens
MAGQEDPVQREIHQDWANREYIEIITSSIKKIADFLNSFDMSCRSRLATLNEKLTALERRIEYIEARVTKGETLT

SEQ ID NO: 7223 - protein, 75 aa, Homo sapiens; identical to SEQ ID NO: 7222

SEQ ID NO: 7224 - protein, 75 aa, Homo sapiens; identical to SEQ ID NO: 7222

SEQ ID NO: 7225 - protein, 75 aa, Homo sapiens; identical to SEQ ID NO: 7222

SEQ ID NO: 7226 - protein, 75 aa, Homo sapiens; identical to SEQ ID NO: 7222

SEQ ID NO: 7227 - protein, 75 aa, Homo sapiens; identical to SEQ ID NO: 7222

SEQ ID NO: 7228 - protein, 68 aa, Homo sapiens
MESKEERALNNLIVENVNQENDEKDEKEQVANKGEPLALPLNVSEYCVPRGNRSGSALGSPSCSIDGT

SEQ ID NO: 7229 - protein, 68 aa, Homo sapiens; identical to SEQ ID NO: 7228

SEQ ID NO: 7230 - protein, 76 aa, Homo sapiens
MESKEKRAVNSLSMENANQENEEKEQVANKGEPLALPLDAGEYCVPRGNRRRFRVRQPILQYRWDMMHRLGEPQQG

SEQ ID NO: 7231 - protein, 100 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKLRESS

SEQ ID NO: 7232 - protein, 55 aa, Homo sapiens
  UNSURE 35: Xaa = Ala,Gly
  UNSURE 36: Xaa = Leu,Val
MESKEKRAVNSLSMENANQENEEKEQVANKGEPLXXPLDAGEYCVPRGNRRRFRR

SEQ ID NO: 7233 - protein, 55 aa, Homo sapiens
  UNSURE 32: Xaa = Ala,Glu,Gly,Val
  UNSURE 54: Xaa = His,Asn,Arg,Ser
  UNSURE 53: Xaa = Phe,Ile,Leu
MESKEKRAVNSLSMENANQENEEKEQVANKGXPLALPLDAGEYCVPRGNRRRXXV

SEQ ID NO: 7234 - protein, 68 aa, Homo sapiens; identical to SEQ ID NO: 7228

SEQ ID NO: 7235 - protein, 103 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKAEGKAVES

SEQ ID NO: 7236 - protein, 115 aa, Homo sapiens
  UNSURE 112: Xaa = Ala,Pro
  UNSURE 86: Xaa = Gly,Arg,Trp
MESKEKRAVNSLSMENANQENEEKEQVANKGEPLALPLDAGEYCVPRGNRRRFRVRQPILQYRWDMMHRLGEPQARMREENMERIXEEVRQLMEKLREKQLSHSLRAVSTGXPSP

SEQ ID NO: 7237 - protein, 55 aa, Homo sapiens
  UNSURE 35: Xaa = Ala,Gly
  UNSURE 30: Xaa = Ile,Lys,Arg,Thr
  UNSURE 37: Xaa = Pro,Thr
MESKEKRAVNSLSMENANQENEEKEQVANXGEPLXLXLDAGEYCVPRGNRRRFRD

SEQ ID NO: 7238 - protein, 125 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKLREKQLSHSLRAVSTDPPHHDHHDEFCLMP

SEQ ID NO: 7239 - protein, 69 aa, Homo sapiens [sequence omitted]

SEQ ID NO: 7240 - protein, 67 aa, Homo sapiens [sequence omitted]

SEQ ID NO: 7241 - protein, 97 aa, Homo sapiens
  UNSURE 56: Xaa = Cys,Phe
MSHCASSGKVCIYVCISVSLNLPLCCKHLLYPSYYSYYLNQFLFCKTTGKDFGMKXSGEPSHPNLKNKNISVIWTIGLMYEVKYIPAYYKYAESFLV

SEQ ID NO: 7242 - protein, 92 aa, Homo sapiens
MLKAAAKRPELSGKNTISNNSDMAEVKSMFREVLPKQGPLFVEDIMTMVLCKPKLLPLKSLTLEKLEKMHQAAQNTIRQQEMAEKDQRQITH

SEQ ID NO: 7243 - protein, 69 aa, Homo sapiens [sequence omitted]

SEQ ID NO: 7244 - protein, 138 aa, Homo sapiens
MATKRLFGATRTWAGWGAWELLNPATSGRLLARDYAKKPVMKGAKSGKGAVTSEALKDPDVCTDPVQLTTYAMGVNIYKEGQDVPLKPDAEYPEWLFEMNLGPPKTLEELDPESREYWRRLRKQNIWRHNRLSKNKRL

SEQ ID NO: 7245 - protein, 63 aa, Homo sapiens
MLPRAAWSLVLRKGGGGRRGMHSSEGTTRGGGRCPPTPTAMPSATTPCQKSPSAQNSTLRSRP

SEQ ID NO: 7246 - protein, 56 aa, Homo sapiens
MIFCSHKLALLSIFPEHTPGVCKYSLPLLHTHRVFTSVTFCAYCSAPCLFHLTVII

SEQ ID NO: 7247 - protein, 56 aa, Homo sapiens [sequence omitted]

SEQ ID NO: 7248 - protein, 68 aa, Homo sapiens
  UNSURE 40: Xaa = Asp,Glu
  UNSURE 37: Xaa = Ile,Met
MGNDFINHVYVMKPPQEKNLNRRPSESFQVADHMEVXPRXGVKAPHPFSIPCPTYLFHLAVSKLHPLY

SEQ ID NO: 7249 - protein, 108 aa, Homo sapiens
MFPPDQLSVQINFPSVPTFAAITVLLCTCFKKKQQGSETKDGQPGARPETRPGPAWPKPSFMCVKRPPNVCEETTKQALFTSGHLDVYVQVTGDAMAWLGLRGLTPSS

SEQ ID NO: 7250 - protein, 56 aa, Homo sapiens
MTLTGAICEGVGLDNMKSFFSIYSIGFQSISGKYVFCPIVYVTGSESQHCSYHFCS

SEQ ID NO: 7251 - protein, 50 aa, Homo sapiens
MNLPRLASHWAWTCFTANVLLPKLYKLPGLLQKRDRVLLCCPEWNAVAQS

SEQ ID NO: 7252 - protein, 110 aa, Homo sapiens
MAETLLNISNNAGNTPGPAKLNSNSVVPQLLNPLLGTGLLGDMSSINNTLSNHQLTHLQSLLNNNQMFPPNQQQQQLLQGYRISRRSKDSPQFLAQLTITPWLVCFRTFR

SEQ ID NO: 7253 - protein, 108 aa, Homo sapiens
  UNSURE 37: Xaa = Asp,Glu,Gly
MGRHWLVEGRGRRGAGAGPEEMGTRQAVTEAARAEMXTGASHESLRPLEAGSLAANSSEEAALLPGARWFAEACYEELVQVKRLLSGNRLRVAAAGMEPTRIFCKHLY

SEQ ID NO: 7254 - protein, 60 aa, Homo sapiens
MKKKQTVQGTSANSSGRSTPRPPAPPSTPPIRPGSSPRRPRRRGPGASMASIMETIGLTQ

SEQ ID NO: 7255 - protein, 137 aa, Homo sapiens
MRGRAAFCHLCRLHWQSRHQSHPGSLSSLSTCCCDFKGNCTTRSDRFAECVLGCGSLAWRSCCWCKGDGLKSEGSRDARLKPALPRRPPAGPHTHCTGSVHWRICNRLLGAPHPCAVFQTPPFCLKVSVNEINCNLL

SEQ ID NO: 7256 - protein, 82 aa, Homo sapiens
  UNSURE 23: Xaa = Ala,Glu
  UNSURE 66: Xaa = Ala,Gly
  UNSURE 81: Xaa = Arg,Thr
  UNSURE 71: Xaa = Asp,His
  UNSURE 79: Xaa = Ile,Lys,Arg,Thr
MRKPAAGSSLTPEGAAPASGPAXAQDSTQASTPGSPLSPTEYERFFALLTPTWKQRLPAVSVQPTXAGIPXSSSWTNMXTXA

SEQ ID NO: 7257 - protein, 71 aa, Homo sapiens
MQAVSLLTNLKPFIGMGRAGGLWKSCICTLTTSGWSPSSYNTDSFCAIDWLKTGSSKLWSKPTHPLCSQDS

SEQ ID NO: 7258 - protein, 57 aa, Homo sapiens [sequence omitted]

SEQ ID NO: 7259 - protein, 54 aa, Homo sapiens
MGQVWPSMIQIRPCLLHLSTCCLWLILHYNSKIYIYIHTYIHIYVLLGPLQKKN

SEQ ID NO: 7260 - protein, 55 aa, Homo sapiens
  UNSURE 30: Xaa =  * ,Tyr
MNVAFFVGCGGWAVLQLNKQIEFCRKKTFXPIFILSHGDIFLLLSFPFFKHFYND

SEQ ID NO: 7261 - protein, 95 aa, Homo sapiens
MSFDCTMRPQQTLIKPITYNAMLAETSTVFHQNDVKIPDAKHVFTTFYAKTKSLLVNPVLFPNREDYIHLMGYDKEEFILYMEETSEEKRHKDDK

SEQ ID NO: 7262 - protein, 63 aa, Homo sapiens
  UNSURE 55: Xaa = Lys,Asn
  UNSURE 59: Xaa = Phe,Leu
MRVQILKDYVRQHFPATPLLDYALEVEKITTSKKPNLILNVDGLIGVAFVDMLRXCGAXTRGS

SEQ ID NO: 7263 - protein, 52 aa, Homo sapiens [sequence omitted]

SEQ ID NO: 7264 - protein, 78 aa, Homo sapiens
  UNSURE 4: Xaa = Asn,Thr
  UNSURE 54: Xaa = Lys,Asn
MEKXTLKFIMEQKRACIAKTILSQKNKAGGIMLPDFKLYYKAKVTKTAWYWYQXQRYRPMEQNRALRNNTTHLQPSDF

SEQ ID NO: 7265 - protein, 53 aa, Homo sapiens [sequence omitted]

SEQ ID NO: 7266 - protein, 117 aa, Homo sapiens
MKFQYKEDHPFEYRKKEGEKIRKKYPDRVPVIVEKAPKARVPDLDKRKYLVPSDLTVGQFYFLIRKRIHLRPEDALFFFVNNTIPPTSATMGQLYEDNHEEDYFLYVAYSDESVYGK

SEQ ID NO: 7267 - protein, 63 aa, Homo sapiens
  UNSURE 44: Xaa = Arg,Ser
  UNSURE 46: Xaa = Asp,Glu
MAATRCLRWGLSRAGVWLLPPPARCPRRALHKQKDGTEFKSIYXLXKALPPNLRARTPPGGSR

SEQ ID NO: 7268 - protein, 113 aa, Homo sapiens
  UNSURE 91: Xaa = Gly,Val
MNSTGGQTPRRDLEKVLTGEEKALRPGDPGFCARARVPMPSNKDYVVRPKWNVEMESSRFQATSKKGISRLDKQMRKFTDIRKKSRSAHAXKSALRATKCHCDLAWNVSPSLL

SEQ ID NO: 7269 - protein, 91 aa, Homo sapiens
  UNSURE 31: Xaa = Gly,Trp
MGFLRRLIYRRRPMIYVESSEESSDEQPDEXNHQLKVRILHLLKRERMREHLQLKGRSLKLIARNWFSQRLGVSLEMVLIPRGCACEMKSR

SEQ ID NO: 7270 - protein, 57 aa, Homo sapiens
MPSSQINYRYLFRREEDFTSQRVRFEIYTKKTTLHLMLHLMRHSFFYKLFFYSVSEH

SEQ ID NO: 7271 - protein, 69 aa, Homo sapiens [sequence omitted]

SEQ ID NO: 7272 - protein, 116 aa, Homo sapiens
  UNSURE 51: Xaa = Leu,Pro,Gln,Arg
  UNSURE 50: Xaa = Leu,Val
  UNSURE 46: Xaa = Pro,Arg
MAAHLVKRCTCLLREAARQAPSMAPVGRLRLAWVAHKTLTSSATSXISHXXGSLMELVEKERASTPYIEKQVDHLIKKATRQRSSWSYLVAVTTWTAIKQQWYLSGSLTCCLKARR

SEQ ID NO: 7273 - protein, 51 aa, Homo sapiens
MGTKGDCRLEGIEPTTASHGHSMFCKRQPVNSKMQAGGEGWPCSPKHNGRC

SEQ ID NO: 7274 - protein, 51 aa, Homo sapiens
MPLILQFRTTDQNIYLSSQLLYNSFCKQGYGMILMNNFFWKLVNLFSVLSF

SEQ ID NO: 7275 - protein, 72 aa, Homo sapiens [sequence omitted]

SEQ ID NO: 7276 - protein, 51 aa, Homo sapiens
  UNSURE 48: Xaa = Ala,Pro
  UNSURE 46: Xaa = Gly,Val
MVTDLFLELKNPLLIFLIHFAPPFFSSATVEAIEADEGKLASPLSXVXCNR

SEQ ID NO: 7277 - protein, 169 aa, Homo sapiens
  UNSURE 90: Xaa = Ile,Met,Thr
  UNSURE 126: Xaa = Lys,Gln
METGPSEEPSGRKESQDMCPPGLLVFAGSSEQDANLAKQFWISASMYPPSESQLVLRRDSSQRLPVARPRRSRGSENSHSSQSFHLASNXNRDIFAEALKIQESEEKVKYLQKAKTREEILQLLRXQREERISKELISLPYKPKAKEHKAKKVVSESDKEDQEEVKTLD

SEQ ID NO: 7278 - protein, 76 aa, Homo sapiens
MAGRKLALKTIDWVAFAEIIPQNQKAIASSLKSWNETLTSRLAALPENPPAIDWAYYKANVARLAWWMTLRRSLMR

SEQ ID NO: 7279 - protein, 85 aa, Homo sapiens [sequence omitted]

SEQ ID NO: 7280 - protein, 78 aa, Homo sapiens
  UNSURE 48: Xaa = Ile,Asn,Ser,Thr
  UNSURE 47: Xaa = Lys,Asn
MMNVRVASSVEFLLRRKRMKDVDNLKSIKEEWVCEKDLIINLLVIIXXQIVNILLIAFLRKLRRLVPNVCLPLNRRNR

SEQ ID NO: 7281 - protein, 95 aa, Homo sapiens
MSECIQISFAVCRIGIYTCFRALCCKGPPPARPEYDLVCIGLTGSGKTILLSKLCSESPDNVVSTTGFSIKAVPFQNAILNVKELGDFISLWGQR

SEQ ID NO: 7282 - protein, 158 aa, Homo sapiens
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEDDLEAARNELHSALQHPQLCTLPFLILANHQDKPAARSVQEKIQD

SEQ ID NO: 7283 - protein, 108 aa, Homo sapiens
  UNSURE 94: Xaa = Glu,Gly,Lys,Arg
MSDLRITEAFLYMDYLCFRALCCKGPPPARPEYDLVCIGLTGSGKTSLLSKLCSESPDNVVSTTGFSIKAVPFQNAILNVKELGGADNIRKYWXPATTKGSQGGNIWY

SEQ ID NO: 7284 - protein, 52 aa, Homo sapiens [sequence omitted]

SEQ ID NO: 7285 - protein, 110 aa, Homo sapiens [sequence omitted]

SEQ ID NO: 7286 - protein, 81 aa, Homo sapiens
  UNSURE 55: Xaa =  * ,Glu
  UNSURE 53: Xaa = Cys,Phe,Ser,Tyr
  UNSURE 54: Xaa = Ile,Asn,Ser,Thr
  UNSURE 56: Xaa = Ile,Ser
MSDLRITEAFLYMDYLCFRALCCKGPPPARPEYDLVCIGLTGSGKTSLLSKLXXXXPDNVVSTTGFSIKAVPFQNAILNVK

SEQ ID NO: 7287 - protein, 115 aa, Homo sapiens
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEMI

SEQ ID NO: 7288 - protein, 77 aa, Homo sapiens
MRFCPFAERTRLVLKAKGIRHEVININLKNKPEWFFKKNPFGLVPVLENSQGQLIYESAITCEYLDEAYPGEEAVAG

SEQ ID NO: 7289 - protein, 50 aa, Homo sapiens
  UNSURE 48: Xaa = Lys,Gln
  UNSURE 49: Xaa = Phe,Ile,Leu,Val
  UNSURE 34: Xaa = Pro,Arg
MLCMRLSGIRDILLAGACCRGDPPRPQVNQGSAXGPISSLAAVCNLGXXT

SEQ ID NO: 7290 - protein, 55 aa, Homo sapiens [sequence omitted]

SEQ ID NO: 7291 - protein, 91 aa, Homo sapiens
  UNSURE 7: Xaa = Ala,Ser
MAASSRXQVLSLYRAMLRESKRFSAYNYRTYAVRRIRDAFRENKNVKDPVEIQTLVNKAKRDLGVIRRQVHIGQLYSTDKLIIENRDMPRT

SEQ ID NO: 7292 - protein, 91 aa, Homo sapiens
MAASSRAQVLALYRAMLRESKRFSAYNYRTYAVRRIRDAFRENKNVKDPVEIQTLVNKAKRDLGVIRRQVHIGQLYSTDKLIIENRDMPRT

SEQ ID NO: 7293 - protein, 91 aa, Homo sapiens [sequence omitted]

SEQ ID NO: 7294 - protein, 60 aa, Homo sapiens
MAVLPAHSPWAPFPPPTSPCPHGLLVPRHSCMGVIHAGHLRHKERRQGAAERGSVKNFQQ

SEQ ID NO: 7295 - protein, 81 aa, Homo sapiens
MMFPLARNALSSLKIQSILQSMARHSHVKHSPDFHDKYGNAVLASGTAFCVATWVFTATQIGIEWNLSPVGRVTPKEWKHQ

SEQ ID NO: 7296 - protein, 62 aa, Homo sapiens
  UNSURE 62: Xaa =  * ,Gly
MMFPLARNALSSLKIQSILQSMARHSHVKHSPDFHDKYGNAVLASGTAFCVATWVFTATQIX

SEQ ID NO: 7297 - protein, 74 aa, Homo sapiens [sequence omitted]

SEQ ID NO: 7298 - protein, 81 aa, Homo sapiens; identical to SEQ ID NO: 7295

SEQ ID NO: 7299 - protein, 74 aa, Homo sapiens [sequence omitted]

SEQ ID NO: 7300 - protein, 162 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDIPITYPTTAPEIAVPELDGKTAKMYRGGKICLTDHFKPFWARNVPKFGLAHLMALGLGPWLAVEIPDLIQKGVIQHK

SEQ ID NO: 7301 - protein, 58 aa, Homo sapiens
MISAHCSVCLPGSRDSPASASRVAGSTGVCHHAWLIVCIFSRDRVSPCWQDGLDLLTS

SEQ ID NO: 7302 - protein, 90 aa, Homo sapiens
MSTAMNFGTKSFQPRPPDKGSFPLDHLGECKSFKEKFMKCLHNNNFENALCRKESKEYLECRMERKLMLQEPLEKLGFGDLTSGKSEAKK

SEQ ID NO: 7303 - protein, 75 aa, Homo sapiens
  UNSURE 62: Xaa =  * ,Leu
  UNSURE 56: Xaa =  * ,Lys
  UNSURE 60: Xaa =  * ,Lys,Asn,Ser,Thr,Tyr
  UNSURE 61: Xaa = Ala,Leu,Pro,Val
  UNSURE 64: Xaa = Cys,Gly,Trp
  UNSURE 59: Xaa = Cys,Phe,Ile,Leu,Met,Arg,Ser,Trp
  UNSURE 57: Xaa = Gly,Arg,Ser
  UNSURE 66: Xaa = His,Pro,Gln
  UNSURE 63: Xaa = Ile,Asn
  UNSURE 54: Xaa = Ile,Lys,Asn
  UNSURE 58: Xaa = Lys,Gln,Arg
  UNSURE 55: Xaa = Phe,Ile
  UNSURE 53,68: Xaa = Phe,Leu
  UNSURE 65: Xaa = Phe,Leu,Pro,Ser
MQKKTLFLKCGPGMMYIPGKERTAVTSDNAPFYGILINCILAGDTQVKQSCIXXXXXXXXXXXXXXFXLRMLIYG

SEQ ID NO: 7304 - protein, 55 aa, Homo sapiens
MTTFQLECTHCPRNPAFQGGSAFDSARRFVGPDGVGCGCGPGGDGAFASIVGHSF

SEQ ID NO: 7305 - protein, 64 aa, Homo sapiens
  UNSURE 3: Xaa = Ala,Gly,Pro,Arg
  UNSURE 16: Xaa = Gly,Arg
  UNSURE 13: Xaa = Gly,Val
  UNSURE 10: Xaa = Ile,Leu,Val
  UNSURE 12: Xaa = Leu,Arg
  UNSURE 33: Xaa = Lys,Arg
  UNSURE 11: Xaa = Lys,Asn,Arg,Ser
MIXASAFRPXXXXPNXVGMSCPHRDLPSAHCEXVFRCAMARCGATMWVVATETWRRSFCTLGNQ

SEQ ID NO: 7306 - protein, 71 aa, Homo sapiens
  UNSURE 42: Xaa = Glu,Gly
  UNSURE 41: Xaa = Phe,Ile
MTQGVTENKKIQYQDNQTTTGLQFIETRAVLTLRSVEEMSXXEWLVVTLFSPHPLNQTLKVLNPLNLLFFT

SEQ ID NO: 7307 - protein, 94 aa, Homo sapiens [sequence omitted]

SEQ ID NO: 7308 - protein, 110 aa, Homo sapiens
  UNSURE 108: Xaa = Arg,Ser,Thr
  UNSURE 109: Xaa = Cys,Phe
MGRLDGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRXXT

SEQ ID NO: 7309 - protein, 76 aa, Homo sapiens [sequence omitted]

SEQ ID NO: 7310 - protein, 98 aa, Homo sapiens
MALSKSMHARNRYKDKPPDFAYLASKYPDFKQHVQINLNGRVSLNFKDPEAVRALTCTLLREDFGLSNGYSIGETNSHSSLETQLYSLGRRSDRSPGF

SEQ ID NO: 7311 - protein, 67 aa, Homo sapiens
MTLLYALHTISTLTVMPSSTLYSPYHCLLRKTTQIQIKEMKQIDKLSLVVAHTCNPSTLGGRGGWTT

SEQ ID NO: 7312 - protein, 56 aa, Homo sapiens [sequence omitted]

SEQ ID NO: 7313 - protein, 56 aa, Homo sapiens
  UNSURE 8: Xaa = Pro,Arg
MTTYAGGXSSGLPQGLVSRACSFIRKIYILLIKERFVSNKVFVITHENATLSLCRL

SEQ ID NO: 7314 - protein, 52 aa, Homo sapiens
MSYGPLDMYRNPGPSGQPSGTSAASSRREAATSSGSAKPLLQIKNFDEPARN

SEQ ID NO: 7315 - protein, 108 aa, Homo sapiens
MASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 7316 - protein, 53 aa, Homo sapiens
MMTAVSLTTRPQESVAFEDVAVYFTTKEWAIMVPAERALYRDVMLENYEAVAL

SEQ ID NO: 7317 - protein, 102 aa, Homo sapiens
MMTAVSLTTRPQESVAFEDVAVYFTTKEWAIMVPAERALYRDVMLENYEAVAFVVPPTSKPALVSHLEQGKESCFTQPQGVLSRNDWRAGWIGYLELRRYTY

SEQ ID NO: 7318 - protein, 53 aa, Homo sapiens
  UNSURE 29: Xaa =  * ,Glu
MMENYDNLVSLGHSVSKPDLITLLEQGKXPWMIVREETRGECTELQSKNCGFN

SEQ ID NO: 7319 - protein, 80 aa, Homo sapiens
MAHGSVTFRDVAIDFSQEEWEFLDPAQRDLYRDVMWENYSNFISLGPSISKPDVITLLDEERKEPGMVVREGTRRYCPGE

SEQ ID NO: 7320 - protein, 71 aa, Homo sapiens
MVNVLKGVLIECDPAMKQFLLYLDESNALGKKFIIQDIDDTHVFVIAELVNVLQERVGELMDQNAFSLTQK

SEQ ID NO: 7321 - protein, 77 aa, Homo sapiens [sequence omitted]

SEQ ID NO: 7322 - protein, 57 aa, Homo sapiens [sequence omitted]

SEQ ID NO: 7323 - protein, 54 aa, Homo sapiens
MPVSPALWEAEAGRSPEDKSSRPAWPTWQNPISTKNTRISRCGGGHCNPIYLGG

SEQ ID NO: 7324 - protein, 64 aa, Homo sapiens [sequence omitted]

SEQ ID NO: 7325 - protein, 100 aa, Homo sapiens
  UNSURE 30: Xaa = Lys,Asn
MAASSQGNFEGNFESLDLAEFAKKQPWWRXCSGRNLDLQQKSIAWQPSCSLEVSLDGAQVSYSRRLESWLQQLWEVDFFSFSLQTILGTSKLTGNEWRRT

SEQ ID NO: 7326 - protein, 71 aa, Homo sapiens
  UNSURE 19: Xaa = Cys,Gly
  UNSURE 67: Xaa = Cys,Phe
  UNSURE 17: Xaa = Cys,Trp
MLTLPTNLRCVTQILLXAXVDIAIPCNNKWSSLSGFDVVDAGSGSFCACVHTISHEHPWEVMPQLCXLQRS

SEQ ID NO: 7327 - protein, 60 aa, Homo sapiens
MLPFFNHICITYGVWVLMRSWYHIWDFFLCKSSSIRRNYGTLSLALENLQWTNRCHQTSF

SEQ ID NO: 7328 - protein, 67 aa, Homo sapiens
  UNSURE 45: Xaa =  * ,Cys,Gly,Arg,Ser
  UNSURE 43: Xaa = Ala,Glu
  UNSURE 61: Xaa = Gly,Arg
MPAREVLRMRDTISHEHPWEVMPQLCFYRDPEEIEKEEQAAAXKXMTKEEFQGEWTAPAPXVHCYSA

SEQ ID NO: 7329 - protein, 82 aa, Homo sapiens
  UNSURE 74: Xaa =  * ,Gly,Arg,Trp
  UNSURE 64: Xaa = Ala,Gly
  UNSURE 62: Xaa = Arg,Ser
  UNSURE 75: Xaa = Asp,Glu
  UNSURE 11: Xaa = Asp,His
  UNSURE 61: Xaa = Leu,Val
  UNSURE 73: Xaa = Lys,Arg
MLTYLPLLCVXRFSSVLCGHCHPMQQQGSSLSGFDVVDAGSGKFCACVTPFPMNTPGRSCXXSXSTEILKRLXXXQAAAEKQ

SEQ ID NO: 7330 - protein, 100 aa, Homo sapiens
MAVSNIRYGAAVTKEVGMDLKNMGAKNVCLMTDKNLSKLPPVQVAMDSLVKNGIPFTVYDNVRWNQRIQASWKLLSLPKRELLMPMLLSVVALPWTPVSC

SEQ ID NO: 7331 - protein, 123 aa, Homo sapiens
MGNRVCCGGSWSCPSTFQKKKKRGSQTRRTLKPQPQQLQQNLPKGHETTGHTYERVLQHQGSQERSPGLMSEDSNLHYADIQVCSRPHAREVKHVHLENATEYATLRFPQATPRYDSKNGTLV

SEQ ID NO: 7332 - protein, 64 aa, Homo sapiens
MSTSVPQGHTWTQRVKKDDEEEDPLDQLISRSGCAASHFAVQECMAQHQDWRQCSHRCRRSRIA

SEQ ID NO: 7333 - protein, 55 aa, Homo sapiens
MVPGTLSGAGRAQACTSKVGWDQAAPRPSIQVLPWAPVALQTLRAKVLCCFLVPP

SEQ ID NO: 7334 - protein, 71 aa, Homo sapiens
MQKKKFCSVLFGNFFVLRLCEIHLFLAELKTYIIPISAGCLVSRNITYFGLWPGWVVLKVTECQVWLELKF

SEQ ID NO: 7335 - protein, 62 aa, Homo sapiens [sequence omitted]

SEQ ID NO: 7336 - protein, 80 aa, Homo sapiens
MARTLEPLAKKIFKGVLVAELVGVFGAYFLFSKMHTSQDFRQTMSKKYPFILEVYYKSTEKSGMYGIRELDQKTWLNSKN

SEQ ID NO: 7337 - protein, 80 aa, Homo sapiens; identical to SEQ ID NO: 7336

SEQ ID NO: 7338 - protein, 79 aa, Homo sapiens
  UNSURE 78: Xaa = Asp,Glu
MHPDLSPHLHTEECNVLINLLKECHKNHNILKFFGYCNDVDRELRKCLKNEYVENRTKSREHGIAMRKKLFNPPEESXK

SEQ ID NO: 7339 - protein, 54 aa, Homo sapiens
MCDAKEDAAFKVLSWKQRLCPHQMLNLLSTLIFHFTFIRTVFEELSHCLLQWMN

SEQ ID NO: 7340 - protein, 54 aa, Homo sapiens
  UNSURE 6: Xaa = Leu,Val
MIILTXFNLKVKGYELILKRLPVLLVHWGFNYVYIRACFQFYQNLRNKVEVQIG

SEQ ID NO: 7341 - protein, 67 aa, Homo sapiens
  UNSURE 49: Xaa =  * ,Tyr
  UNSURE 51: Xaa = Phe,Ile
MMSLKSYPTNFLYISIFPTLIFMMHYLICPECIMDICSYHLFFSINLMXLXSQICCLSTKKIYVVYP

SEQ ID NO: 7342 - protein, 121 aa, Homo sapiens
  UNSURE 87: Xaa = Ile,Val
MASEAEKTFHRFAAFGESSSSGTEMNNKNFSKLCKDCGIMDGKTVTSTGRGHRVQQSQGQERPNHHVSTVQRGSEGTGPEALQREEXQMKSLENIYGLMEGQRPSHHWALLKQQQWVQWTV

SEQ ID NO: 7343 - protein, 67 aa, Homo sapiens
MASEAEKTFHRFAAFGESSSSGTEMNNKNFSKLCKDCGIMDGKTVTSTDVTSCSAKSSEEPKIWRWG

SEQ ID NO: 7344 - protein, 73 aa, Homo sapiens
MASEAEKTFHRFAAFGESSSSGTEMNNKNFSKLCKDCGIMDGKTVTSTDVTSCSAKSRPRTPEPSRFNSSKRQ

SEQ ID NO: 7345 - protein, 58 aa, Homo sapiens
MASEAEKTFHRFAAFGESSSSGTEMNNKNFSKLCKDCGIMDGKTVTSTDVDIVFSKVK

SEQ ID NO: 7346 - protein, 73 aa, Homo sapiens; identical to SEQ ID NO: 7344

SEQ ID NO: 7347 - protein, 155 aa, Homo sapiens
  UNSURE 41: Xaa = Ala,Asp
  UNSURE 132: Xaa = Ala,Glu
  UNSURE 6,102: Xaa = Asp,Glu
  UNSURE 51: Xaa = Asp,His,Asn,Tyr
  UNSURE 131: Xaa = Lys,Asn
  UNSURE 7: Xaa = Lys,Gln
  UNSURE 56: Xaa = Lys,Thr
  UNSURE 137: Xaa = Ser,Thr
MASEAXXTFHRFAAFGESSSSGTEMNNKNFSKLCKDCGIMXGKTVTSTDVXIVFSXVKAKNARTITFQQFKEAVKELGQKRFKGKSPDEVLENIYGLMEGKXPATTGATKATTVGAVDRLTDTSKYTGTHXXRFDEXGKGKGIAGREEMTDTQAM

SEQ ID NO: 7348 - protein, 73 aa, Homo sapiens; identical to SEQ ID NO: 7344

SEQ ID NO: 7349 - protein, 52 aa, Homo sapiens; identical to SEQ ID NO: 6638

SEQ ID NO: 7350 - protein, 116 aa, Homo sapiens
MLRPKALTQVLSQANTGGVQSTLLLNNEGSLLAYSGYGDTDARVTAAIASNIWAAYDRNGTKRLMKTISNSSSWTAWPRLWCSTWRSPSPKWRHLNGIGGSWGQKREMTIWRGGAS

SEQ ID NO: 7351 - protein, 80 aa, Homo sapiens
MLRPKALTQVLSQANTGGVQSTLLLNNEGSLLAYSGYGDTDARVTAAIASNIWAAYDRNGTKRLMKTISNSSSWTAWRAV

SEQ ID NO: 7352 - protein, 80 aa, Homo sapiens; identical to SEQ ID NO: 7351

SEQ ID NO: 7353 - protein, 69 aa, Homo sapiens
MDNSNIVAMFEMMDSSGRGTISFVQYKEALKTLGLCTEDEDLQDDGHKITLDKFKEEVNKRMKEIWSAF

SEQ ID NO: 7354 - protein, 72 aa, Homo sapiens
MDNSNIVAMFEMMDSSGRGTISFVQYKEALKTLGLCTEDEDLQDDGHKITLDKFKEEVCIHPASLQAFARKF

SEQ ID NO: 7355 - protein, 103 aa, Homo sapiens
MTTEIGWWKLTFLRKKKSTPKVLYEIPDTYAQTEGDAEPPRPDAGGPNSDFNTRLEKIVDKSTKGKHVKVSNSGRFKEKKKVRATLAENPNLFDDHEEGRSSK

SEQ ID NO: 7356 - protein, 52 aa, Homo sapiens [sequence omitted]

SEQ ID NO: 7357 - protein, 56 aa, Homo sapiens
  UNSURE 18: Xaa = Gly,Trp
MEGWGMSSINPYGMHSQXPSHLGLEPLVQGLGENRPHGNSHTVIAFNTEPRVPKQQ

SEQ ID NO: 7358 - protein, 110 aa, Homo sapiens
MQAALEVTARYCGRELEQYGQCVAAKPESWQRDCHYLKMSIAQCTSSHPIIRQIRQACAQPFEAFEECLRQNEAAVGNCAEHMRRFLQCAEQVQPPRSPATVEAQPLPAS

SEQ ID NO: 7359 - protein, 91 aa, Homo sapiens
MAATVNLELDPIFLKALGFLHSKSKDSAEKLKALLDESLARGIDSSYRPSQKDVEPPKISSTKNISIKQEPKISSSLPSGNNMARSSQLKR

SEQ ID NO: 7360 - protein, 76 aa, Homo sapiens
  UNSURE 67: Xaa = Gly,Ile,Arg,Val
MGPQVCAPYSPPITYQRALQELLTNRLSMVLHSRINCTSVCAKSTRHWRNSRNNTWYRHMDLSGKRXGNKQEKARV

SEQ ID NO: 7361 - protein, 57 aa, Homo sapiens
MAHVSSETQDVSPKDELTASEASTRSPLCEHTFPGDSDLRSMIEEHAFKETLENSGK

SEQ ID NO: 7362 - protein, 55 aa, Homo sapiens
  UNSURE 2: Xaa = Ala,Gly
  UNSURE 8: Xaa = Ala,Thr
  UNSURE 50: Xaa = Cys,Phe
  UNSURE 29: Xaa = Cys,Trp
  UNSURE 7: Xaa = Glu,Gly
  UNSURE 42: Xaa = Met,Arg
MXHVSAXXQDVSPKDESTGSKASSGSPLXEHIIPGDSDLRSXTESMIFRXCHKDP

SEQ ID NO: 7363 - protein, 53 aa, Homo sapiens
  UNSURE 14: Xaa = Asp,Asn
MFLQKLKMFLLKMXQLGSKASSGSPLCEHIIPGDSDLRSMTESMIFRFCHKDP

SEQ ID NO: 7364 - protein, 68 aa, Homo sapiens
  UNSURE 35: Xaa = Gly,Val
MGEILRARASETFRHRAREGFQVPLSSCSQGELVXCYSSLRGSWFFATRAARWRFGVSEEDSTGHESW

SEQ ID NO: 7365 - protein, 68 aa, Homo sapiens
MSCTPKDSVLQLHPPVSLNINSERANLTGERTTRMRMSPTELNLSPEASCWPWNMAKALSVPVKERGK

SEQ ID NO: 7366 - protein, 51 aa, Homo sapiens
MCPLPLAAAAVAAPRAPLRLLNRGLAAAMSTAQSLKSVDYEVFGRVQGSPG

SEQ ID NO: 7367 - protein, 67 aa, Homo sapiens
MSSTVCNSPTNELFSPHIPPSLNPPMPIVFILRNTESQGASFHFPKGVALALWATTVFKLCGVTMTV

SEQ ID NO: 7368 - protein, 63 aa, Homo sapiens [sequence omitted]

SEQ ID NO: 7369 - protein, 75 aa, Homo sapiens
  UNSURE 27: Xaa = Gly,Arg
MPGPTPSGTNVGSSGRSPSKAVAARAXDPLSGRGKMPAVGQGVQAAQPRQAPGGCGDSTQKIHLGSKLALFQYWL

SEQ ID NO: 7370 - protein, 52 aa, Homo sapiens
  UNSURE 27: Xaa = Gly,Arg
MPGPTPSGTNVGSSGRSPSKAVAARAXDPLSGRDFNREPAQVISIPGTHHKA

SEQ ID NO: 7371 - protein, 75 aa, Homo sapiens; identical to SEQ ID NO: 7369
  UNSURE 27: Xaa = Gly,Arg

SEQ ID NO: 7372 - protein, 91 aa, Homo sapiens
MLSNLHELLPNHLMETLYSRKSEEDKKKCENPELSGLERILARHQLPKEINLTPKPNRMPPWKRKIINNVTDGWKKCHLLKRTRKSLQCPP

SEQ ID NO: 7373 - protein, 68 aa, Homo sapiens
MFILPKASSRHNAIPIKIPMTFFKEIEKTILKFVWNHKRPQITKAILNKKKKKLEASHCLASKYTTRL

SEQ ID NO: 7374 - protein, 101 aa, Homo sapiens
MDVFLMIRRHKTTIFTDAKESSTVFELKRIVEGILKRPPDEQRLYKDDQLLDDGKTLGECGFTSQTARPQAQPQWGWPSGQMTPLRPCASSRFPARQSCPM

SEQ ID NO: 7375 - protein, 66 aa, Homo sapiens
MDVFLMIRRHKTTIFTDAKESSTVFELKRIVEGILKRPPDEQRLYKMTPLRPCASSRFPARQSCPM

SEQ ID NO: 7376 - protein, 58 aa, Homo sapiens; identical to SEQ ID NO: 7301

SEQ ID NO: 7377 - protein, 65 aa, Homo sapiens
  UNSURE 19: Xaa = Ala,Pro
  UNSURE 41: Xaa = Cys,Trp
  UNSURE 63: Xaa = Glu,Gly
MLTRLVLNSWPQVILPLQXSQYAGITGMRRQAWHWFCFCSXLYPSMDMCITEIELDKYLLNNXLN

SEQ ID NO: 7378 - protein, 92 aa, Homo sapiens
  UNSURE 41: Xaa = Ala,Pro
MKKDGLVGMASWEAWPWVWRDWPDSSDLLCPSPNPEGDAGXTENAPGGPVHPRCPFPVLPLPPVSILCGLQLISAPLRFVLQPHHVLWDECK

SEQ ID NO: 7379 - protein, 89 aa, Homo sapiens
  UNSURE 38: Xaa = Ala,Pro
MDSWAWPSWEAWPWVWRDWPDSSDLLCPSPNPEGDAGXTENAPGGPVHPRCPFPVLPLPPVSILCGLQLISAPLRFVLQPHHVLWDECK

SEQ ID NO: 7380 - protein, 65 aa, Homo sapiens [sequence omitted]

SEQ ID NO: 7381 - protein, 68 aa, Homo sapiens
  UNSURE 55: Xaa = His,Asn
  UNSURE 56: Xaa = Leu,Val
  UNSURE 65: Xaa = Lys,Gln
  UNSURE 12: Xaa = Pro,Arg
METGPEDPSSMXEESSPRRTPQSIPYQDLPQPGQCRRTVPLLQVLETHRHTQGPXXCVPWSRRAXWPL

SEQ ID NO: 7382 - protein, 80 aa, Homo sapiens
MRKVVLITGASSGIGLALCKRLLAEDDELHLCLACRNMSKAEAVCAALLASHPTARSPLSRWMSATCSHSSGPPRNLSKG

SEQ ID NO: 7383 - protein, 83 aa, Homo sapiens [sequence omitted]

SEQ ID NO: 7384 - protein, 102 aa, Homo sapiens
MADDVDQQQTTNTVEEPLDLIRLSLDERIYVKMRNDRELRGRLHAYDQHLNMILGDVEETVTTIEIDEETYEEIYKSTKRNIPMLFVRGDGVVLVAPPLRVG

SEQ ID NO: 7385 - protein, 69 aa, Homo sapiens
METESGNQEKVMEEESTEKKKEVEKKKRSRVKQVLADIAKQVDFWFGDANLHKDRFLREQIEKSRDGYG

SEQ ID NO: 7386 - protein, 57 aa, Homo sapiens [sequence omitted]

SEQ ID NO: 7387 - protein, 65 aa, Homo sapiens
MNIRNAQPDDLMNMQHCNLLCLPENYQMKYYLYHGLSWPQLSYIAEDEDGKIVGYVLAKMGGGTR

SEQ ID NO: 7388 - protein, 112 aa, Homo sapiens
MFSKMATYLTGELTATSEDYKLLENMNKLTSLKYLEMKDIAINISRNLKDLNQKYAGLQPYLDQINVIEEQVAALEQAAYKLDAYSKKTGSQVQEAGEAMRNLFLWDRVFFF

SEQ ID NO: 7389 - protein, 74 aa, Homo sapiens
MAPTIQTQAQREDGHRPIPTGLCLRGLEWSAESSTAIASLISPSTPSSSPTPSTRTGSSSTKPLPWRNSTNMTS

SEQ ID NO: 7390 - protein, 50 aa, Homo sapiens [sequence omitted]

SEQ ID NO: 7391 - protein, 59 aa, Homo sapiens [sequence omitted]

SEQ ID NO: 7392 - protein, 116 aa, Homo sapiens
  UNSURE 112: Xaa = Asp,Asn
  UNSURE 19: Xaa = Ile,Lys,Arg,Thr
  UNSURE 108: Xaa = Ser,Thr
MGGAVSAGEDNDELIDNLXEAQYIRTELVEQAFRAIDRADYYLEEFKENAYKDLAWKHGNIHLSAPCIYSEVMEALDLQPGLSFLNLGSGTGYLSSMVGLILGPFGVXMGWXFTQM

SEQ ID NO: 7393 - protein, 75 aa, Homo sapiens
  UNSURE 4: Xaa = Ala,Asp,Gly,Val
MRTXPSAKDQESCPHDPLPQHIHFQSSARNLCAENRRKAQGAAALPTGPFHSQASSAKAGREETHSPPNPYDQGL

SEQ ID NO: 7394 - protein, 70 aa, Homo sapiens
  UNSURE 27: Xaa = Asn,Thr
MWAFSRVKIQVLTTVYLQFPLKKKKVXLAAIEYTMCIYNSYFIYCSINIFKLNVLHSQVVGSLVIKVCVI

SEQ ID NO: 7395 - protein, 63 aa, Homo sapiens [sequence omitted]

SEQ ID NO: 7396 - protein, 60 aa, Homo sapiens
  UNSURE 54: Xaa =  * ,Ser
  UNSURE 51: Xaa = Cys,Gly
  UNSURE 52: Xaa = Glu,Gln
  UNSURE 50: Xaa = Lys,Asn
  UNSURE 53: Xaa = Phe,Val
MVKLTLLNIYHVPSCRLNSFYVLYHLVLTVNPCGAYHHYLRKLRLRDRVXXXXXGHTSRK

SEQ ID NO: 7397 - protein, 58 aa, Homo sapiens
  UNSURE 18: Xaa =  * ,Glu,Lys
  UNSURE 30: Xaa =  * ,Gly
  UNSURE 19: Xaa = Ala,Thr
  UNSURE 13: Xaa = Arg,Ser
  UNSURE 20: Xaa = Gln,Arg
  UNSURE 24: Xaa = Pro,Thr
MPVIPALWEAKVXGFPFXXXDFKXSLANMXNPITTKNTKISQAQWHMPVIPASQEAEA

SEQ ID NO: 7398 - protein, 60 aa, Homo sapiens
MRLSPFHLQLEFHMKEKREDLQISWSFISVPEMAVNIQPKHWGRTRWLRQVRCLTFSRTS

SEQ ID NO: 7399 - protein, 60 aa, Homo sapiens
  UNSURE 40: Xaa = Ala,Pro,Thr
MRHPLSVSHKPAKKMDVARITFDLNKLSPQDFISCLNVKXTFYDVYSISYDLHCMRLSAW

SEQ ID NO: 7400 - protein, 83 aa, Homo sapiens [sequence omitted]

SEQ ID NO: 7401 - protein, 59 aa, Homo sapiens
  UNSURE 25: Xaa = His,Ile,Leu,Asn,Pro,Arg,Ser,Thr
  UNSURE 29: Xaa = Lys,Asn
  UNSURE 30: Xaa = Met,Arg
MLCCLPPGTELLGGTYAFTVCAICXLIPXXNALKSFEVRSFNSYFLLHWSLFFYCSIRC

SEQ ID NO: 7402 - protein, 66 aa, Homo sapiens
  UNSURE 34: Xaa = Asn,Thr
  UNSURE 37: Xaa = Glu,Gly
  UNSURE 33: Xaa = His,Gln
MHILHEKVCILFEYIMNLGVYKGLRMSDKISWXXPAXWMIFILENDELINLYMKSNKQSLLFLEQK

SEQ ID NO: 7403 - protein, 68 aa, Homo sapiens [sequence omitted]

SEQ ID NO: 7404 - protein, 61 aa, Homo sapiens
MEIDVRSEYWSYTSISELILSSHEKESSFKVQLLSLLEANFFSFIFLNINILLYGLKRPHE

SEQ ID NO: 7405 - protein, 58 aa, Homo sapiens; identical to SEQ ID NO: 7301

SEQ ID NO: 7406 - protein, 98 aa, Homo sapiens
MRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRVD

SEQ ID NO: 7407 - protein, 122 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRVSN

SEQ ID NO: 7408 - protein, 120 aa, Homo sapiens
MSSLYPSLEDLKVDQAIQAQVRASPKMPALPVQATAISPPPVLYPNLAELENYMGLSLSSQEVQESLLQIPEGDSTAVSGPGPGQMVAPVTGTAWACGELRSSPGCARSTCARTSAARPG

SEQ ID NO: 7409 - protein, 52 aa, Homo sapiens
MPMWNARCEPSWYSWKKHPARTVSLTVIIPGASTHTHIPTILECFCFMKQKE

SEQ ID NO: 7410 - protein, 63 aa, Homo sapiens
  UNSURE 13: Xaa =  * ,His,Gln,Tyr
  UNSURE 30,63: Xaa = Ala,Pro
  UNSURE 2: Xaa = Gly,Arg
MXLRPWRGVARPXTRLPAVRRAVYLCHAQXWQVLQAALVLSPRMVSLQIHVSAYDPCGTASKX

SEQ ID NO: 7411 - protein, 81 aa, Homo sapiens
MVAPVTFASIVEEELQQEAALIRSREKPLALIQIEEHAIQDLLVFYEAFGNPEEFVIVERTPQDHWQYLCGISMDASSLWS

SEQ ID NO: 7412 - protein, 70 aa, Homo sapiens
MPHIDNDVKLDFKDVLLRPKRSTLKSRSEVDLTRSFSFRNSKQTYSGVPIIAANMDTVGTFEMAKVLCKS

SEQ ID NO: 7413 - protein, 158 aa, Homo sapiens
MAAVAAGGLVGKGRDISLAALQRHDPYINRIVDVASQVALYTFAHRANEWEKTDVEGTLFVYTRSASPKHGFTIMNRLSMENRTEPITKDLDFQLQDPFLLYRNARLSIYGIWFYDKEECQRIAELMKNLTQYEQLKAHQGTGAGISPVILNSGEGKK

SEQ ID NO: 7414 - protein, 58 aa, Homo sapiens; identical to SEQ ID NO: 7301

SEQ ID NO: 7415 - protein, 88 aa, Homo sapiens
MALSTIVSQRKQIKRKAPRGFLKRVFKRKKPQLRLEKSGDLLVHLNCLLFVHRLAEESRTNACASKCRVINKEHVLAAAKVILKKSRG

SEQ ID NO: 7416 - protein, 88 aa, Homo sapiens; identical to SEQ ID NO: 7415

SEQ ID NO: 7417 - protein, 56 aa, Homo sapiens; identical to SEQ ID NO: 6275

SEQ ID NO: 7418 - protein, 96 aa, Homo sapiens
MPRLEVQSFLDFAPHYFNYITNAVQQKRPTALAKILGVYRIGYKNSQNNTEKKLDLLVMENLFYGRKMAQVFDLKGSLRNRNVKTDTGKESCDVVL

SEQ ID NO: 7419 - protein, 58 aa, Homo sapiens
MKSAPFPSGFSKYEQRRHKTQVPETVPATIRLISRHTGPCSPLRLGSWTRVLRSDRRA

SEQ ID NO: 7420 - protein, 62 aa, Homo sapiens
  UNSURE 12: Xaa = Ala,Gly
MAHPERAWKLRXPSHRLSPIHLFIWCSSIAFVMSLIVNRKTCTPNSMVRKPQKDVSKDHEGV

SEQ ID NO: 7421 - protein, 106 aa, Homo sapiens
MMATGTPESQARFGQSVKGLLTEKVTTCGTDVIALTKQVLKGSRSSELLGQAARNMVLQEDAILHSEDSLRKMAIITTHLQYQQEAIQKNVEQSSDLQDQLNHLLK

SEQ ID NO: 7422 - protein, 55 aa, Homo sapiens [sequence omitted]

SEQ ID NO: 7423 - protein, 78 aa, Homo sapiens
MPRQPQSHDEGQLRTRCAQNHRSGSLDPALSARYLNGDSSSFGVPSAGSTTTLLLGLGIKPCQVARKAGGRAGRHHLT

SEQ ID NO: 7424 - protein, 53 aa, Homo sapiens
MQNCRTRSGGWIQRTWGSVWAVLVKEGFQGEATEDSLQLFLEKMRIRSGIGNI

SEQ ID NO: 7425 - protein, 90 aa, Homo sapiens
MSARKLRNLSYKKAVRRQKLLEQSIQSAQETEKSLHLIQESLTFIDKQLAAYIADKVDAAQMPQEAQASTSGNQLPFFCFYYFNKMLQCF

SEQ ID NO: 7426 - protein, 90 aa, Homo sapiens; identical to SEQ ID NO: 7425

SEQ ID NO: 7427 - protein, 63 aa, Homo sapiens [sequence omitted]

SEQ ID NO: 7428 - protein, 59 aa, Homo sapiens; identical to SEQ ID NO: 5025

SEQ ID NO: 7429 - protein, 59 aa, Homo sapiens; identical to SEQ ID NO: 5025

SEQ ID NO: 7430 - protein, 55 aa, Homo sapiens
MAEQEQRKIPLVPENLLKKRKAYQALKATQAKQALLAKKEVMVGNQEKVIRIFIW

SEQ ID NO: 7431 - protein, 59 aa, Homo sapiens; identical to SEQ ID NO: 5025

SEQ ID NO: 7432 - protein, 59 aa, Homo sapiens; identical to SEQ ID NO: 5025

SEQ ID NO: 7433 - protein, 60 aa, Homo sapiens
MLSMSSLNILHIWNSAVIIVLMSTSTNVKSCISSGSISIDQMPSLNEICIVLLLCKPGNF

SEQ ID NO: 7434 - protein, 80 aa, Homo sapiens
  UNSURE 48: Xaa = Ile,Ser
MNCSRCVVWGSQMAILCMCIWYHGPWNRIYVGPLKSCKGPILSILHGXQKLMVVAAEVWLLDEADFFFLTWNNETNNKHF

SEQ ID NO: 7435 - protein, 59 aa, Homo sapiens
MIKGYYCYPHFSYEAWRGSMARPGAPGEMGCRARNNPEPAHSATRLSGSTGPDTSFTSL

SEQ ID NO: 7436 - protein, 58 aa, Homo sapiens; identical to SEQ ID NO: 7301

SEQ ID NO: 7437 - protein, 63 aa, Homo sapiens
  UNSURE 9: Xaa = Ala,Cys,Gly,Ser,Trp
  UNSURE 8: Xaa = Asp,Glu,His,Gln
MLTAWSAXXMLCERIAIAKELIKRAESLSRSRKGGIEGGAKLCSKLKAGIKILAESRSWESSY

SEQ ID NO: 7438 - protein, 50 aa, Homo sapiens
MNHLDSSMKWSEPRRAQPTEALWEPVSKARLAKCHLILNLVGPHSPSARS

SEQ ID NO: 7439 - protein, 60 aa, Homo sapiens
MQSARAWLPGDCTSRDGVASAFSGATLLQLPPLPGAPGKKECQVDMQSLWREAVLFAGLW

SEQ ID NO: 7440 - protein, 59 aa, Homo sapiens
  UNSURE 39: Xaa = Leu,Pro,Gln,Arg
MSVLLPSPKKSHAGRGGNQSSALPGSPWSPWEILSLQRXKSPGPIAETPGHCSTAAAER

SEQ ID NO: 7441 - protein, 112 aa, Homo sapiens
MYRTKVGLKDRQQLYKLIISQLLYDGYISIANGLINEIKPQSVCAPSEQLLHLIKLGMENDDTAVQYAIGRSDTVAPGTGLTWNLMQMFRLCPQRLLSTKHAMSHHIKDHAV

SEQ ID NO: 7442 - protein, 53 aa, Homo sapiens
MMSAAAIANGGGVASGSLVATLQSLGATGLSGLTKFILGSIGSAIAAVIARFY

SEQ ID NO: 7443 - protein, 75 aa, Homo sapiens; identical to SEQ ID NO: 6647

SEQ ID NO: 7444 - protein, 53 aa, Homo sapiens; identical to SEQ ID NO: 7442

SEQ ID NO: 7445 - protein, 97 aa, Homo sapiens
MTILCQENENVRYFHYRESHFPLIVSGRKKATQINLFRTIFSYLYMSYMLSCSKTTLFLDTAFQNLWDSTLKKKKEYLALHIILFWGSLISTLISES

SEQ ID NO: 7446 - protein, 83 aa, Homo sapiens
  UNSURE 62: Xaa = Gly,Val
  UNSURE 16: Xaa = Leu,Val
MGKESGWDSGRAAVAXLVGGFVAVGTVLVALSAMGFTSVGIAASSIAAKMMSTAAIANGGGXCCWQSGGYSAVSGGSWTLCDI

SEQ ID NO: 7447 - protein, 91 aa, Homo sapiens [sequence omitted]

SEQ ID NO: 7448 - protein, 56 aa, Homo sapiens
MRVRGKLSPTERIQIGREKKKDQRWFMWAAPHNPAQTLLRHQDLQDSYEETEAKEC

SEQ ID NO: 7449 - protein, 71 aa, Homo sapiens
  UNSURE 17: Xaa = Asp,Glu
MLSRVSPVLQGSHKASXLLPKQLYILSEQWGSSFSLELKRFICGTSLPSILQFQVQKGTKAQIQCLEGLNF

SEQ ID NO: 7450 - protein, 58 aa, Homo sapiens
MLVTINEGRVCRTLEISPEIQPNSIPGPKTLKNLELESSRLEASTDCRIQGDICRLAL

SEQ ID NO: 7451 - protein, 53 aa, Homo sapiens
MLDTEKELLKEKIKEALIQQSQEQKEILEKCLEEERQRNKEALVSAANLKKKQ

SEQ ID NO: 7452 - protein, 81 aa, Homo sapiens
  UNSURE 75: Xaa =  * ,Leu
  UNSURE 68: Xaa = Ala,Gly
  UNSURE 72: Xaa = Ala,Pro
  UNSURE 66,69: Xaa = Asp,Glu
  UNSURE 80: Xaa = Cys,Gly
MQLNRQTRSVNHMKAWNLMNLIPSLTGEMQIPSYPLSRDGELKSKRGSENALSLSTSSIGKPVTTXFXXGKXNGXWIQCXL

SEQ ID NO: 7453 - protein, 125 aa, Homo sapiens
MERHTSHPNRKVPAKEEANAVPLCRAKPSPSYINLQASSPPATFLNIQTTKLPSVDHKPKECLGLLECMYANLQLQTQLAQQQMAVLEHLQASVTQLAPGRGSNNSSLPALSPNPLLNHLPQFSK

SEQ ID NO: 7454 - protein, 107 aa, Homo sapiens
MCVLELKDARLLSPCSFPLFNLMFFGIKTSLPSSTWFYAQHALTVEKRPLAHIEGMVMEMPIHGIRWHSYVGSYSRSLLGKDSSREGRYHWRTMHEDREEMIGIMKH

SEQ ID NO: 7455 - protein, 69 aa, Homo sapiens
MYSHQEDLKVWSLVEKKLILGEASCHVMKTLKKPCEEEARPANNSQHQLSSQGIEPSHSGSSSPHQAFI

SEQ ID NO: 7456 - protein, 56 aa, Homo sapiens
MQEMSDFHSFLSPYSTQEVQLAPPLDHKFQVNLDISNNLSFAVNYKIFQFDHWRLT

SEQ ID NO: 7457 - protein, 144 aa, Homo sapiens
MNEVKESLRSIEQKYKLFQQQQLTFTAALEHCRENAHDKIRPISSIGQVQSYMEHYCNSSTDRRVLLMFLDICSELNKLCQHFEAVHSGTPVTNNLLEKCKTLVSQSNDLSSLRAKYPHDVVNHLSCDEARNHYGGVVSLIPLI

SEQ ID NO: 7458 - protein, 66 aa, Homo sapiens
  UNSURE 12: Xaa =  * ,Glu,Lys,Gln
  UNSURE 48: Xaa = Ala,Val
  UNSURE 17: Xaa = Phe,Ile
MTWSGVTARTEXARPAXLNTLGWWGCGKKRVCFFTSSTESAHYGCPLXPRTHNMKEMVLPSSSLGL

SEQ ID NO: 7459 - protein, 220 aa, Homo sapiens
MPMWNKVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIENRHTSVRSC

SEQ ID NO: 7460 - protein, 71 aa, Homo sapiens
  UNSURE 19: Xaa = Asp,Glu
MELSAEYLREKLQRDLEAXMWRWRTRPSTVAPVASESWWCRPSSRGNRCFRDTGSVQSNEMCDGCKPGVFF

SEQ ID NO: 7461 - protein, 55 aa, Homo sapiens
  UNSURE 19: Xaa = Asp,Glu
MELSAEYLREKLQRDLEAXMWRWRTRPSTVAPVASESWWCRPSSRGNRCFRDTGW

SEQ ID NO: 7462 - protein, 57 aa, Homo sapiens
MIKTTILLSSIQVLMSILKRRELKKFCRNCFLHHISKDLLRISEVPRVERSEPKKLI

SEQ ID NO: 7463 - protein, 69 aa, Homo sapiens
MIKTTILLSSIQVLMSILKRRELKKFCRNCFLHHISKDLLRISEVPRVERSEPKNSSEVFGQMKSMAAD

SEQ ID NO: 7464 - protein, 66 aa, Homo sapiens
  UNSURE 47: Xaa =  * ,Glu
  UNSURE 58: Xaa = Ile,Ser
MVRAAVAATKAWLSGGVLRCWEPWGGRGRGIGKSRSLGVRAQALAWXRPRRGLGKEGXGHLWVRLA

SEQ ID NO: 7465 - protein, 139 aa, Homo sapiens
MLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKFEAFEHENKFYINPGSAHWGI

SEQ ID NO: 7466 - protein, 123 aa, Homo sapiens
MAGHRLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKF

SEQ ID NO: 7467 - protein, 142 aa, Homo sapiens
  UNSURE 141: Xaa = Asp,Glu
  UNSURE 139: Xaa = Ile,Met
MAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSITCKTRSRSFXNXR

SEQ ID NO: 7468 - protein, 70 aa, Homo sapiens
MDDPKSEQQRILRRHQRERQELQAQIRSLKNSVPKTDKTKRKQLLQDVARMEGRDGSEAPAGAGEVPRRQ

SEQ ID NO: 7469 - protein, 51 aa, Homo sapiens
MLQRSLRICFKLGGGLEIQKSLCSTGLFSCLCKKFRFLFQHLERHSSPPRR

SEQ ID NO: 7470 - protein, 78 aa, Homo sapiens [sequence omitted]

SEQ ID NO: 7471 - protein, 56 aa, Homo sapiens
  UNSURE 42: Xaa = Ile,Asn,Ser,Thr
  UNSURE 23: Xaa = Leu,Arg
MPVCDVGKKKKASDITEGLCIFXFSEPPPLTLITQTLTEPRXPNSADLRTFEDYLP

SEQ ID NO: 7472 - protein, 136 aa, Homo sapiens
  UNSURE 89: Xaa = Ala,Pro
  UNSURE 99: Xaa = Asn,Tyr
MARTKQTARKSTGGKAPRKQLATKAARKSAPSTGGVKKPHRYRPGTVALREIRRYQKSTELLIRKLPFQRLVREIAQDFKTDLRFQSAXSVRCRRLAKXLVGLFEDTNLCAIHAKRVTIMPKDIQLARRIRERELK

SEQ ID NO: 7473 - protein, 72 aa, Homo sapiens
  UNSURE 72: Xaa = Gly,Arg,Trp
MARTKQTARKSTGGKAPRKQLATKAARKSAPSTGGVKKPHRYRPGTVALREIRRYQKSTELLIRKLPLPEVX

SEQ ID NO: 7474 - protein, 86 aa, Homo sapiens
  UNSURE 54: Xaa =  * ,Glu,Lys,Gln
  UNSURE 61: Xaa = Asp,Gly
  UNSURE 68: Xaa = Glu,Gly
  UNSURE 65: Xaa = Lys,Arg
MDDAHESPSDKGGETGESDETAAVPGDPGATDTDGIPEETDGDADVDLKEAAAXEGEVGRXVLMXLKXLPRDCVTGCSPGFCRIEE

SEQ ID NO: 7475 - protein, 90 aa, Homo sapiens
MRISSCSDESSNSNSSRKSDNHSPAVVTTTVSSKKQPSVLVTFPKEERKSVSGKASIKLVPIFIFNIYSVIMKYLITEFVGKKVNLQLAK

SEQ ID NO: 7476 - protein, 72 aa, Homo sapiens
MIERQRVASLQGTSSSRHGITLREKTDKGRGSCDGISQMPAWPLPLRGLGLLLTLAGWYKLPAQIKLCLMLP

SEQ ID NO: 7477 - protein, 55 aa, Homo sapiens
  UNSURE 19: Xaa =  * ,Leu
  UNSURE 28: Xaa = Gly,Ser
MGCEELAEQRQASQMERTXGECRPLVEXRTECGQTWSKRDIITALKESTMHEGSI

SEQ ID NO: 7478 - protein, 151 aa, Homo sapiens
MTKIKADPDGPRLRRRRVPGSAPTRSCWSTRTPSRTPGFSPPHAKLYKCIKKAVKQKQIRRGVKEVQKFVNKGEKGIMVLAGDTLPIEVYCHLPVMCEDRNLPYVYIPSKTDLGAAASKRPTCVIMVKPHEEYQEAYDECLEEVQSLPLPL

SEQ ID NO: 7479 - protein, 88 aa, Homo sapiens
  UNSURE 58: Xaa = Ala,Asp,Gly,His,Leu,Pro,Arg,Val
MLLSPGEVTSTIKGGSEMASGFLGVGQGPAGGFPSRCTEGSAEPTVCRGCVPRALPRXPPALASALQGGVPILGAVCHAHLTQVCVPV

SEQ ID NO: 7480 - protein, 123 aa, Homo sapiens
  UNSURE 117: Xaa = His,Gln
  UNSURE 36: Xaa = Pro,Arg,Ser,Thr
MTKIKADPDGPRLRRRRVPGSAPTRSCWSTRTPSRXPGFSPPHAKLYKCIKKAVKQKQIRRGVKEVQKFVNKGEKGIMVLAGDTLPIEVYCHLPVMCEDRNLPYVYIPSKTDLGAAXPSAPPV

SEQ ID NO: 7481 - protein, 73 aa, Homo sapiens
MPTSSSFKHRIKEQEDYIRDWTAHREEIARISQDLALIAREINDVAGEIDSVTSSGTAPSTTVSTAATTPGSA

SEQ ID NO: 7482 - protein, 50 aa, Homo sapiens
MLGPAVLTAVLLLTHHVMEQPTVLKPRFLHLQNNHLRPSSLRALLPEPSM

SEQ ID NO: 7483 - protein, 113 aa, Homo sapiens
MLGPQVWSSVRQGLSRSLSRNVGVWASGEGKKVDIAGIYPPVTTPFTATAEVDYGKLEENLHKLGTFPFRGFVVQGSNGEFPFLTSSERLEVVSRVRQAMPKNRLLLAGSGCE

SEQ ID NO: 7484 - protein, 120 aa, Homo sapiens
  UNSURE 96: Xaa = Gly,Trp
MSFEELLKVFWENHDPTQGMRQGNDHGTQYRSAIYPTSAKQMEAALSSKENYQKVLSEHGFGPITTDIREGQTFYYAEDYHQQYLSKNPNGYCGLXGTACPAQWVLKNNCSPHGGPLRFQ

SEQ ID NO: 7485 - protein, 119 aa, Homo sapiens
  UNSURE 101: Xaa = Arg,Thr
MRPGGFLGAGQRLSRAMSRCVLEPRPPGKRWMVAGLGNPGLPGTRHSVGMAVLGQLARRLGVAESWTRDRHCAADLALAPLGDAQLVLLRPRLLMNANGRXWPGLRTVWADCRGSLPGA

SEQ ID NO: 7486 - protein, 63 aa, Homo sapiens
MVMKLELGLHECSLPVSPLGSIATRFLEEEELRSHHILERLDAHIEELKRESEKTVRQFTALK

SEQ ID NO: 7487 - protein, 139 aa, Homo sapiens
MATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARVWDFFSSNKRSVI

SEQ ID NO: 7488 - protein, 162 aa, Homo sapiens
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVIVSFEFGSLKKCLRYGVQK

SEQ ID NO: 7489 - protein, 104 aa, Homo sapiens
MFIQNLLWEKNMRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 7490 - protein, 65 aa, Homo sapiens
MGLGPWGCGRPGIQGMPWGSFTRMETGSPRILPSSATEPEMGLQDDTSTSGTALQVSHLGFTIAG

SEQ ID NO: 7491 - protein, 120 aa, Homo sapiens
MDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLSC

SEQ ID NO: 7492 - protein, 81 aa, Homo sapiens
MSYDRAITVFSPDGHLFQVEYAQEAVKKGSTAVGVRGRDIVVLGVEKKSVAKLQDERTVRKICALDDNVCMAFAGSPPMQG

SEQ ID NO: 7493 - protein, 65 aa, Homo sapiens [sequence omitted]

SEQ ID NO: 7494 - protein, 51 aa, Homo sapiens
  UNSURE 30: Xaa = Ala,Ser
  UNSURE 31: Xaa = Arg,Ser,Thr
  UNSURE 28: Xaa = Asp,Tyr
  UNSURE 32: Xaa = Ile,Met,Arg,Ser
  UNSURE 34: Xaa = Lys,Arg
MAKKWKQAKYSSTDEWIKKMWYIYMMDXHXXXQXNKILNHAAVWMNLKTLC

SEQ ID NO: 7495 - protein, 57 aa, Homo sapiens [sequence omitted]

SEQ ID NO: 7496 - protein, 61 aa, Homo sapiens
MSFCSFFGGEVFQNHFEPGVYVCAKCGYELFSSRSKFTLVSMAGVHRDHSRRQRGQASGAQ

SEQ ID NO: 7497 - protein, 79 aa, Homo sapiens
MGTEVSEEDICNILHLCTQVIEISEYRTQLYEYLQNRMMAIAPNVTVMVGELVGARLIALRFSFKFGQACSFYRSDSWS

SEQ ID NO: 7498 - protein, 93 aa, Homo sapiens
MANILMRDRRQTPRRGPCEDTAEPGGVRPLAAERLEPPEAEKGLRIQKSAAHSTQRWGGRGHALDHEAHSEEQVTRGEKWDNEKSQAQSKDPG

SEQ ID NO: 7499 - protein, 71 aa, Homo sapiens
  UNSURE 56: Xaa =  * ,Glu
  UNSURE 69: Xaa = Ala,Thr
MVQSCSAYGCKNRYDKDKPVSFHKFPLTRPSLFKEWEAAVRRKNFKPTKYSSICSXHFTPDCFKRECTXSY

SEQ ID NO: 7500 - protein, 92 aa, Homo sapiens
  UNSURE 25: Xaa = His,Gln
MVEKKTSVRSQDPGQRRVLDRAARXVASTGSWRPWRMTTSRMTPTRDSLSSARDCLSLMTMRTLERKRRKPEVIILNFASEKTFRPCWRSRT

SEQ ID NO: 7501 - protein, 92 aa, Homo sapiens
  UNSURE 83: Xaa = Ala,Thr
  UNSURE 25: Xaa = His,Gln
MVEKKTSVRSQDPGQRRVLDRAARXVASTGSWRPWRMTTSRMTPTQDSLSSARDCLSLMTMRTLERKRRKPEVIILNFASEKXFRPCWRSRT

SEQ ID NO: 7502 - protein, 92 aa, Homo sapiens
  UNSURE 69: Xaa = Gly,Ser
MVEKKTSVRSQDPGQRRVLDRAARHVASTGSWRPWRMTTSRMTPTRDSLSSARDCLSLMTMRTLERKRXKPEVIILNFASEKTFRPCWRSRT

SEQ ID NO: 7503 - protein, 64 aa, Homo sapiens
  UNSURE 23: Xaa = Arg,Thr
MGRKCSPVPACGSCLEVTQWCAXPSHHSPRASPVNGAGIPCSSPLAAWKLPFFQLYYWPSKELF

SEQ ID NO: 7504 - protein, 60 aa, Homo sapiens
MKFDLFQNPQKSLKWKNFLRTKRHGIDDMKLTLHHVPEIDLRKRSCPPGTSLTWKRQAVS

SEQ ID NO: 7505 - protein, 57 aa, Homo sapiens
MADGKAGDEKPEKSQRAGAAGVMEGKVPVAALRSDQLKKKLPTSQQSLQRSPSLDLP

SEQ ID NO: 7506 - protein, 50 aa, Homo sapiens
  UNSURE 27: Xaa = Cys,Gly
  UNSURE 26: Xaa = Phe,Leu
MFHYIKTSLAPLPCYVYLIEHPSLKXXDHSFHSQVSCGVLLCHPGWSPMV

SEQ ID NO: 7507 - protein, 79 aa, Homo sapiens
MNGFGRLEHFSGAVYEGQFKDNMFHGLGTYTFPNGAKYTGNFNENRVEGEGEYTDIQGLEWSGNFHFTAAPDLKLKLHM

SEQ ID NO: 7508 - protein, 67 aa, Homo sapiens
  UNSURE 3: Xaa = Cys,Gly
MGXMDYQRRQAGLPNLLTGHVTLLPPDLYSPLHLSSTVIRVISCNDQGVTPCFVSDKTVTQRDEMTC

SEQ ID NO: 7509 - protein, 57 aa, Homo sapiens
  UNSURE 8: Xaa = Phe,Ile
MFLSCACXPYWHVKISFIIVNYIPARSEIFALVFIPICFICNCARFFAPEIFFWVQL

SEQ ID NO: 7510 - protein, 60 aa, Homo sapiens [sequence omitted]

SEQ ID NO: 7511 - protein, 74 aa, Homo sapiens
  UNSURE 58: Xaa =  * ,Gly
MNGFGRLEHFSGAVYEGQFKDNMFHGLGTYTFPNGAKYTGNFNENRVKGEGEYTDIQXLEWSGNFHFTAAPDLN

SEQ ID NO: 7512 - protein, 83 aa, Homo sapiens
  UNSURE 77: Xaa =  * ,Tyr
MGKVLECDIIKNYGFVHIEDKTAAEDAIRNLHHYKLHGVNINVEASKNKSKTSTKLHVGNISPTCTNKELRAKFEEXWSGHRM

SEQ ID NO: 7513 - protein, 70 aa, Homo sapiens
MMAAALGPPEVIAQLENAAKVLMAPPSMVNNEQRQHAEHIFLSFRKSKSPFAVCKHILVLHALEVTVEER

SEQ ID NO: 7514 - protein, 77 aa, Homo sapiens
MFPGENELIVNDQLAVAELKDCIEKKTMEGRSSKVYFTINMNLDVSDEKMAMFSLACILPFKYPAVLLKLLSDQYIE

SEQ ID NO: 7515 - protein, 79 aa, Homo sapiens
MVNNEQRQHAEHIFLSFRKSKSPFAVCKHILETSKVDYVLFQAATAIMEAVVREWILLEKGSIESLRTFLLTYVLQRPK

SEQ ID NO: 7516 - protein, 101 aa, Homo sapiens
MAKIKARDLRGKKKEELLKQLDDLKVELSQLRVAKVTGGAASKLSKIRVVRKSIARVLTVINQTQKENLRKFYKGISTSPWTCGLRRHVPCAAGSTSTRRT

SEQ ID NO: 7517 - protein, 101 aa, Homo sapiens
  UNSURE 78: Xaa =  * ,Ala,Glu,Ser
MAKIKARDLRGKKKEELLKQLDDLKVELSQLRVAKVTGGAASKLSKIRVVRKSIARVLTVINQTQKENLRKFYKGKKXSPWTCGLRRHVPCAAGSTSTRRT

SEQ ID NO: 7518 - protein, 99 aa, Homo sapiens
METSNDGDCTRTSSGIYERNGIGIHTTPNGIVYTGSWKDDKMNGFGRLEHFSGAVYEGQFKDNMFHGLGTYTFPNGAKYTGNFNENRVKGEGEYTDIQG

SEQ ID NO: 7519 - protein, 95 aa, Homo sapiens
MSDAAVDTSSEITTKDLKEKKEVVEEAENGRDAPANGNANEENGEQEADNEGRRRRGRKVGRKRRRKKKVMVRKRMEMKMRKLSQLRASGAAEDG

SEQ ID NO: 7520 - protein, 69 aa, Homo sapiens
  UNSURE 61: Xaa =  * ,Ala,Cys,Asp,Glu,Gly,His,Pro,Gln,Arg,Ser,Trp,Tyr
  UNSURE 60: Xaa = Glu,Gly,Ile,Lys,Arg,Val
  UNSURE 27: Xaa = Pro,Thr
MSDAAVDTSSEITTKDLKEKKEVVEDXENGRDAPANGNANEENGEQEADNEVDEEEEEGXXGRGGGRRR

SEQ ID NO: 7521 - protein, 77 aa, Homo sapiens
  UNSURE 18: Xaa = Lys,Asn
MSDAAVDTSSEITTKDLXEKKEVVEEAENGRDAPANGNANEENGEQEADNEVDEEEEEGGEEEEEEEEGDGEGRGWR

SEQ ID NO: 7522 - protein, 59 aa, Homo sapiens [sequence omitted]

SEQ ID NO: 7523 - protein, 72 aa, Homo sapiens [sequence omitted]

SEQ ID NO: 7524 - protein, 88 aa, Homo sapiens
MPPGSGHWLLVAIFHKYSGREGDKHTLSKKELKELIQKELTIGSKLQDAEIARLMEDLDRNKDQEVNFQEYVTFLGALALIYNEALKG

SEQ ID NO: 7525 - protein, 68 aa, Homo sapiens
MSDAAVDTSSEITTKDLKEKKEVVEEAENGRHAPANGNANEENGEQEADKGRRRRGRRWGGRGGGRRR

SEQ ID NO: 7526 - protein, 88 aa, Homo sapiens; identical to SEQ ID NO: 7524

SEQ ID NO: 7527 - protein, 69 aa, Homo sapiens
MSDAAVDTSSEITTKDLKEKKEVVEEAENGRDAPANGNANEENGEQEADNEVDERRGRRWGGRGGGRRR

SEQ ID NO: 7528 - protein, 88 aa, Homo sapiens
  UNSURE 64: Xaa = His,Gln
MPPGSGHWLLVAIFHKYSGREGDKHTLSKKELKELIQKELTIGSKLQDAEIARLMEDLDRNKDXEVNFQEYVTFLGALALIYNEALKG

SEQ ID NO: 7529 - protein, 68 aa, Homo sapiens; identical to SEQ ID NO: 7525

SEQ ID NO: 7530 - protein, 96 aa, Homo sapiens
MDRSSYHCCWDTAIGYLAYKRFYVKDHRNKAMINLHIQKDNPKIVHAFDMEDLGDKAVYCRCWRSKKFPFCDGAHTKHNEETGDNVGPLIIKKKET

SEQ ID NO: 7531 - protein, 50 aa, Homo sapiens
  UNSURE 15: Xaa = Leu,Arg
MLLTWRIWEIKLYCXCWRSKKFPFCDGAHTKHNEETGDNVGPLIIKKKET

SEQ ID NO: 7532 - protein, 96 aa, Homo sapiens; identical to SEQ ID NO: 7530

SEQ ID NO: 7533 - protein, 50 aa, Homo sapiens
MLLTWRIWEIKLYCRCWRSKKFPFCDGAHTKHNEETGDNVGPLIIKKKET

SEQ ID NO: 7534 - protein, 71 aa, Homo sapiens
  UNSURE 56: Xaa = Ile,Arg
  UNSURE 12: Xaa = Ser,Thr
MDRSSYHCCWDXAIGYLAYKRFYVKDHRNKAMINLHIQKDNPKIVHAFDMEDLGDXAVYCRCWRSKKVPIL

SEQ ID NO: 7535 - protein, 50 aa, Homo sapiens; identical to SEQ ID NO: 7533

SEQ ID NO: 7536 - protein, 68 aa, Homo sapiens
MWAFPWEEPLYVITFYIVAVEAKWTESPRQHEVVLQVILEKLTYHTTHQPMQKPVYVQSAECLGPPKK

SEQ ID NO: 7537 - protein, 92 aa, Homo sapiens
  UNSURE 90: Xaa = Ala,Gly
MACPLDQAIGSLVAIFHKYSGREGDKHTLSKKELKELIQKELTIGSKLQDAEIARLMEDLDRNKDQEVNFQEYVTFLGALALIYNEALKXDK

SEQ ID NO: 7538 - protein, 79 aa, Homo sapiens
MRKDGEGGNRALFLSKENCVTLKWPQAFITMRKTYLSYPFGPKEDEACCVTETTSRHLSQDSLLLKSNMPELASIDSSP

SEQ ID NO: 7539 - protein, 72 aa, Homo sapiens [sequence omitted]

SEQ ID NO: 7540 - protein, 86 aa, Homo sapiens [sequence omitted]

SEQ ID NO: 7541 - protein, 98 aa, Homo sapiens
MVHPRILYRDGQALGSWLRPLGQPCAKDLLTTDQPDHLPPSKSSKSSKLVTCPLMFPGNQERGPLHFIFPSRVAGSLPGKQASFSTAVVALTKQSGHM

SEQ ID NO: 7542 - protein, 60 aa, Homo sapiens
MIEACTKKARTGWKRRTWWEEQEGFYHMVGMVTIIMNDYPKFKYALLAVMGAYVLLKRES

SEQ ID NO: 7543 - protein, 78 aa, Homo sapiens
MLIKVKTLTGKEIEIDIEPTDKVERIKERVEEKEGIPPQQQRLIYSGKQMNDEKTAALQDFRWFSPSPGVGSERRRWS

SEQ ID NO: 7544 - protein, 73 aa, Homo sapiens
MSEKSGQSTKAKDGKKYATLSLFNTYKGKSLETQKTTARHGLQSLGKVGISRRMLHLLTSQVLKQKTKAMILM

SEQ ID NO: 7545 - protein, 50 aa, Homo sapiens [sequence omitted]

SEQ ID NO: 7546 - protein, 63 aa, Homo sapiens [sequence omitted]

SEQ ID NO: 7547 - protein, 52 aa, Homo sapiens
MDGSLFPSPLNIFIKKQTNGQAWWLTPVIPALWKAEAGESPEVRSLRPAWPM

SEQ ID NO: 7548 - protein, 63 aa, Homo sapiens
MLKSHFRQLHDFLQMSWPCLEVYLYSLKREGCRPGAVTHACNPSTVGGQGRWITRSGDRDHPG

SEQ ID NO: 7549 - protein, 51 aa, Homo sapiens
MKKRLYREIKKLAQGYTARKQKSWSLNFDSLTRGSFSVFNQSTTLPLQKHA

SEQ ID NO: 7550 - protein, 144 aa, Homo sapiens
MAVLLETTLGDVVIDLYTEERPRACLNFLKLCKIKYYNYCLIHNVQRDFIIQTGDPTGTGRGGESIFGQLYGDQASFFEAEKVPRIKHKKKGTVSMVNNGSDQHGSQFLITTGENLDYLDGVHTVFGEVTEGMDIIKKINETFC

SEQ ID NO: 7551 - protein, 61 aa, Homo sapiens [sequence omitted]

SEQ ID NO: 7552 - protein, 69 aa, Homo sapiens
  UNSURE 61: Xaa = Asp,Glu
MVASVPGNMGRGKLGGLKNEDRFHLGCMLNFRWQRGIQQATRTGTQKRDTESHWHNDIIFXALGADELT

SEQ ID NO: 7553 - protein, 114 aa, Homo sapiens
  UNSURE 102: Xaa = Phe,Val
MDQEPVGGVERGEAVAASGAAAAAAFGESAGQMSNERGFENVELGVIGKKKKVPRRVIHFVSGETMEEYSTDEDEVDGLEKKDVLPTVDPCVTSLERRLHLXWVSAPPKYQYAI

SEQ ID NO: 7554 - protein, 66 aa, Homo sapiens
MDQEPVGGVERGEAVAASGAAAAAAFGESAGQNLTLLPRLKFMARSRLAATSTSRVQAILLPQPPV

SEQ ID NO: 7555 - protein, 51 aa, Homo sapiens
MYSLPWGWCEALHEAPMIQSPPTRPHLQHWGLHFNMRFGQDKNPNYFKDSS

SEQ ID NO: 7556 - protein, 66 aa, Homo sapiens; identical to SEQ ID NO: 7554

SEQ ID NO: 7557 - protein, 73 aa, Homo sapiens
  UNSURE 13: Xaa = Ala,Pro
MFFLAETTHPWPXPYPTPGPDVATIFEKVLDVPVLWNTSLICNFLSMCVIICLFGSLIRPSFLDLPILIHFYF

SEQ ID NO: 7558 - protein, 87 aa, Homo sapiens
MSSAICLFSCNICPELTSEIIDRLHRSQLLKMTFLSFFTSILSSTHDLGSIVQDLGTHFECKQFLLALLEVKGCLILRNRVVSGGLA

SEQ ID NO: 7559 - protein, 133 aa, Homo sapiens
MGIRIRVSDKGVPVRQRSSEWPRGSHEQQRQQPGQPGEPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 7560 - protein, 51 aa, Homo sapiens
MFCHTKNLGCKDKAKAPIPFFSSPRMHPSGSLARVPRPVSVSVALFSIKAL

SEQ ID NO: 7561 - protein, 99 aa, Homo sapiens
MRPQEKQVTITETLWDQVLTVFKDIQKELQEDARIRGMSNCSMTPMTSAPRTGSIRPSDSLMTPKLRRLQFSSGEQPSGGRIHNLKTQLFSQSAYYPGP

SEQ ID NO: 7562 - protein, 59 aa, Homo sapiens
MAQHPCQDQEQKVEMTSKQQRSTSIEETMRPQEKQVTITETLWDQVLTVFKDIQKEARV

SEQ ID NO: 7563 - protein, 80 aa, Homo sapiens
MELNEKRRGLKYELISETGRGHDKRFVMEVEVDGQKFRGAGPNKKVAKASAALAAWRNCFLDPMRQIIRKRRLSLRQRAL

SEQ ID NO: 7564 - protein, 114 aa, Homo sapiens
  UNSURE 54: Xaa = Ala,Pro
  UNSURE 55,110: Xaa = Leu,Val
MELNEKRRGLKYELISETGRGHDKRFVMEVEVDGQKFRGAGPNKKVAKASAALXXLEKLFSGPNAANNKKKKIIPQAKGVVNTAVSAAVQAVRGRGRGTLTRGAFVGATXLLAT

SEQ ID NO: 7565 - protein, 58 aa, Homo sapiens [sequence omitted]

SEQ ID NO: 7566 - protein, 117 aa, Homo sapiens
METKKLIGKPLQPARPVRHLTSPPGAVFPFNFQNEYPCNTQCIQSGVSRCKTNGMQAFSQGLNEQQQQQSPVKKERIKYSRDFLLKLSSVSICRKKPDFLPDHPIVLQKPENNQSFK

SEQ ID NO: 7567 - protein, 58 aa, Homo sapiens
  UNSURE 14: Xaa = Gly,Arg
MISAHCSVCLPGSXDSPASASRVAGSTGVCHHAWLIVCIFSRDRVSPCWQDGLDLLTS

SEQ ID NO: 7568 - protein, 107 aa, Homo sapiens
MCGDCVEKEYPNRGNTCLENGSFLLNFTGCAVCSKRDFMLITNKSLKEEDGEEIVTYDHLCKNCHHVIARHEYTFSIMDEFQEYTMLCLLCGKAKILSVFSLMTPDK

SEQ ID NO: 7569 - protein, 107 aa, Homo sapiens; identical to SEQ ID NO: 7568

SEQ ID NO: 7570 - protein, 76 aa, Homo sapiens [sequence omitted]

SEQ ID NO: 7571 - protein, 51 aa, Homo sapiens
MGKNTTKSSGRLQAILRTRMLPVPPELDEKRRTEPHPVPCREFPSALLQPK

SEQ ID NO: 7572 - protein, 59 aa, Homo sapiens
MIVLGWMFFVGLVCYMGTFPELMPPTLKWQERWPVQESKTQLRRRALGEDLLQNHVEGI

SEQ ID NO: 7573 - protein, 59 aa, Homo sapiens; identical to SEQ ID NO: 7572

SEQ ID NO: 7574 - protein, 76 aa, Homo sapiens
MIVLGWMFFVGLVCYMGTFPELMPPTLKWQERWPVQESKTQLRRRALGTMWKGYKYPPGGTPVEVSKDDPGEVMQL

SEQ ID NO: 7575 - protein, 96 aa, Homo sapiens
MSRLSARLFGEVTRPTNSKSMKVVKLFSELPLAKKKETYDWYPNHHTYAELMQTLRFLGLYRDEHQDFMDEQKRLKKLRGKEKPKKGEGKRAAKRK

SEQ ID NO: 7576 - protein, 106 aa, Homo sapiens
  UNSURE 91: Xaa = Lys,Arg
MSSLSEYAFRMSRLSARLFGEVTRPTNSKSMKVVKLFSELPLAKKKETYDWYPNHHTYAELMQTLRFLGLYRDEHQDFMDEQKRLKKLRGXEKPKKGEGKRAAKRK

SEQ ID NO: 7577 - protein, 106 aa, Homo sapiens
  UNSURE 23: Xaa = Asn,Thr
MSSLSEYAFRMSRLSARLFGEVXRPTNSKSMKVVKLFSELPLAKKKETYDWYPNHHTYAELMQTLRFLGLYRDEHQDFMDEQKRLKKLRGKEKPKKGEGKRAAKRK

SEQ ID NO: 7578 - protein, 106 aa, Homo sapiens
MSSLSEYAFRMSRLSARLFGEVTRPTNSKSMKVVKLFSELPLAKKKETYDWYPNHHTYAELMQTLRFLGLYRDEHQDFMDEQKRLKKLRGKEKPKKGEGKRAAKRK

SEQ ID NO: 7579 - protein, 152 aa, Homo sapiens
  UNSURE 29: Xaa = Ala,Gly
MQDAPLSCLSPTKWSSVSSADSTEKSASXAGTRNLPFQFCLRQALRMKAAGILTLIGCLVTGRVQNLHSLQTGKNILEGWPGQLLGLQLGNWICMAYYESGYNTTAQTVLDDGSIDYGIFQINSFAWCRRGKLKENNHCHVACSGPADTSTR

SEQ ID NO: 7580 - protein, 99 aa, Homo sapiens
  UNSURE 53: Xaa = Ile,Val
  UNSURE 65: Xaa = Lys,Arg
MAYYESGYNTTAQTVLDDGSIDYGIFQINSFAWCRRGKLKENNHCHVACSALXTDDLTDAIICAXKIVKETQGMNYWQGWKKHCEGRDLSDWKKDCEVS

SEQ ID NO: 7581 - protein, 69 aa, Homo sapiens
MPNRPPAVSKPRGFTHSPALLILNLETTFFYPGWHSFPWPWLNLMPFKYPAKLAALRKPWTLIYLLSND

SEQ ID NO: 7582 - protein, 110 aa, Homo sapiens
MEKPERQESAKHTKDWAVTGENTQPACTQVKYTALLLTQSLFGGFFTRMHVTFGAEDPGQEDSFGRPVPCCRPHSVRDPPMISGPQTNQPKEHLANFKSEDRSVRPLSPS

SEQ ID NO: 7583 - protein, 72 aa, Homo sapiens [sequence omitted]

SEQ ID NO: 7584 - protein, 81 aa, Homo sapiens [sequence omitted]

SEQ ID NO: 7585 - protein, 72 aa, Homo sapiens
  UNSURE 62: Xaa = Ala,Ser
MIQWLAGSPPCPPASVSGVGISLGRCAGSGWGGRGEEPWTLRDGISPCCLGWSGALDLKRSXLPRPPNVLGL

SEQ ID NO: 7586 - protein, 151 aa, Homo sapiens
  UNSURE 108: Xaa = Leu,Val
MQPCYSKNGFLPNASPRRLLAGLTLGRGEGLRSEGQANHSRGFLPGGSCAHGMEKGIGFFFPIFNFQNHPLYPVECTHLHSDVSRSRAYRDCHNFDYPTVSTQPAASXCYSHSWPSHSLSSVPLGPGGCSESKPQGKREAGTTEAPRQPPF

SEQ ID NO: 7587 - protein, 66 aa, Homo sapiens
MLEKLNELVYKVLPHLPYSPDFSPTTTSSSISTTFCRENASTTSRMQKMLSKSLSNPEARIFVLQE

SEQ ID NO: 7588 - protein, 71 aa, Homo sapiens
  UNSURE 34: Xaa = Leu,Trp
MISSHCNLHLPDSSDSPLSASQVAGITGIHYHAXLIFVFLVETGFHHVGQAGLQLLTSGDTPPRPPKVLGL

SEQ ID NO: 7589 - protein, 77 aa, Homo sapiens [sequence omitted]

SEQ ID NO: 7590 - protein, 60 aa, Homo sapiens
  UNSURE 25: Xaa = Ala,Asp,Gly,Val
MTGFSREGEARFFPWRGIWLEGWAXSGCEELARGIAGSERRGPRSRARRLQQWLNNWTLL

SEQ ID NO: 7591 - protein, 111 aa, Homo sapiens
MSEHVRTRSQSSERGNDQESSQPVGSVIVQEPTEEKRQEEEPPTDNQGIAPSGEIENEGAPAVQGPDMEAFQQELALLKIEDEPGDGPDVREGIMPTFDLTKVLEAGDAQP

SEQ ID NO: 7592 - protein, 110 aa, Homo sapiens
  UNSURE 82: Xaa = Ala,Glu
  UNSURE 30: Xaa = Glu,Gln
  UNSURE 55: Xaa = Glu,Lys
  UNSURE 93: Xaa = Ile,Thr
  UNSURE 94: Xaa = Leu,Met
  UNSURE 99: Xaa = Leu,Pro
  UNSURE 67: Xaa = Met,Val
  UNSURE 25: Xaa = Pro,Ser
  UNSURE 65: Xaa = Pro,Thr
MSEHVTRSQSSERGNDQESSQPVGXVIVQXPTEEKRQEEEPPTDNQGIAPSGEIXNEGAPAVQGXDXEAFQQELALLKIEDXPGDGPDVREGXXPTFDXTKVLEAGEGQL

SEQ ID NO: 7593 - protein, 89 aa, Homo sapiens [sequence omitted]

SEQ ID NO: 7594 - protein, 76 aa, Homo sapiens
MTTSRCVRLMLISMANDLKEVWISEQPFLLVTYLWQYMPTWAWWITNKMGKKRIENFKSGVDADSSYFKIFKTKHD

SEQ ID NO: 7595 - protein, 91 aa, Homo sapiens [sequence omitted]

SEQ ID NO: 7596 - protein, 71 aa, Homo sapiens
MISSHCNLHLPDSSDSPLSASQVAGITGIHYHAWLIFVFLVETGFHHVGQAGLQLLTSGDTPPRPPKVLGL

SEQ ID NO: 7597 - protein, 55 aa, Homo sapiens
MVCDPNNQFLNITTSRNRVHLQFLLTFSFPFGFPFSGLRLPVSLGTIKILPSWVH

SEQ ID NO: 7598 - protein, 55 aa, Homo sapiens [sequence omitted]

SEQ ID NO: 7599 - protein, 96 aa, Homo sapiens
  UNSURE 86: Xaa = Pro,Arg
  UNSURE 11: Xaa = Ser,Thr
MTGLSMDGGGXPRGTWTRSTMVSLGPCAPFLSPQDPFHQAAASPSPRSMLCAPYLPWLPRAAAGRLRRETAAGRDHPSRSSCPLFXETMRPFAMGA

SEQ ID NO: 7600 - protein, 55 aa, Homo sapiens
MLHIKPIEYLFSHSKRQGMHAVLMYRKLLTPLSPLNFSHICPKTFIRHTQPSLLR

SEQ ID NO: 7601 - protein, 62 aa, Homo sapiens
MMMPSSSTDPACSSCCSCWPWKKLDLHLMQNFIQKNPLLLESQPHLQQGTCVSSQRNAGGKH

SEQ ID NO: 7602 - protein, 62 aa, Homo sapiens [sequence omitted]

SEQ ID NO: 7603 - protein, 189 aa, Homo sapiens
MSRCMRCWPLPSRCTPCVLMRAFTSSCGRNMGTRCCACRKVTHKSMKNFSVTPAPSSSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEEA

SEQ ID NO: 7604 - protein, 74 aa, Homo sapiens
MLGGKVHGSLARAGKVRGQTPKVSESISGHGVSTFFPFTAKPSPWALTRFAFSLPGDEPEGRDARCGRQEPGPD

SEQ ID NO: 7605 - protein, 61 aa, Homo sapiens
MQLFVRAQELHTFEVTGQETVAQIKAHVASLEGIARKIKSCSWQARPWRMRPLWASAGWRP

SEQ ID NO: 7606 - protein, 96 aa, Homo sapiens
MADNDTDRNQTEKLLKRVRELEQEVQRLKKEQAKNKEDSNIRENSSGAGKTKRAFDFSAHGRRHVALRIAYMGWGYQGFASQENTNNTIEENCLKL

SEQ ID NO: 7607 - protein, 99 aa, Homo sapiens
MMEVDRRVESEESGDEEGKKHSSGIVADLSEQSLKDGEERGEEDPEGTRPSSLGDICWLGDVGCAARGLALGVGAVSVWRRTAVLLRGPQWPRAGGYAL

SEQ ID NO: 7608 - protein, 96 aa, Homo sapiens
MTSALENYINRTVAVITSDGRMIVGTLKGFDQTINLILDESHERVFSSSQGVEQVVLGLYIVRGDNVAVIGEIDEETDSALDLGNIRAEPLNSVAH

SEQ ID NO: 7609 - protein, 82 aa, Homo sapiens
MFAPAVMRAFRKNKTLGYGVPMLMDPELEKKLKENKISLESEYEKIKDSKFDDWKNIRGPRPWEDPDLLQGRNPESLKTKTT

SEQ ID NO: 7610 - protein, 108 aa, Homo sapiens
MAAPCLLRQGRAGALKTMLQEAQVFRGLASTVSLSAESGKSEKGQPQNSKKQSPPKKPAPVPAEPFDNTTYKNLQHHDYSTYTFLDLNLELSKFRMPQPSSGRESPRH

SEQ ID NO: 7611 - protein, 108 aa, Homo sapiens; identical to SEQ ID NO: 7610

SEQ ID NO: 7612 - protein, 71 aa, Homo sapiens
  UNSURE 14: Xaa = Cys,Gly,Arg,Ser
MISSHCNLHLPDSXDSPLSASQVAGITGIHYHAWLIFVFLVETGFHHVGQAGLQLLTSGDTPPRPPKVLGL

SEQ ID NO: 7613 - protein, 70 aa, Homo sapiens
MSVMMACWKQNEFRDDACRKEIQGFLDCAARAQEARKMRSIQETLGESGSLLPNKLNKLLQRFPNKPYLS

SEQ ID NO: 7614 - protein, 68 aa, Homo sapiens
MAEDADMRNELEEMQRRADQLADESLESTRRMLQLVEESKDAGIRTLVMLDEQGEQLQNTVVRIMGIY

SEQ ID NO: 7615 - protein, 89 aa, Homo sapiens [sequence omitted]

SEQ ID NO: 7616 - protein, 77 aa, Homo sapiens
  UNSURE 56: Xaa = Gly,Arg
MGSQRPSISEKRRKKARSTGNLELRNYVPEDEDLKKRRVPQAKPVALEEKVKEQLXGRQARARHRGGGPGQPRSSEA

SEQ ID NO: 7617 - protein, 83 aa, Homo sapiens
MEAEESEKAATEQEPLEGTEQTLDAEEEQEESEEAACGSKKRVVPGIVYLGHIPPRFRPLHVRNLLSAYGRSDASSFRLRTGS

SEQ ID NO: 7618 - protein, 102 aa, Homo sapiens
  UNSURE 83: Xaa = Glu,Gln
MGFTGFGKKARTFDLEAMFEQTRRTAVERSRKTLEAREKEEEMNREKELRRQNEDIEPTSSRSNVVRDCSKSSSRDTSSSESXQSSDSSDDELIGLLYPLKW

SEQ ID NO: 7619 - protein, 107 aa, Homo sapiens
MRNEARKLNHQEVVEEDKRLKLPANWEAKKARLEWELKEEEKKKECAARGEDYEKVKLLEISAEDAERWERKKKRKNPDLGFSDYAAAQLRQYHRLTKQIKPDMENI

SEQ ID NO: 7620 - protein, 59 aa, Homo sapiens
MIVSLVEDYPNYMIINLDKLDYCASLKNLETISNKQNYKFIQGDICDSHFVNCFLKQRK

SEQ ID NO: 7621 - protein, 59 aa, Homo sapiens
MSPSSDPGTRLLGVWGSSTPQRHKADFNHFFSFKLDSAAVEPAQRMFSHPARQRPSSPP

SEQ ID NO: 7622 - protein, 62 aa, Homo sapiens
MASSTPPSTKNLLPHTPSRNCSIQVLSLPQRSASHSPFGPSFELPDLRLDCLFVLEFSKFLY

SEQ ID NO: 7623 - protein, 110 aa, Homo sapiens
MAASSSSSSAGGVSGSSVTGSGFSVSDLAPPRKALFTYPKGAGEMLEDGSERFLCESVFSYQVASTLKQVKHDQQVARMEKLAGLVEELEADEWRFKPIEQLLGFTPSSG

SEQ ID NO: 7624 - protein, 110 aa, Homo sapiens
MAASSSSSSAGGVSGSSVTGSGFSVSDLAPPRKALFTYPKGAGEMLEDGSERFLCESVFSYQVASTFKQVKHDQQVARMEKLAGLVEELEADEWRFKPIEQLLGFTPSSG

SEQ ID NO: 7625 - protein, 135 aa, Homo sapiens
  UNSURE 82: Xaa =  * ,Glu
  UNSURE 113: Xaa = Ala,Val
  UNSURE 57: Xaa = Arg,Ser
  UNSURE 86: Xaa = Asp,His
  UNSURE 125: Xaa = Leu,Arg
  UNSURE 110: Xaa = Lys,Asn
  UNSURE 118: Xaa = Phe,Leu
  UNSURE 58: Xaa = Pro,Ser
  UNSURE 95: Xaa = Ser,Trp
  UNSURE 120: Xaa = Ser,Tyr
MFEAIFPSTPQARLKRDPREKPGLSSFRSTFRQQSSLGLCIPRLMLPKEASPSQRHXXMSSSMARALVLLQSMASRDARCPXWKPXQKPRTLSKXVQTISRYYRKTSEPXDAXSLTGXMXKMELXRVFPTHPDCP

SEQ ID NO: 7626 - protein, 62 aa, Homo sapiens [sequence omitted]

SEQ ID NO: 7627 - protein, 77 aa, Homo sapiens
MTSLFAQEIRLSKRHEEIVSQRLMLLQQMENKLGDQHTEKASQLQTVETAFKRNLSLLKDIGSRKVTTDQDSPTSTA

SEQ ID NO: 7628 - protein, 71 aa, Homo sapiens
  UNSURE 38: Xaa = Ala,Glu,Gly,Val
  UNSURE 37: Xaa = Phe,Leu
MISSHCNLHLPDSSDSPLSASQVAGITGIHYHAWLIXXFLVETGFHHVGQAGLQLLTSGDTPPRPHKVLGL

SEQ ID NO: 7629 - protein, 60 aa, Homo sapiens
MSSSGIYQAFKQDCNNYSKMVEKFLRQKAISTNCAGSILYYDDESLQCNGCQDSETMARL

SEQ ID NO: 7630 - protein, 61 aa, Homo sapiens
  UNSURE 45: Xaa = Ala,Glu,Gly,Val
MSTLFPSLFPRVTETLWFNLDRPCVEETELQQQTAASGLAPKHRXERQQPGSYWQASLRAL

SEQ ID NO: 7631 - protein, 52 aa, Homo sapiens [sequence omitted]

SEQ ID NO: 7632 - protein, 50 aa, Homo sapiens
MILPCSISPWQKKSKISASRKLQLKTLLLQIAKQELEREAEERRERRGAL

SEQ ID NO: 7633 - protein, 55 aa, Homo sapiens [sequence omitted]

SEQ ID NO: 7634 - protein, 65 aa, Homo sapiens
MIPLTTCFQHSQVGQGVLQKNLGLDLQGVWLVLTEGRAELVRLAMEKADLAGVVQRSQLVYMLIP

SEQ ID NO: 7635 - protein, 60 aa, Homo sapiens
MKRNCERRRFPQAGTNELLGHVVRTRQRHTIKENAGLSWPLKSGLPRLPPSIKMVVGRPS

SEQ ID NO: 7636 - protein, 205 aa, Homo sapiens
  UNSURE 75: Xaa = Gln,Arg
MAEASSANLGSGCEEKRHEGSSSESVPPGTTISRVKLLDTMVDTFLQKLVAAGSYQRFTDCYKCFYQLQPAMTQXIYDKFIAQLQTSIREEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQRELVAVLREPE

SEQ ID NO: 7637 - protein, 68 aa, Homo sapiens [sequence omitted]

SEQ ID NO: 7638 - protein, 60 aa, Homo sapiens
MAVDQDWPSVYPVAAPFKPSAVPLPVRMGYPVKKGVPMAKEGNLELFKDSQFSAFDSCSN

SEQ ID NO: 7639 - protein, 75 aa, Homo sapiens
MGEKPVGSLAGIGEVLGKKLEERGFDKAYVVLGQFLVLKKDEDLFREWLKDTCGANAKQSRDCFGCLREWCDAFL

SEQ ID NO: 7640 - protein, 75 aa, Homo sapiens; identical to SEQ ID NO: 7639

SEQ ID NO: 7641 - protein, 119 aa, Homo sapiens
MFFRELPEPLFPYSFFEQFVEAIKKQDNNTRIEAVKSLVQKLPPPNRDTMKVLFGHLTKIVAKASKNLMSTQSLGIVFGPTLLRAENETGNMAIHMVYQNQIAELMLSEYSKIFGSEED

SEQ ID NO: 7642 - protein, 106 aa, Homo sapiens
  UNSURE 24,104: Xaa = Ala,Pro
  UNSURE 55: Xaa = Cys,Arg
MQVAHPALSREAPQPGWPSGGLAXFTVAGKAKLVAGGAHHQGDLTAEKLDPPPSXLGRQVVELGLSGIARGQARQGAPPSGHAVSSRKAGRASRALGTLTQPGXRG

SEQ ID NO: 7643 - protein, 56 aa, Homo sapiens
  UNSURE 54: Xaa = Arg,Thr
MSLRSRASLGGESSDTQDPKASPAHPSPWTCLPGCAPAPGGGGAPHSPGQDSLXGE

SEQ ID NO: 7644 - protein, 67 aa, Homo sapiens
MGKGSSMDRRWDGRDRNCRVRRRNCSPKANKLALWNPRKAQELRDITEGRVKRGREDREMEGRKLLK

SEQ ID NO: 7645 - protein, 61 aa, Homo sapiens [sequence omitted]

SEQ ID NO: 7646 - protein, 74 aa, Homo sapiens
MPHAKQMCPNSCRTRHILNLSVQQLFKTFFKIIQAQGLIKYTQNGYVTPWIPCRFGSNQGELEPEARFRNRALD

SEQ ID NO: 7647 - protein, 144 aa, Homo sapiens
MDQSSEGCMKKISSVNLDKLINDFSQIEKKMVETNGKNNILDIQLEKSNCLLKVMQAKEVSIKEECATLHNIIKGLQQTIEYQQNLKGENEQLKISADLIKEKLKSHEQEYKNNIAKLVSEMKIKEEGYKKGISKLYQDMQRKG

SEQ ID NO: 7648 - protein, 56 aa, Homo sapiens
MLHQLGVGIAETTAVGAPISSLWQGHILPEDHPVVLGQPSMSTCTPVTLIAQSQGI

SEQ ID NO: 7649 - protein, 83 aa, Homo sapiens [sequence omitted]

SEQ ID NO: 7650 - protein, 61 aa, Homo sapiens
  UNSURE 53: Xaa = Asp,Glu
  UNSURE 54: Xaa = Asp,His
MKKKEPVGDDESVPENVLSFDDLTADALANLKVSQIKKVRLLIDEAILKCDAXXKVGSRAV

SEQ ID NO: 7651 - protein, 54 aa, Homo sapiens
MPRVHNIKKSLTPHISCVTNESDNLLDFLPDRLRAKLLPFQKDGIIFALKRNGR

SEQ ID NO: 7652 - protein, 69 aa, Homo sapiens
MPHSYPALSAEQKKELSDIALRIVAPGKGILAADESVGSMAKRLSQIGVENTEENRRLYRQSCSVLMTV

SEQ ID NO: 7653 - protein, 69 aa, Homo sapiens; identical to SEQ ID NO: 7652

SEQ ID NO: 7654 - protein, 65 aa, Homo sapiens
MAKRLSQIGVEKHRGEPAGCTRQVLFSADDRVKKVHWRASFFFHETLLTRKDDNGCSPSSETIQG

SEQ ID NO: 7655 - protein, 69 aa, Homo sapiens
  UNSURE 12: Xaa = Ala,Cys,Asp,Phe,Gly,His,Ile,Leu,Asn,Pro,Arg,Ser,Thr,Val,Tyr
  UNSURE 9: Xaa = Cys,Ser
MPHSYPALXAEXKKELSDIALRIVAPGKGILAADESVGSMAKRLSQIGVENTEENRRLYRQSCSVLMTV

SEQ ID NO: 7656 - protein, 51 aa, Homo sapiens
MTTSQKHRDFVAEPWGRSQWGAWLGLVKSWARSWRKGVLTRPMLSLASFWC

SEQ ID NO: 7657 - protein, 69 aa, Homo sapiens
  UNSURE 12: Xaa =  * ,Cys,Phe,His,Leu,Pro,Gln,Arg,Ser,Trp,Tyr
  UNSURE 3: Xaa = Asp,His
  UNSURE 6: Xaa = Pro,Arg
MPXSYXALSAEXKKELSDIALRIVAPGKGILAADESVGSMAKRLSQIGVENTEENRRLYRQSCSVLMTV

SEQ ID NO: 7658 - protein, 69 aa, Homo sapiens; identical to SEQ ID NO: 7652

SEQ ID NO: 7659 - protein, 69 aa, Homo sapiens; identical to SEQ ID NO: 7652

SEQ ID NO: 7660 - protein, 51 aa, Homo sapiens; identical to SEQ ID NO: 7656

SEQ ID NO: 7661 - protein, 119 aa, Homo sapiens [sequence omitted]

SEQ ID NO: 7662 - protein, 119 aa, Homo sapiens [sequence omitted]

SEQ ID NO: 7663 - protein, 118 aa, Homo sapiens
MQKSVQNKIKSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 7664 - protein, 71 aa, Homo sapiens; identical to SEQ ID NO: 7612
  UNSURE 14: Xaa = Cys,Gly,Arg,Ser

SEQ ID NO: 7665 - protein, 58 aa, Homo sapiens; identical to SEQ ID NO: 7301

SEQ ID NO: 7666 - protein, 54 aa, Homo sapiens
  UNSURE 2,15,48: Xaa =  * ,Lys
  UNSURE 18: Xaa = Cys,Gly
  UNSURE 17,31: Xaa = Pro,Ser
MXFTVKMILCCTIFXYXXFERIVERKWVACXVIAFRSLGECYRRLNLXIKAQSS

SEQ ID NO: 7667 - protein, 73 aa, Homo sapiens
  UNSURE 21: Xaa = Leu,Ser
MCFSRLIQLQRWQLSHCLSPXGHCPAGSWKAWYEDLQEVLSSDENGGTMFHLLEMKRKNQKSSPLLTLLLWLG

SEQ ID NO: 7668 - protein, 53 aa, Homo sapiens
MFELCIFDIVPGRNSTAQTLVFLLTSSNTWFVWRVSKNSAITPVHVFTGDCSC

SEQ ID NO: 7669 - protein, 140 aa, Homo sapiens
  UNSURE 38: Xaa = Asp,Glu
MPLESSSSMPLSFPSLLPSVPHNTNPSPPLMSYITSQXMKCILHWFANWSGPQRERFLEDLVAKAVPEKLQPLLDSLEQLSVSGADRPPSIFECQLHLWDQWFRGWAEQERNEFVRQLEFSEPDFVAKFYQAVAATAGKD

SEQ ID NO: 7670 - protein, 152 aa, Homo sapiens
MTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTRMYQISLPL

SEQ ID NO: 7671 - protein, 117 aa, Homo sapiens
MFRLLSSCCSCLRTTEETRRNVTIPIIGLNNSGKTVLVEAFQKLLPSKTDHCMKSELTTLLLDEYELSIYDLNGDLKGREAWPNYYAQAHGLVFVLDSSDIRRMQGSEDHLNTSAVR

SEQ ID NO: 7672 - protein, 52 aa, Homo sapiens
MMMAMNYALFSKVWYHGLKSHTKNILKINISWACRTHLLICFQLKFSHHHDG

SEQ ID NO: 7673 - protein, 117 aa, Homo sapiens
MQAVRNAGSRFLRSWTWPQTAGVVARTPAGTICTGARQLQDAAAKQKVEQNAAPSHTKFSIYPPIPGEESSLRWAGKKFEEIPIAHIKASHNKGISECQEGHRHRSTDSRHSRSGES

SEQ ID NO: 7674 - protein, 143 aa, Homo sapiens
  UNSURE 54: Xaa = Ala,Asp,Ser,Tyr
MQAVRNAGSRFLRSWTWPQTAGRVVARTPAGTICTGARQLQDAAAKQKVEQNAXPSHTKFSIYPPIPGEESSLRWAGKKFEEIPIAHIKASHNNTQIQVVSASNEPLAFASCGTEGFRNAKKGTGIAAQTAGIAQRRELNKRA

SEQ ID NO: 7675 - protein, 60 aa, Homo sapiens
  UNSURE 31: Xaa = Ile,Thr
MQAVRNAGSRFLRSWTWPQTAGVVARTPAGXICTGARQLQDAAAKQKVEQNAAPSHTKFR

SEQ ID NO: 7676 - protein, 69 aa, Homo sapiens
MCIGPEGDMHDITPGECAVRLVKAGASIVGVNCRFGPDTSLKTMELMKEGLEWAGLKRTSWSASGVPRA

SEQ ID NO: 7677 - protein, 86 aa, Homo sapiens
  UNSURE 32: Xaa = His,Gln,Arg
MQTRGAVIPSPAWGAIWNLDSLETLETPRRIXRQVSREMSLSPSHGPPKDSRIRKLFLLLRHPRKAAPPLGRSDGNWLRAQRKTHN

SEQ ID NO: 7678 - protein, 77 aa, Homo sapiens; identical to SEQ ID NO: 7627

SEQ ID NO: 7679 - protein, 86 aa, Homo sapiens
  UNSURE 68: Xaa = Ala,Pro,Ser
MPAYQELVEEAIAYGRKLGGSQEDQIKNAIDKLFVLFGAEILKKIPGRVSTEVDARLSFDKDAMVARXGGSSSSTRKLGSARTEFL

SEQ ID NO: 7680 - protein, 86 aa, Homo sapiens
MPAYQELVEEAIAYGRKLGGSQEDQIKNAIDKLFVLFGAEILKKIPGRVSTEVDARLSFDKDAMVARAGGSSSSTRKLGSARTEFL

SEQ ID NO: 7681 - protein, 55 aa, Homo sapiens
MGERLHSTLPRPVELQMLAHIREGVKPLRSSAGLSSDHGSTQMHGHVSHRLFACK

SEQ ID NO: 7682 - protein, 53 aa, Homo sapiens
MLLKAPFPQRITAIEGKMLHVPSASWCLSKDNGGRETKCLDVCVNQELSGPCL

SEQ ID NO: 7683 - protein, 71 aa, Homo sapiens; identical to SEQ ID NO: 7596

SEQ ID NO: 7684 - protein, 50 aa, Homo sapiens
MFLTGDTSPAEDNREATLPQCSLPELYACIENFNKESKKSNLLKNAWYFT

SEQ ID NO: 7685 - protein, 102 aa, Homo sapiens
MSPPLLKLGAVLSTMAMISNWMSQTLPSLVGLNTTRLSTPDTLTQISPKEGWQVYSSAQDPDGRCICTVVAPEQNLCSRDAKSRQLRQLLEKVQTCPSLLKS

SEQ ID NO: 7686 - protein, 96 aa, Homo sapiens
MAEVEETLKRLQSQKGVQGIIVVNTEGIPIKSTMDNPTTTQYASLMHSFILKARSTVRDIDPQNDLTFLRIRSKKNEIMVAPDKDYFLIVIQNPTE

SEQ ID NO: 7687 - protein, 71 aa, Homo sapiens; identical to SEQ ID NO: 7596

SEQ ID NO: 7688 - protein, 55 aa, Homo sapiens
MVQLHQDTDPQIPKVVPSSCTCIRPKNLISPLTVINILMKTGYVDAGRWGKLVSS

SEQ ID NO: 7689 - protein, 55 aa, Homo sapiens
  UNSURE 50: Xaa =  * ,Leu
  UNSURE 3: Xaa = Asn,Thr
  UNSURE 6: Xaa = Asp,Glu
  UNSURE 49: Xaa = Asp,Gly
MDXPEXVQPPKQQPMIYICGECHTENEIKSRDTNQMQRMWIQNNVQEKXXKDWSF

SEQ ID NO: 7690 - protein, 53 aa, Homo sapiens
MKTFGSAKHQKQIQKIKYTPEKPILSTHLTVHKEQLQSNLKNKENGRKMGNMH

SEQ ID NO: 7691 - protein, 87 aa, Homo sapiens [sequence omitted]

SEQ ID NO: 7692 - protein, 64 aa, Homo sapiens
  UNSURE 14: Xaa = Cys,Trp
MLENYSNMVSLGFXIYQPEAFSLLEKGKEPWKILRDETRGPCPDMQSRCQTKKLLPKNGIFERE

SEQ ID NO: 7693 - protein, 73 aa, Homo sapiens
  UNSURE 66: Xaa = Phe,Ser
MCSCPISSPGHIKGLGQEETPVRSADLVFKERMPACNTHGEGHFLAPPAKYLQTLGRRLHSQHRTXLNSFRIR

SEQ ID NO: 7694 - protein, 61 aa, Homo sapiens
MMLFNPYCLGHLLKMSFRRYQHFLSHGLIEFIELCDRNHILHKSHKAIMTTRVEDERCQIF

SEQ ID NO: 7695 - protein, 98 aa, Homo sapiens
MSALDSVTSLIQAAKNLMNAVVQTVKMSYIASTKIIRIQSPAGPRHPVVMWRMKAPAKKPLIKREKPEETCAAVRRGSAKKKIHPLQVMSEFRGRQIY

SEQ ID NO: 7696 - protein, 96 aa, Homo sapiens
  UNSURE 3: Xaa =  * ,Lys,Leu,Met,Arg,Trp
  UNSURE 76: Xaa = His,Tyr
  UNSURE 92: Xaa = Met,Arg
  UNSURE 68: Xaa = Phe,Ser
  UNSURE 90: Xaa = Pro,Ser
MAXRDDLSFCREMKFRNKMVEYLTDWVMGTSNQAADDDVKCLTRHQVPEKEEIKALKTLSIFYQAGAXKAGNPIFXYAARATSPSWWNPXVXTAKA

SEQ ID NO: 7697 - protein, 131 aa, Homo sapiens
  UNSURE 101: Xaa = Ile,Ser
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRXIISHVDFRENVFSSLLAILRSSNKCGSVFL

SEQ ID NO: 7698 - protein, 87 aa, Homo sapiens
  UNSURE 61: Xaa = Ala,Pro
  UNSURE 66: Xaa = Pro,Ser
MSRKGRRRHGHTQRESAVWRQRLRPTCRGRSQGSPQMGSRAEAGTEAPSGGTFSVLGRSPXCLRLXLGLLFPEPGERPSLLESHSSL

SEQ ID NO: 7699 - protein, 74 aa, Homo sapiens [sequence omitted]

SEQ ID NO: 7700 - protein, 74 aa, Homo sapiens [sequence omitted]

SEQ ID NO: 7701 - protein, 75 aa, Homo sapiens
MASDTVLWAPSLDSWPAFSSGKGLLQVFIGPRASWIPSAEAGQRGRAPEASGVGEHRCFQLAWLPALGPEGVNEA

SEQ ID NO: 7702 - protein, 76 aa, Homo sapiens
  UNSURE 76: Xaa =  * ,Trp
MAALSCLLDSVRRDIKKVDRELRQLRCIDEFSTRCLCDLYMHPYCCCDLHPYPYCLCYSKRSRSCGLCDLYPCCLX

SEQ ID NO: 7703 - protein, 68 aa, Homo sapiens
MAALSCLLDSVRRDIKKVDRELRQLRCIDEFSTRCLCDLYMHPYCCCDLHPYPYCLCYSKRSRSCGPV

SEQ ID NO: 7704 - protein, 56 aa, Homo sapiens; identical to SEQ ID NO: 6178
  UNSURE 26: Xaa = Ser,Thr

SEQ ID NO: 7705 - protein, 59 aa, Homo sapiens [sequence omitted]

SEQ ID NO: 7706 - protein, 76 aa, Homo sapiens
  UNSURE 72: Xaa = Ala,Pro,Ser,Thr
MDNHLEELSLPVPTSDRTTSRTSSSSSSDSSTNLHSPNPSDDGADTPLAQSDEEEERGDGGAELEPAASSGXLTTD

SEQ ID NO: 7707 - protein, 81 aa, Homo sapiens
  UNSURE 45: Xaa = His,Gln
MLAAVGRPKPRSPLSSLSTLQLYLFCSSTRRADMDPNPRAALERXSSAFGSGKNSSRTFYSQRQSLSFLCPICISSRRDPP

SEQ ID NO: 7708 - protein, 51 aa, Homo sapiens
  UNSURE 45: Xaa = Gly,Arg
  UNSURE 44: Xaa = Lys,Arg
MTAIQQEQVDQVKITGKPIKRRPVSFVARYFDETLSEKTAATPXXPLFLLL

SEQ ID NO: 7709 - protein, 91 aa, Homo sapiens [sequence omitted]

SEQ ID NO: 7710 - protein, 91 aa, Homo sapiens [sequence omitted]

SEQ ID NO: 7711 - protein, 91 aa, Homo sapiens
  UNSURE 74: Xaa = Asp,Glu
MILGNKCDMNDKRQVSKERGEKLAIDYGIKFLETSAKSSANVEEAFFTLARDIMTKLNRKMNDSNSAGAGGPVXITENRSKKTSFFRCSLL

SEQ ID NO: 7712 - protein, 91 aa, Homo sapiens [sequence omitted]

SEQ ID NO: 7713 - protein, 96 aa, Homo sapiens
  UNSURE 52: Xaa = Asp,Asn
  UNSURE 75: Xaa = Asp,His,Asn,Tyr
  UNSURE 73: Xaa = Gly,Val
  UNSURE 74: Xaa = Ile,Lys,Met,Asn,Arg,Ser,Thr
MILGNKCDMNDKRQVSKERGEKLAIDYGIKFLETSAKSSANVEEAFFTLARXIMTKLNRKMNDSNSAGAGGPXXXNRKPIKEDQFLSLLATLMNSF

SEQ ID NO: 7714 - protein, 91 aa, Homo sapiens [sequence omitted]

SEQ ID NO: 7715 - protein, 96 aa, Homo sapiens
  UNSURE 86: Xaa =  * ,Ile,Lys,Leu,Arg,Ser,Thr
  UNSURE 30: Xaa = Lys,Asn
MILGNKCDMNDKRQVSKERGEKLAIDYGIXFLETSAKSSANVEEAFFTLARDIMTKLNRKMNDSNSAGAGGPVKITENRSKKTSFXSLLATLMNSF

SEQ ID NO: 7716 - protein, 91 aa, Homo sapiens
  UNSURE 72: Xaa = Ile,Lys,Met,Asn,Arg,Ser,Thr
MILGNKCDMNDKRQVSKERGEKLAIDYGIKFLETSAKSSANVEEAFFTLARDIMTKLNRKMNDSNSAGAGGXVKITENRSKKTSFFRCSLL

SEQ ID NO: 7717 - protein, 91 aa, Homo sapiens; identical to SEQ ID NO: 7716
  UNSURE 72: Xaa = Ile,Lys,Arg,Thr

SEQ ID NO: 7718 - protein, 91 aa, Homo sapiens [sequence omitted]

SEQ ID NO: 7719 - protein, 96 aa, Homo sapiens
  UNSURE 74: Xaa =  * ,Cys,Asp,Glu,Gly,His,Lys,Asn,Gln,Arg,Ser,Trp,Tyr
  UNSURE 75: Xaa = Asp,Asn
  UNSURE 73: Xaa = any one of the twenty amino acids
MILGNKCDMNDKRQVSKERGEKLAIDYGIKFLETSAKSSANVEEAFFTLARDIMTKLNRKMNDSNSAGAGGPXXXNRKPIKEDQFLSLLATLMNSF

SEQ ID NO: 7720 - protein, 82 aa, Homo sapiens
  UNSURE 70: Xaa = Ile,Leu,Ser,Thr
MARTPDLSHFWELLVELQKKRRLTKLVKRDRARWLTPVILALWRPRQADHLRSRVRDQPGQLGETSSLLXVQKLAGRGGMHL

SEQ ID NO: 7721 - protein, 86 aa, Homo sapiens
MASVAVDPQPSVVTRVVNLPLVSSTYDLMSSAYLSTKDQYPYLKSVCEMAENGVKTITSVAMTSALPIIQKLEPQIAVANTYACKG

SEQ ID NO: 7722 - protein, 94 aa, Homo sapiens
  UNSURE 20: Xaa = Asn,Ser
MKTDSLMEEKLECSLWCCLXDPSTPGRCCVLERRIVPWMQQESYSSSSPIWSVDSDEPNLTSVLERLEDTKDNSSVRKETKLFSLFLMNIIFRN

SEQ ID NO: 7723 - protein, 50 aa, Homo sapiens
MEGCGGIVSCKFESSYLPFNSLHSSLPLNKQNNTKTQKTKTVFALGRRTT

SEQ ID NO: 7724 - protein, 70 aa, Homo sapiens [sequence omitted]

SEQ ID NO: 7725 - protein, 55 aa, Homo sapiens
MADKEAAFDDAVEERVINEEYKIWKKNTPFLYDLVMTHALEWPSLTAQWLPDVTR

SEQ ID NO: 7726 - protein, 52 aa, Homo sapiens
MCCTGRYISNIIFKFEFSEVLPKKKHYCFCARDAHQNLKSCSHFSVLVDTFS

SEQ ID NO: 7727 - protein, 78 aa, Homo sapiens
  UNSURE 16: Xaa = Leu,Val
MVATRSLQPQSPYSAXPGGGGKRYRAVYDYSAADEDEVSFQDGDTIVNVQQIDDGWMYGTVERTGDTGMLPANYVEAI

SEQ ID NO: 7728 - protein, 55 aa, Homo sapiens
MVFESVGARAHFWLSQQLGWHLLPSARNSNIMNARDSVLSKVFHPKGAGHGGSRL

SEQ ID NO: 7729 - protein, 67 aa, Homo sapiens [sequence omitted]

SEQ ID NO: 7730 - protein, 73 aa, Homo sapiens
MYQDRPDHKTNNKECQKSFTWKKKKMRARRPKKGEVSIDGTLGCSLRPPLLVFASKKNISTENHIIWFNRLNI

SEQ ID NO: 7731 - protein, 53 aa, Homo sapiens
MAGGGRGGSCNRYWRERRGHKGRGRNRCPQWLQICPWITEDSCSPAEVETAVS

SEQ ID NO: 7732 - protein, 67 aa, Homo sapiens
  UNSURE 26: Xaa = Lys,Arg
MNSLVLFLGHLGLLIKDCVLLFAMSXVSQKQKVLGPFGSPELESLGIGPKYLHFHRFLVGDFLQAKV

SEQ ID NO: 7733 - protein, 101 aa, Homo sapiens [sequence omitted]

SEQ ID NO: 7734 - protein, 55 aa, Homo sapiens; identical to SEQ ID NO: 6473

SEQ ID NO: 7735 - protein, 84 aa, Homo sapiens
MHLFESLLSILWGIYPGVELLDHMVTPYLIFEELPDCFPQWPHHFTFSSTMHKVPVSLHPHQHLLFSYPNGCKLVAYGFLFAFT

SEQ ID NO: 7736 - protein, 70 aa, Homo sapiens
MGIIFLRFHRLRSGLAFRIGLEKGPSAGWAGVFLPMCSVPLHTPPLWSRCIVEILPQGWVQWLTPVIPVL

SEQ ID NO: 7737 - protein, 71 aa, Homo sapiens
  UNSURE 53: Xaa =  * ,Cys
  UNSURE 12: Xaa =  * ,Lys,Arg,Trp
  UNSURE 58: Xaa = Cys,Trp
  UNSURE 40: Xaa = Gly,Arg
MSRGGSYPHLLXDVRKRSLGLEDPSRLRSRYLGRREFIQXLKLEATLNVHDGXVNTIXWNDTGEYISIWLR

SEQ ID NO: 7738 - protein, 75 aa, Homo sapiens
MPTSSELKVLTFLLPHQYLLFSDFLMIVILVGVKWYLIVVLICISLMANDVEPSFHVSPGHLCIFGEVFRSFAHY

SEQ ID NO: 7739 - protein, 61 aa, Homo sapiens
  UNSURE 59: Xaa = Leu,Val
MYGTVERTGDTGMLPANYVRPSEPAAPPSVFSTFHGIASVLGVTRSILQCLCFLKPATXDS

SEQ ID NO: 7740 - protein, 87 aa, Homo sapiens
  UNSURE 60: Xaa = Arg,Thr
MANRGPSYGLSREVQEKIEQKYDADLENKLVGLDHPAVRRGHRAPAPRQAHFQKWLMDGXVLCKLINSLYPPGQEPIPKISESKDGF

SEQ ID NO: 7741 - protein, 56 aa, Homo sapiens
  UNSURE 38: Xaa =  * ,Glu
  UNSURE 53: Xaa = Cys,Phe,Gly,Val
  UNSURE 48: Xaa = Phe,Leu
  UNSURE 49: Xaa = Pro,Thr
MREVRARLAATQVEYISGKVFFTTCSDLNMLKKLKSAXRLFLLIKKQXXLIIXFCK

SEQ ID NO: 7742 - protein, 152 aa, Homo sapiens
  UNSURE 45: Xaa = Ala,Val
MALASVLERPLPVNQRGFFGLGGRADLLDLGPGSLSDGLSLAAPXGVSQKSQESKCFMEQPPWPSRLYYVDSEGNRISVATFSVGSGSVYAYGVMDRGYSYDLEVEQAYDLARRAIYQATYRDAYSGGAVNLYHVREDGWIRVSSDNVAGST

SEQ ID NO: 7743 - protein, 58 aa, Homo sapiens
MLSPTFCCSSLLIPKKVVFTWCFFNLLRMNSRNISTNTLNSCHILIFTEHLHTHYVIR

SEQ ID NO: 7744 - DNA, 108 bp, Homo sapiens
gaggttgagacaagagaatcacttgaacctgagaggcagaggttgcagtgcagcctgggtgacagagggagactccggccccctcccaaaaaaaaaaaaaaaaaagct

SEQ ID NO: 7745 - DNA, 89 bp, Homo sapiens
aataatagctactaaaaagtaacaaggttgagaccagcctgggcaacataaggagaccccttcttcacaaaaaaaaaaaaaaaaaagct

SEQ ID NO: 7746 - DNA, 108 bp, Homo sapiens
gaggttgagacaagagaatcacttgaacctgagaggcagaggttgcagtgcakcctgggtgacagagggagactccggccccctyccaaaaaaaaaaaawmaaaagct

SEQ ID NO: 7747 - DNA, 108 bp, Homo sapiens; identical to SEQ ID NO: 7744

SEQ ID NO: 7748 - DNA, 154 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaaaaaagct

SEQ ID NO: 7749 - DNA, 108 bp, Homo sapiens; identical to SEQ ID NO: 7744

SEQ ID NO: 7750 - DNA, 96 bp, Homo sapiens
agagaccaatggctgcggccgcagctgcggcgctggaatcctggcaggcggcggctccgcggaagaggcgctccgcggctcgacggccgcrgcggm

SEQ ID NO: 7751 - DNA, 153 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaaaaagct

SEQ ID NO: 7752 - DNA, 108 bp, Homo sapiens; identical to SEQ ID NO: 7744

SEQ ID NO: 7753 - DNA, 101 bp, Homo sapiens
acagttaactttaggaccatagccaaaagatagaaacagcataaacgccaaaataaaaagaagccaataaagataaacacaaaaaaaaaaaaaaaaaagct

SEQ ID NO: 7754 - DNA, 108 bp, Homo sapiens; identical to SEQ ID NO: 7744

SEQ ID NO: 7755 - DNA, 113 bp, Homo sapiens
aagtaggagcggcggcwgcggcggcggcggcggtcgaaagcggwgtgaaagagggaggcagggagccggagagccggaaccgbamtcgcagcsgcggagacccctgtgcggtd

SEQ ID NO: 7756 - DNA, 108 bp, Homo sapiens; identical to SEQ ID NO: 7744

SEQ ID NO: 7757 - DNA, 108 bp, Homo sapiens
gaggttgagacaagagaatcacttgaacctgasaggcasaggttgcagtgcagcctgggtgacagagggagactccggccccctcccaaaaaaaaaaaaaaaaaagct

SEQ ID NO: 7758 - DNA, 108 bp, Homo sapiens; identical to SEQ ID NO: 7744

SEQ ID NO: 7759 - DNA, 406 bp, Homo sapiens
cctgtaatcccagctacccaggaggctgaggcaggagaatcgctggaacccgggaggtagaggctgcagtgagccgagatcgcgccactgcactccagcctgggcgacagagcgagagtttgtctgaaaaaaaaaaaaaaaaaaaaaagccagggtgagcggtggctcaagcctgtaatcgcaagcaacactttgggaggcggcagctgggcagatcaccggaggtcgggagttggagaccagcctgaccaacgtggagaaaccccatctgtactaaaaatacaaagttagacgggcgtggtggcacatgcctgtagtcccagctgctcgggaggctgaggcaggggaatcgcttgaacccgggaggcggaggttgcagagagcctaratcgcgccattggactcc

SEQ ID NO: 7760 - DNA, 108 bp, Homo sapiens; identical to SEQ ID NO: 7744

SEQ ID NO: 7761 - DNA, 88 bp, Homo sapiens
cattggtagcttgatggggatggcattgaatctgwaaattaccttgggcagtatggccattttcacgatatygattcttcctacccgy

SEQ ID NO: 7762 - DNA, 169 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacawaaaaraaaaaaaaaagct

SEQ ID NO: 7763 - DNA, 108 bp, Homo sapiens; identical to SEQ ID NO: 7744

SEQ ID NO: 7764 - DNA, 108 bp, Homo sapiens; identical to SEQ ID NO: 7744

SEQ ID NO: 7765 - DNA, 108 bp, Homo sapiens
gaggttgagacaagagaatcacttgaacctgakaggcagaggttgcagtgcagcctgggtgacagagggagactccggccccctcccaaaaaaaaaaaaaaaaaagct

SEQ ID NO: 7766 - DNA, 169 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaaaaaaaaaaaaaaaaagct

SEQ ID NO: 7767 - DNA, 108 bp, Homo sapiens; identical to SEQ ID NO: 7744

SEQ ID NO: 7768 - DNA, 134 bp, Homo sapiens
actgtcggcgcttcccccacccccccaggaccchmccctgsctsccagmcstgcaaatytvgcgaggaaacacgcggwttmactaghgtgtytacaccgatcactactaatycgkrccgaaccgatccggattw

SEQ ID NO: 7769 - DNA, 108 bp, Homo sapiens; identical to SEQ ID NO: 7744

SEQ ID NO: 7770 - DNA, 108 bp, Homo sapiens
gaggttgagacaagagaatcacttgaacctgagaggcagaggttgcagtgcagcctgggtgacagagggagactccggccccctyccaaaaaaaaaaaaaaaaaagct

SEQ ID NO: 7771 - DNA, 108 bp, Homo sapiens; identical to SEQ ID NO: 7744

SEQ ID NO: 7772 - DNA, 266 bp, Homo sapiens
atgtcgtctcccagtgggaagggagcccgggcgctggaggctcctggctgcgggccccggccgctcgcccgggacctggtggactccgtggacgatgcggaggggctgtacgtggctgtggagcgctgcccgctgtgcaacactacccgccggcggctgacctgcgccaaatgcgttcagagcggcgatttcgtctacttcgacggccgcgaccgggagaggtttatcgacaagaaggaaaggctaagccgacttaagagcaagcm

SEQ ID NO: 7773 - DNA, 108 bp, Homo sapiens; identical to SEQ ID NO: 7744

SEQ ID NO: 7774 - DNA, 63 bp, Homo sapiens
cttttgcgttctctttccctctcccaacatggcggcctcagcaaaaaaaaaaaaaaaaaagct

SEQ ID NO: 7775 - DNA, 299 bp, Homo sapiens
tttttttttttttttttytctttctgagacggagtctcgctttgkcgccaaggctggagtgcagtggtgagatctcagmtcactgcaacctctgcctycctgcctcatgtcctgccccatccctatcctgcctgatccctggatctccctcaratcccctyttctmagacagcgccaggccggggtggggccggggttggggccragccccacagytgcccccytcccctccctttttcgkataatttaataaagaaatggtcgcgcttctgtttttgaaaaaaaaaaaaaaaaaagct

SEQ ID NO: 7776 - DNA, 108 bp, Homo sapiens; identical to SEQ ID NO: 7744

SEQ ID NO: 7777 - DNA, 80 bp, Homo sapiens
tttttcgcaacgggtttgccgccagaacacaggtgtcgtgaaaactacccctaaaagccaaaaaaaaaaaaaaaaaagct

SEQ ID NO: 7778 - DNA, 101 bp, Homo sapiens; identical to SEQ ID NO: 7753

SEQ ID NO: 7779 - DNA, 63 bp, Homo sapiens; identical to SEQ ID NO: 7774

SEQ ID NO: 7780 - DNA, 80 bp, Homo sapiens
ctttttcgcaacgggtttgccgccagaacacaggtgtcgtgaaaactacccctaaaagccaaaaaaaaaaaaaaaaagct

SEQ ID NO: 7781 - DNA, 108 bp, Homo sapiens; identical to SEQ ID NO: 7744

SEQ ID NO: 7782 - DNA, 154 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaawwrraaaaaaaaaaaaaaaaaaaaaaaagct

SEQ ID NO: 7783 - DNA, 169 bp, Homo sapiens
ctggacaaatgacttgaatagacagttctccaaagaagatatgcaaatggctcaacattattaatcattagggaacattgttaataattagyggtatctscacagtgagatatcacttsttacccattaggatggctataataaaaaacamaaaamaawaaaaaargct

SEQ ID NO: 7784 - DNA, 108 bp, Homo sapiens; identical to SEQ ID NO: 7744

SEQ ID NO: 7785 - DNA, 108 bp, Homo sapiens; identical to SEQ ID NO: 7744

SEQ ID NO: 7786 - DNA, 366 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaawwawaaaragct

SEQ ID NO: 7787 - DNA, 101 bp, Homo sapiens; identical to SEQ ID NO: 7753

SEQ ID NO: 7788 - DNA, 444 bp, Homo sapiens
acctggggcgcccgcgcgggaagcgccagtgcgggggagagccccggatactcgacccccaagccagtttggggagaaagacggcggcggggaggggaaagttgagcacacagctgcgattcccgtgagttgcggcgactttgcataggtgacatcgcgccgcggtcctgccttgggcacggtgggacccgcttgctgagcgcgctctagagcgcgcggyacatcgtcgaaatttctaactctgcagggaaagcgctatgtacttcggctttacaaatggggaaactgaggctcagaaacgcgccctaccaaagccaccgaccagtaagtggcaacgccaaataataaataggactttaagcccagggctttctgctgcagagagcgtaccctcaccccttcgattctgccaggcatcaggaccaggagggtcccgcagccgcg

SEQ ID NO: 7789 - DNA, 108 bp, Homo sapiens; identical to SEQ ID NO: 7744

SEQ ID NO: 7790 - DNA, 108 bp, Homo sapiens
gaggttgagacaagagaatcacttgaacctgagaggcagaggytgcmstgcagcctgvgtgacagagggagactccggccccctcccaaamaammwaaaarraaagct

SEQ ID NO: 7791 - DNA, 108 bp, Homo sapiens
gaggttgagacaagagaatcacttgaacctgagaggcagaggttgcagtgcagcctgggtgacagagggagactccggccccctcccaaaaaaaaaaaamaaaaagct

SEQ ID NO: 7792 - DNA, 339 bp, Homo sapiens
catataaaattagatttgtattcagaaaacaaccagaaatatgaaataactaggaataattttaataagaaatgttaaaaattatcaatgtttgggaaataaaacatacatacaggtagagttatgccatgttgaaggagagaaataaccaaatctagggctgagcacagtggctcatgcctgtaatcctagcactttgagaggccgagatgggaggaccgcttgaggccaggagttcagcctggtcaacacagcaagcccttagcgcaaaaaaaaaaamrrhaagaaaagaamagaaaggaaaaaaaagatgtgagataagtaaccaaatattacagk

SEQ ID NO: 7793 - DNA, 79 bp, Homo sapiens
gaggaagaagcggaggaggcrgmtcccgcgctcgcagggccgtgccacctgcccgcccggccgctcgctcgctcgcccg

SEQ ID NO: 7794 - DNA, 63 bp, Homo sapiens
cttttgcgttctctttccctctcccaacatggcggcctcagcaaaaaaraaaaaaaaaaagct

SEQ ID NO: 7795 - DNA, 169 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaaaaaawaaaaaaaaaagct

SEQ ID NO: 7796 - DNA, 108 bp, Homo sapiens
gaggttgagacaagagaatcacttgaacctgagaggcagaggttgcagtgcagcctgggtgacmsagggagactccggccccctcccaaaaaaaaaaaaawaaaagct

SEQ ID NO: 7797 - DNA, 80 bp, Homo sapiens; identical to SEQ ID NO: 7780

SEQ ID NO: 7798 - DNA, 108 bp, Homo sapiens; identical to SEQ ID NO: 7744

SEQ ID NO: 7799 - DNA, 89 bp, Homo sapiens
ccataaaaggctaaatgtassagttcacttataaagtgaacaggtagatctaatcagtctagtaagtccaaaaaaaaaaaaaaaaagct

SEQ ID NO: 7800 - DNA, 63 bp, Homo sapiens; identical to SEQ ID NO: 7774

SEQ ID NO: 7801 - DNA, 150 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaagct

SEQ ID NO: 7802 - DNA, 500 bp, Homo sapiens
  misc_feature 417: n=a, g, c or t
tgattatgtgtcttggggttgctcttcttgmsgggtatcttasyggtgttccctgtactttctgaatttgaacttgggcctgtcttgctaggttgssgaagyycttctggatgatatcctaaagtgtgttttccaatttggtccattctccctgtcactttcaggtatgccmstcattcatgggtwwggtcttttcacatagtcgcatatkytcttgcaggctttgttcactccttttcattgttcttgttctctaatcttgyctttatgccttatttcagcmhggtgatcttcastctctgatatcctttcttctgcttsatcgatttgtctattgatactygtgtatgctycaagaagytctcatgctgtgtttttcagctccatcaggtcattkatgtycctctctaaactggnyattktagttagccattcctgtmacctttkatcaaggttcttarcttccttgcattgggttagaacatgctcctttagctcas

SEQ ID NO: 7803 - DNA, 108 bp, Homo sapiens; identical to SEQ ID NO: 7744

SEQ ID NO: 7804 - DNA, 108 bp, Homo sapiens; identical to SEQ ID NO: 7744

SEQ ID NO: 7805 - DNA, 108 bp, Homo sapiens; identical to SEQ ID NO: 7744

SEQ ID NO: 7806 - DNA, 297 bp, Homo sapiens
ttgtagttgttgctgtttttgagacagagtctcactctgtcgcctaggctggagtgcagtggtgcaatctcagctcactgcaaactctgcctcccaggttcaaactattctcctgcctcagcctcccaagtaggtgggactacaggcgcccaccaccacacccgcctaatttttgtattttattagagacagggtttcaccatattggccaggctggtcggaactcccgaccttgtgatccacccacctcggsctyccacagtggtgggattacaggcgtgagccaccacacccags

SEQ ID NO: 7807 - DNA, 357 bp, Homo sapiens
aagagaaaacatagaagaatatctttataacctttggagtaagcaaatatttcttagagaacagacaaaaatttcataaaagaaaaaaaattaatgactcagacataaaccacagtgtgggggaaaatatttgtaaaatattttctgtccacagagtgaaaatgatatctcatgcagtttggatgtgtatctgcctgactcctggagatggtgcatatcttttatgttgacttaaatttttttttctgkgaattgccaattcatgccctttgactatttttctattggtttgkccttttttaaaaatcgatgtttargtgcttatgtttaagtaatatgaaacctatgcttacatgk

SEQ ID NO: 7808 - DNA, 80 bp, Homo sapiens; identical to SEQ ID NO: 7780

SEQ ID NO: 7809 - DNA, 385 bp, Homo sapiens
gacggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgttttttgaccagaaaaaccgacaaccttccccagaaagtccaagctcgtggtgggt

SEQ ID NO: 7810 - DNA, 53 bp, Homo sapiens
agagagcgctctgggtagaggccgggcccggrmagcaggtggccccaggtagc

SEQ ID NO: 7811 - DNA, 381 bp, Homo sapiens
cgagtcgtttaagctgccgttccagcttgcccagcacacaaaaagtcacaggacatttcaggctcagtgtagttttccagaatgccatgagctttttgaagatcttcctctgctgtatgaacatgaagctcaacactatttaagtaaaacaccagagtcatctgcacaaccaagtgaaacaattctttgggatgttcagacagactcaaatcctaatcaggaaaaagactcatctagtaatgagaaacaaactattagtctgccagtttctactagcaaatcaaggaaagagtctacagaaccaaagacatgtatagaaagtatggaaaagaaaacagacagtttagttcagaatggaaacgaacgttctgatgacactgk

SEQ ID NO: 7812 - DNA, 177 bp, Homo sapiens
caaaaaattagccgggcgcggtggcgggtgcctgtagtcccagctactcgggaggctgaggcaggagaatggcgtgaacctgggaggcggagcttgcagtgagccaagattgtgccactgcaatccggcctgggctaaagagcgggactccgtcccaaaaaaaaaaaaaaaaaagct

SEQ ID NO: 7813 - DNA, 162 bp, Homo sapiens
  misc_feature 111,162: n=a, g, c or t
gttggacatgggttgtaaaaataaaaccaggaacacacaaacagacacacacacaaacacacccccacctcctgcaattaaacagtagcatcgccaaaaaaaaaaaaaawnvwmhwmmaaaaaaaaaaaaaaaaaaaaaaaaaaaaaaaaaaaaaaaaaaan

SEQ ID NO: 7814 - DNA, 409 bp, Homo sapiens
caagaaactggtacagtgttatcagaatggacttccattaagggatttagcacagatatttaaaattctgaatctgtgttcaggaaaaataaaaaaccagcctcgttttatagaatctgcatatgatatcataaaactgtgtggcttgccatttttgaaaaagaaagtgtcggatgaaataacttatgctgaagatactgctaattcaattgcacttctgggtgacttaatgaaaataccaagttctgaattgaggatacaaatttgtaagtgtattgktgatttttatcatgcagaaccaccaaagaagcatattccaggttaccagcaagcgagttcatcatacaagattcaaatggctgaagttggaggattagcaaaaacaatggtccagtcaatgaccttgctt

SEQ ID NO: 7815 - DNA, 230 bp, Homo sapiens
agacctaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcggg

SEQ ID NO: 7816 - DNA, 61 bp, Homo sapiens
ataaccggccgccgccgccaccgcggaccgagcgcggagttctggagtctcggacccgaag

SEQ ID NO: 7817 - DNA, 157 bp, Homo sapiens
agtgcgggctgagaaggcggtggctgcagcagcagcggcggcggaaaccctaaagtccgagtccggactacgagtgcgtggcctcctaatccggatcctagtcctgagcgtgtctgtgtgcsagtggacsgkcccggacgcgatgaccctgaacggs

SEQ ID NO: 7818 - DNA, 158 bp, Homo sapiens
ctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggca

SEQ ID NO: 7819 - DNA, 205 bp, Homo sapiens
ttgaattgagtcattaattttgatgctgaagttgttccatatgatatcaggaataattgaggagtagaagatggcttggtgacagtgtgttgagtgaatgtgagaatctggccgggcattggacagattttctgaataaattgaggatgtgaagaggatggcatttctaaataatgtgaacttcaaaaaaaaaaaaaaaaaagct

SEQ ID NO: 7820 - DNA, 366 bp, Homo sapiens
atcaatcattggctctcatttgtatccacaccttccccctggtgatcccatctggtcccatgactttaaaatcattctaccagagggagtggagccaagatggctgaaaaggaacagctccagtctacagctcccagtgtgagcgacacagaagatggatgatttctgcatttccaactgaggtactgggttcatctcactggggagtgctgtatagcgggtgcagcacaccatacatgagccaaagcagggcgaggcatcgcctyacccgggaagcacaagaggtcagggaattcccattcctagtcaaagaaaggggtgacagatggcacctggaaaatcgggttactyccaccctaatactgk

SEQ ID NO: 7821 - DNA, 361 bp, Homo sapiens
attcactatccaagctgcaccatcttcggggtcattgtgtgccaggcatatcaactcttttcaataaaaatggtaagtaatagattttataactctccttggtctcctggcaaatgtgctactcttctctgcatagaacagtcagagttgagggtgcttcacagtcaggtcctctgagcctttgggattttgcttggccactttttccttgctgatgaagctgctgagtcttgttcatgccagttgagagacatggcttcaagagttccctttttttgattctagccttcagaataggagaagagcactgkcttgcagaaagaaaatatgcattctttgkctttgcctcataggatagctt

SEQ ID NO: 7822 - DNA, 317 bp, Homo sapiens
attattgttctttttttgcgatgggtctctgttacctaagctggtctgagctcctgagctcaagcgatcctcctgcctcggccacccaaagtgttgggattacaggagtgagccaccacgtctggcctctcgtcgtttttattttttaatttttgagtgggggctcgctccgtcgcccaggctgtgatgcagccgcgcgatcacgacctactgsrtcctggacctcctgggctcaagcgaatctccggcttcagcctcccaagtagctggaactacactyccgcgccaccacgtcccgctaaattaaaaaaaaaaty

SEQ ID NO: 7823 - DNA, 343 bp, Homo sapiens
aaaaaaaatgtggcacacatacaccatggaatactatggagacataaaaaaggatgagttcatgtcctttgcagggacatggatgaagctggaaacaatcagtctcaggaaactaacacaggaacagaaaaccaaacaccgcatgttctcactcataagtaggagttgaacaatgagaacacatggacacagggaagggaacatcacacaccagggcctgtcagggggtgggggcgaggggaggcatagcattaggagaatacctaatgtagatgacgggttgatgggtgcaagcaaaccaccatggcacctgtatacctatgtaacaaacctgcaagttcag

SEQ ID NO: 7824 - DNA, 343 bp, Homo sapiens
actcgtctggcaccagcccgggccgcgcccgggacctcatttcggacctcggtttccctttgcgtggggctcgcagctgccaccgcttccccgcggagcatggggctgcctcgccgggcaggggacgcggcggagctgcgcaagagcctgaagccgctgctggagaagcgccggcgcgcgcgcatcaaccagagcctgagccagcttaaggggctcatcctgccgctgctgggccgggaggatgcttctggctggcacacctggcttcccctccatgctcagaactgsttcctactctacatccaggctcctgagcagcccccagcttaagcttcagcagcty

SEQ ID NO: 7825 - DNA, 208 bp, Homo sapiens
ttcgcgagaagccggtccgcgatcttgtggccgcccctcccctccccctgcctctcggactcgggctgcggcgtcagccttcttcgggcctcggcagcggtagcggytcgctcgcctcagccccagcgcccctcggctaccctcggcccaggcccgcagcgccgcccgccctcggmmgccccgacrccggcctgggccgcggccgcar

SEQ ID NO: 7826 - DNA, 293 bp, Homo sapiens
taaaataaaggcacctcttgcagtggcatcttcgatttgaagaagtataatattctacgaatatacaaatttctgttgtttttttgtmyscccgcaasscctgcccttttaaagacatatagtaatatagtggggttataggtttatatactgctacttadctgtgcagagaaattacagcatttaaaarratcaccaatctgtcttmstcataagtcatsatctagaaatggggagaagcwdmgagtggkaattttggccagktaataaggkcttatrttcttttggcttaw

SEQ ID NO: 7827 - DNA, 242 bp, Homo sapiens
aaaaatatccggcgagccatggtgtctcacgcctgtaatcccagcagtttgggaggccaaggcgggtggatcacttgaggtcaggagttcaagaccagcctcaccaatatggtgaaacctcatctgtactaaaaatacaaaaattagccaggtgtggtggtgggcccctgtaatctcagctacttgggaggctgagccagaagaattacttgagcctgggggttggaggttgcagtgagccg

SEQ ID NO: 7828 - DNA, 584 bp, Homo sapiens
ataaaggaagagggcaacgttatcatctgactgcttgtagctgtggaagggcggcgtagaagaggaaaggctgggggtttcggatggttgtttttgaagccatcagtattcttgaagaagcagcatatcttgaactgtcctatgggtgaaggctttgatgtggtcctgtaaaaactggcattgaaatggatggcatctgatcctgcttcatgtgattcttcatttagctctggactctttacatcattaaggctttttctttgcaggaatttaaaagcaaccctatgaatataacatttgtcaaaaagagcaagtgccaagccagttgagaataaccttacaatgtgtacaaggattccagcttatgcaacatgaaaatggcaaggatgaagacctttatgatgatccatttccatttaatgaatagaagaagtgtkatcaattctgttgatggaccccttaatctcttctactgattatcttctacttgaaccagtgccaaattaatgttgcaagctttgtcttgaaatattttcttctgagcatcagccagagatcactgattggttcacaggaataagcag

SEQ ID NO: 7829 - DNA, 81 bp, Homo sapiens
attagaagtaagtaggttagaggggaggtggagggagtgtgctggggtgtgagcttttatgatgctgaaaggatcatgata

SEQ ID NO: 7830 - DNA, 310 bp, Homo sapiens
tgagatggagtcttgcactgtcacccaggctggagtgcagtggcgcgatcttggctcactgcaacccccgccgcctaggttcaagtgattctcatgcctcagcctcccaagtagctgggactacaggtgtgcaccactactcctggatatttttttgtggttttagtagagatggggtttcgccatgttggccaagctggtcttgaactcctgacctcaggtgatccacccgcctcgggctcccaaactgctgggattacagacgtgaggcaccacaaccagcctggatgattcttaagggcccttctag

SEQ ID NO: 7831 - DNA, 548 bp, Homo sapiens
tcttttttggagagaaggtcttgttatattgcccaggctagactcaaactcctaggctaatgtgcctctcctgcctcatcctcccaagaagctatgagatgagtggtagataatcaacctaggactgatgtttcaggtgatatagcacagattcaggcaaaactctcttgccattggtgataacactgtcttgaggaaccagaagtatctccttttcttgggatcatgggagtttgtgggttcttgtttttacataaaaaaccaaagtgtgtttcaaataatgcagatcttctcctcttagtaatcttctcagtatttcctttgaaaagggacagttcgtttccagatacataatttttatttatacatgcagcatagcacatttactatgcagttaagagcatgaacttgagagccagactgcctgtttgaatccccattcccttaacttctctgtgcatcagtttcttcmtctataaaatgggggytaatgataacacatacctcaaaggtggtaataasgatccagttaatattcatagatcttt

SEQ ID NO: 7832 - DNA, 328 bp, Homo sapiens
agtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgta

SEQ ID NO: 7833 - DNA, 505 bp, Homo sapiens
taatattatttaaaatgcaaacggggcagtttttgttgctgctgttgttcttgtttatttttgtgccctttatgtatttgttatgtttttctttggcagattttaagatcaccttttctttattgattttgaaaatcaaattatgatggcctgtggtgtcctttgtgtgtgtgtgtttcttacttagagtttattaaacttctcagttctatgtgtttatatttttcctttactgtgaacaattttcagccattttcttttcaaatatgtctagctttccccctcactctttctcttcttttagtactccagctgaaattaggatagaccactgctatccaattagtagtgccccacagatcactgatctcgttatttttatttcttcctttttcatccttttccctgctctgtgtttgtgtagtttccaatgtatgctggccattttctttgtgatgtctaatcgatagcattttctttatttcagaattgkatcttttagctt

SEQ ID NO: 7834 - DNA, 187 bp, Homo sapiens
attgctggggctccgcttcggggmggaggacgctgaggaggcgccgagccgcgcagcgctgcgggggaggcgcccgcgccgacgcggggcccatgkycagkwccaccagccagctgtatgacgccgtgcccatccagkccagcgyggtgtyatgttcctgcccatccccatcaatggtgaggacccw

SEQ ID NO: 7835 - DNA, 81 bp, Homo sapiens
ctttttcgcamcgggtttgccgccagaacacaggtgtcgtgaaaactacccctaaaagccaaaaaaaaaaaaaaaaaagct

SEQ ID NO: 7836 - DNA, 307 bp, Homo sapiens
aaaacaaaaaaaggggggaamagggggggaaagaaagaaagagaaaaaggagggcgagtggcgagcaggggcctcggccgccacccacacgccccgaagcgtgctcgtcccccgcgcggggctcccggccgccgccctcggccatccgctgctccccggtggcccaggcctcggactccgcggccggcccggcgcggcccagcgccctyagggatcatggcccaggtagcagtgtccaccctgcctgttgaagaagagtcctcctcagagaccaggatggtggtgacattcctcgtgtctgccctcs

SEQ ID NO: 7837 - DNA, 547 bp, Homo sapiens
aaaaggaagagggcaacgttatcatctgactgcttgtagctgtggaagggcggcgtagaagaggaaaggctgggggtttcggatggttgtttttgaagccatcagtattcttgaagaagcagcatatcttaactgtcctatgggtgaaggctttgatgtggtcctgtaaaaactgggaagatttggaggatcatctgaatacccatccaacagagatccatgattcatgtatttctcaagacagccatacactaaaattataagatcataagaatattaattatattctaccaatgcaatacaagcattgaaatggatggcatctgatcctgcttcatgtgattcttcatttagctctggactctttacatcattaaggtaccctgaatatattcagtatggctttttctttgcaggaatttaaaagcaaccctatgaatataacatttgtcaaaaagagcaagtgccaagccagttgagaataaccttacaatgtgtacaaggattccagttctgctgctatataaaccagcctcaaadtagtctg

SEQ ID NO: 7838 - DNA, 263 bp, Homo sapiens
cttttgccctgaagggggctggatgggcaaggcggccgsgatggctcgagctcgggcggtggcggcggtggccggaggcggyggtgcctmctcctcctcgscccggcgccggcggtgatcckagcgagcggscgcggycccckwtgagactgctggcggrctggctgtgcctgascctggcgtmcgwgtggctggcrckgaggatgtggacgctgckgagccckytcacccgctccctgtdcgtgaacatgactagcggcccr

SEQ ID NO: 7839 - DNA, 465 bp, Homo sapiens
caatgtaaagttgatctaaaaaatctcgttttccgccgtgcgcggtggctcacgcctctaatcccatcactttgggaggccgagacgggcggatcacgaggtcaggaggtcgagaccatcctggctaacactgtgaaaccctgtctctactaaaaaaaatacaaacaaaattagccgggcgtggtggcactcacctgtagtttcagctactctggaagctgaggctggagagtcacttgaacccgggaggcggaggttgcagtgatcagagatcgcgccactgcactccatcctgggcgaaagagctagatttcatctcataaaaaaraaamrraamwwaaraaaaaaattacagttttggctggctgggcgcagtggctctcgcctgkaatcccagcattttgggaggcgaggctggtggatcacttgaggtcaggagttcaaaaacagcctgacccacatggt

SEQ ID NO: 7840 - DNA, 409 bp, Homo sapiens
aaaaattagccgtggcccagcaaggtggctcatgcctgtaatcccagcactttggggggccagggtgggcggatcacttgagatcagaagttagggacaagcctggccatcatggtgaaaccccgtctctgctaaaaaatacaaaaattggccgggtgtggtggggtacaccggtaatcccagctacttgggtgactgaggcatgagaattgcttgggcctgggaggcggaggctgcagtgagctgagactgcactccagtctgggcaacagagcgagactttgtctcaaaaataaataaataaataaaaataaaaattagccagacatggtggtgcatatcggtagttccagctactcagctactcaggttcaaggctgcagtgagccatgattgcaacactgcactt

SEQ ID NO: 7841 - DNA, 307 bp, Homo sapiens
taccttgccgggcgcggtggctcacacctgtaatcccagcactttgtgaggctgaggcgggcagatcacgaggtcaggagatcgagactatcctggccaacacggtgaagccccctctctactaaaaatataaaaaattagccgtgcatggttgcgggcgcctgtggtcccagctactcaggaggctgaggcgggagaatgatgtgaacccgggaggcggaccttgccgtgagccaggatcacgtcactgcactccagcctgggtgacagagcaagactctgtctcaaaaaaaaaaaamwaaaagct

SEQ ID NO: 7842 - DNA, 515 bp, Homo sapiens
cacttaaaaaaagattctgcctaaacctctctttatctcactagaagagctaaccctaaccactaccaccgccagttagtatcagggctgctgtaaattgttccaagggtacatttagtggtattgattgctgctaatagtaaaagaataaaagcaattatgaatgtacacaacaacttgttgctctaccccagtttcaccaggagataggatttagtcaagaggggatgtcacagaatctttatcctgattaggagctttttgaggggagggaccttgccttttttcattttgtatctccaggtatacagggtgaaaggcaccatagtagatgccaagcgaatgaatgaatgaacgagatggataggcccaaagacaactaaatcaaaaaacctgtgttgkttcagaggagaatgatccagtatcatttcccctttgggtaggagtagtgggtatgaatattgctatgactgcagaaatcccagacttgkctagaatctctagttatagcttty

SEQ ID NO: 7843 - DNA, 365 bp, Homo sapiens
agggacctttagagagttagcaataaggctggagaaggaaaagccggcgcgcccgcggcccgcgcgatttcccgccgagcccgcgtccccggcggcgggcgggctccgggggcgcccgggccgcggcggcggcggcggcgcgagctgcgcctccgggccggtgaatcatcccggcagacaccaagagccgcggycagcagagaggagcgctgaaacatggctgaagcggccacgggctttctggagcagctcaagtcctgcatagtttggtcttggacgtwtctgtggaccgtgtggtttcttcatcgtgctattcctggtctacatcctgcgggtgccttttaaaatcaacgacwwcttgagch

SEQ ID NO: 7844 - DNA, 308 bp, Homo sapiens
acttcccgcggaggcgctccccggcgccgcgctccgcggcagccgcctgcccccggcgctgcccccgcccgccgcgccgccgccgccgcgcacgccgcgccccgcagctctgggcttcctcttcgcccgggtggcgttgggcccgcgcgggcgctcgggtgactgcagctgctcagctcccctcccccgccccgcgccgcgcggccgmccgtcgcttcgyagagggctggatggttgtattgggcwkggttggctccaggatgttaggaactgygaagatggaagggcattgaaaccagcgactggaa

SEQ ID NO: 7845 - DNA, 562 bp, Homo sapiens
aaaaggaagagggcaacgttatcatctgactgcttgtagctgtggaagggcggcgtagaagaggaaaggctgggggtttcggatggttgtttttgaagccatcagtattcttgaagaagcagcatatcttaactgtcctatgggtgaaggctttgatgtggtcctgtaaaaactgggaagatttggaggatcatctgaatacccatccaacagagatccatgattcatgtatttctcaagacagccatacactaaaattataagatcataagaatattaattatattctaccaatgcaatacaagcattgaaatggatggcatctgatcctgcttcatgtgattcttcatttagctctggactctttacatcattaaggtaccctgaatatattcagtatggctttttctttgcaggaatttaaaagcaaccctatgaatataacatttgtcaaaaagagcaagtgccaagccagttgagaataaccttacaatgtgtacaaggattccagcttatgcaacatgaaaatggcaaggatgaagacctttatgatgatccattt

SEQ ID NO: 7846 - DNA, 488 bp, Homo sapiens
catgagactgggtgagatcaccagtgagtagagacactgcacagaataggtataaggactaagcccagtggctctctaatgttaagaggtcagcgagaagaaacaaaggagactgaggagcagccagagaggttaaaggaaaaagtgtctcctcaaattccaattagaaattatcatcttcatcagtattttactaaaaaatgttctcctatttcactctgacaatgaaaaaaggtagtgaccaccaaaattatggatctacgattgtccatttttcattgaagcaatttttttttttttttgagatggagtttcactattgttgcccaggctggagtgcaatggtgagatctcggctcactgcagcctctgcttcccgggttcaggcggttctcctgcctcggcctcccaggtggctgagattacaggcacccaccaccatccctggctaactttttgtatttttggtabagacsgggtttgccats

SEQ ID NO: 7847 - DNA, 467 bp, Homo sapiens
aaaggataatgaaaacggctcggggcaaacaggcaacagtgaagagaaaaatttcctgcaaaagaccaagaccaggagcccttgtccttaaataagaggctagtgagggaagtctttcctgccaggagatgttcattgaagtgcagactgctcggagccacaccgcaggctggcagaggaagtgtctcggtgttgccttggcccgttcaccccctgccaggccagtagaggagctgaagagtcttcgccatgttttgagaaaaagcttagaggcctgaggctggaggcagggggatcagtgaggaggctgcarcatcagtccagttttaccaggtatacttgtttcaccggggaataggtctgtagaactcacactgscatycaggaagtgaaactycccggtwcaggcataccatggacatatttcargttcagctycagaccaccacagtgaagtgaatattgca

SEQ ID NO: 7848 - DNA, 329 bp, Homo sapiens
attttcgggactttcctaagctgctctaactttcctgccccttccccggccaagcccaactccggatctcgctctccaccggatctcacccgccacacccggacaggcggctggaggaggcsgkydkyttaaaattctgggaagmagaacctggycggagccactagacagagccgggcctagcccagagacatggagagttgctacaacccaggtctggatggtatyattgaatatgakwgatktyaaatttgaactsctbcattgtggaacccaaggagccakmcccmtaaacagttkatggyccctacctggtgatcgtggaacag

SEQ ID NO: 7849 - DNA, 100 bp, Homo sapiens
ggaaagcgagcgtatctcccgagccgttgccactgacagccgcgggcgctcccatctgagtaagagccagcccgtccgcggcctctmcagccccgggtty

SEQ ID NO: 7850 - DNA, 100 bp, Homo sapiens
ctttcctcttcctcctcctcctccttggcatccgcctcttcttcctcctgcgtcctcccccgctgcctccgctgctcccgacgcggagyccggagcccgm

SEQ ID NO: 7851 - DNA, 449 bp, Homo sapiens
ataaaggaagagggcaacgttatcatctgactgcttgtagctgtggaagggcggcgtagaagaggaaaggctgggggtttcggatggttgtttttgaagccatcagtattcttgaagaagcagcatatcttgaactgtcctatgggtgaaggctttgatgtggtcctgtaaaaactggcattgaaatggatggcatctgatcctgcttcatgtgattcttcatttagctctggactctttacatcattaaggtaccctgaatatattcagtatggaagaagtgttatcaattctgttgatggaccccttaatctcttctactgattatcttctacttgaaccagtgccaaattaatgttgcaagctttgtcttgaaatattttcttctgagcagcagccagagatcactgattggttcacaggaataagcaggggtaactctaaactgc

SEQ ID NO: 7852 - DNA, 116 bp, Homo sapiens
agagagtctcagattgtcttgataattcattctttcgttctctttcttttgcttctctattyytgtttttcagtgttttgcttgttttgttctgttttaggattttattctctcts

SEQ ID NO: 7853 - DNA, 58 bp, Homo sapiens
acggcccagycaggctggggtccgygcggggcctcccgagaggcggmaaggggcgctk

SEQ ID NO: 7854 - DNA, 81 bp, Homo sapiens
agggttaggggcgccaggacktgggcgtgcaggacgccagagctgggtcagagctcgagccagykgcgcccggagagattc

SEQ ID NO: 7855 - DNA, 90 bp, Homo sapiens
ccggagggcggagcttccagtgagccgagatctgcgctccaacctggggacagagcgagactccctctcaaaaaaaaaaaaaaaaaagct

SEQ ID NO: 7856 - DNA, 118 bp, Homo sapiens
tccrwagggaagcgctgggctaccrmggctattgwrcgtcgcgctctcgmmctcctcttcccgctgcagtgyctatggagcgaggctacgttksattgccgccctggcttaacccttv

SEQ ID NO: 7857 - DNA, 115 bp, Homo sapiens
cgtgggtgagccaagaaaatactaattaataatagtaagttgttagtgttggttaagttgytgcttggaagtgagaagttgcttagaaactttccaaagtgcttasaactttaag

SEQ ID NO: 7858 - DNA, 73 bp, Homo sapiens
aaagtaggctaggcctacggaagctgggtcttcttgctgkgaggtcrcgttccccagtgttacggagggtcct

SEQ ID NO: 7859 - DNA, 56 bp, Homo sapiens
ctytktygcaacgggtttgccgbcagaacacaggtgtcghgaaaactacccctaaa

SEQ ID NO: 7860 - DNA, 112 bp, Homo sapiens
agcgaggtcaaaggcccgggcagcattgtcagactttccgggttgacccgctgttgggagtcctttaagtgcatggtagcaagaaataaagggatatatgaaagccaaaaaw

SEQ ID NO: 7861 - DNA, 100 bp, Homo sapiens
tgtctcaaaaaaaaaaaaaaaaaaaammmaamaaaaaargaagaaagaysagaagaaggmsgagtctgaagagtcagatgatgacwtgggatttggcctt

SEQ ID NO: 7862 - DNA, 184 bp, Homo sapiens
ctagccaggtgcgccccgccccctgcctgcccggccaccttcgggagccgcttccaataggcgttcgccattggctctggcgacctccgcgcgttgggaggtgtagcgcggstctgaacgcgctgagggccgttgagtgtamrcaggcggykagggcgcgagtgaggagcagacccaggcatcg

SEQ ID NO: 7863 - DNA, 237 bp, Homo sapiens
gcggagacctgggagactccggccgcacgcgcgggacacgagcgtcccacgctccctggcgcgtacggcctgccaccactaggcctcctatccccgggctccagacgacctaggacgcgtgccctggggagttgcctggcggcgccgtgccakaagcccccttggggcgccacagttttccccgtcgcctycggttcctctgcctgcaccttcctgcggyygcgccgggacctggas

SEQ ID NO: 7864 - DNA, 426 bp, Homo sapiens
agaaggagcgaagctctggcccggcgtgtagcgggcgcactacggggacgctgggccgggcaccgggctgtgtggagaagtgagcgcgctcgtctgacccccgtgcccgccaccccgagccactaacggcgatctcccaaggcctgcccgaggcctctgtcctctgtcctcagccccgcagcggcaacgtcttgcactcggcgagctcgccgctcccgaccctcccgcgcccccgccctgccgcgctgctccccgcccagccgcgggtctgtggtccaagccgccccgaagcagcccgaacaagatcactcaaggtgaaggataatctactaataccagcactttgaatgaaaatttgtttctctgccacaaactgaacatctttttttytttyywytttttttttggtgggggagttgaaaccta

SEQ ID NO: 7865 - DNA, 367 bp, Homo sapiens
tatttgytaaatttgtatgttkctttaacaatwkggtgcagaaaacctatgccgaggactcctattttagaagggaaactaggtaaagaaawgtcagcagagaaaamggaraagagagaaatactgcctggctcagaaaacaacattcttttcagytgaaatagagggaatgcagctgaaagaakagaatgcttctggtggtgggtgagagaakatgagaragcmgatamtgaccatctttagctggggaaatgaagtcyatatacttgyggtagaactgtmtatatgcaggatttcagcttttatttcatgattacmtgaraaaagaagcatttgsttasctgyaaatattttttargcattttcy

SEQ ID NO: 7866 - DNA, 256 bp, Homo sapiens
gcamaacaagggcagmgggcccggcgcggtggctcacgcctgtaatctcagywctttgggaagccaaggcgggcgaatcacttgaggtcakgagttcgagaacagcctgkcccacagggtgaaactctttctctactaaaaatacmaarattagcggmgcttggytgcgggcacctgtratmccagkkactcgggaggctgaggcaggagaatcgctkgaacccgggaagcggmggttgtaktgagccgagatcgh

SEQ ID NO: 7867 - DNA, 452 bp, Homo sapiens
ctgtacctgagggaggagccaagatggccgaataggaacagctccggtctacagctcccagcgtgagcgacgcagaagacgggtgatttctgcatttcaatctgaggtaccgggttcatctcactaggaagtgccagacagtgggcgcaggtcagtgggtgcgcgcaccgtgcgcgagccgaagcagggcgaggcattgcctcacttgggaagcgcaaggggtcagggagttccctttcctagtcaaagaaaggggtgacggacgcacctggaaaatcgggtcactcccacgcgaatactgcgcttttccaaccagcttaaaaaacggcgcaccacgagattatatcgcacctggcttggagggtcctacgcccacggagtctcgctgattgctagcacagcagtctgagatcaaactgcaaggcggcagcgaggctgggggaggcgcccgv

SEQ ID NO: 7868 - DNA, 78 bp, Homo sapiens
atgttagctgtggccactgtggatttttcgcaagaacattaataaactaaaaacttcaaaaaaaaaaaaaaaaaagct

SEQ ID NO: 7869 - DNA, 303 bp, Homo sapiens
ctgggatttctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgkgcggtgctccgggggggcggygggagcccaagaagtacgcagtgaccgacgactaccagttgtccaagcaggtgctgggcctgggtgtgaacggcaaagtgctggagtgctt

SEQ ID NO: 7870 - DNA, 349 bp, Homo sapiens
tagtagagatggggtttcaccatattggccargctggtctcraactcctgacctcatgatctgcccacctsggccttacaaagtgctaggattataggggtgagccactgtgcccagygctgctccttttttcttgcaacatgcggattaccatagctttcctcttttcacctttagcccactttttccctttaaatactgaagccctcagcatcatctctggagaaaaggcacagaccakactgyttctgggattccctatttagttcttccaggcatgtccttaaccttggcaaaattaacttctaaattggyytagacctgtgtcagataatttttggtgtacagy

SEQ ID NO: 7871 - DNA, 177 bp, Homo sapiens; identical to SEQ ID NO: 7812

SEQ ID NO: 7872 - DNA, 572 bp, Homo sapiens
  misc_feature 309: n=a, g, c or t
actttttaacacttctgtcaagcatagtaaaatttcaacttaaaatatcacaagswctaaatcaatcaatgattcatttgtgcattttactttatttttgagacggagtcttgctctgtcgcccagactggagtgcagtggcatgatctcgtctcattgcaaccskccacctcccagattcaagcgattctcctttgtcagcctcgccaagtagctgggattacaggcatccactaccacgcctggctaatttttggaatttttagtagagacaggatttcaccatgttkgscaagstkggktccmaanyccckgahtttcaggcgatacgcccacctcggccttcccaaagtgctgggattataggcgtgagcamctgtgcccgggcctcattttgtgttatttaaattaaaacctttaagactgacttttttattcacacagactagggggtgtgcaatcttttgggcttccctkgggccacgctggaatgagaagaattgtcttggggccacacataaaaatacactaacactaatgatagctgatgagctaaaaaaaaaaaaaaatgg

SEQ ID NO: 7873 - DNA, 276 bp, Homo sapiens
agtttccgaggaacttttcaccggcgccgggccgcctctgaggccagggcaggacacgaacgcgcggagcggcggcggcgactgagagccggggccgcggcggcgctccctaggaagggccgtacgaggcggcggcccggcgggcctsccggaggaggcggctgcgccatggacgagccacccttcagcgaggcggctttggagcaggcgctgggcgagccgtgcgatctggacgcggcgctgctgaccgacatcgaaggtgcgtcagggcgggca

SEQ ID NO: 7874 - DNA, 216 bp, Homo sapiens
tggagtgtttktwwttttttttttttttgagacgggatctcactctgtcacctaggttggagtgcagtggtgcaatcttggttccccgtwacctccaccaccgggctaagggatcctcccgmcccagsctvtcaagtagctgggaccatakgtgcacgcctytacktccggytaatttthtttgtattttyggtmsaraccggatttcaccgtgtt

SEQ ID NO: 7875 - DNA, 106 bp, Homo sapiens
ratgtccgcgcgccaggcccgccccctccgbcgccgrmccgagcccgyccgaccctctttcaattttacctcaggatttggcgccaaagcggtctcgaagcgggtc

SEQ ID NO: 7876 - DNA, 172 bp, Homo sapiens
gaatttgaaaacttgkrgtaagcctgaaagagcaaagttgcaaccaggatgactacaatcaggacgtttctcttttttgatcctgttcacattktcagcctgattkgctgmtttgggtcctttcttgaaaactccacctgcttastkctgtgcatgcccagtgtggttaggy

SEQ ID NO: 7877 - DNA, 233 bp, Homo sapiens
aaactggagccctagggcttcagcgagacaaacgtaggatcaggctttgtgggggtgcarwgcttccctcagccttcagcacagaggtgtgagcctatttaagatagagctgyggcaggctcatgccagwgggcasaggggtctkgatgtgaaggctgvtctgaggctgccgggctgtttctggaagctacagyctaaggaagaaaccctgctatgggactgtggctgctctk

SEQ ID NO: 7878 - DNA, 155 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtstctactaaaaatacaaw

SEQ ID NO: 7879 - DNA, 83 bp, Homo sapiens
cttttcgatccghcatctgcggwrgagccrmcaccaaaatgcakatttthgtgaaaacccttacggkgaagaccatcaccctm

SEQ ID NO: 7880 - DNA, 265 bp, Homo sapiens
aggtttttgaagatggcggccctcaaggctctggtgtccggctgtgggcggcttctccgtgggctactagcggscccggcagcgaccagctggtctcggcttycagctygcgggttcakggaagysktcggagacccaagawgggaasmcaactataattgaaggccgtatymcagcgactcccamsgagagtccaaatcctsctaacccctmtggycagtgccccatytgccgttggaacctgaagcacawgtataactatgay

SEQ ID NO: 7881 - DNA, 508 bp, Homo sapiens
cagacaataattaaacacaaaattagacaaaaatggttgtgattagtactcaacatagaaaagcactgtggtgcaggggagtgaggggagaactggattagtaatttgaagccaaaaaaagggtgaaagccttttgagaaaccaaagatagattccctgttgtccatatactggaacacgttcaattcacttattgaagactctctgggcccttactcaaggcctgtttactcggatttatgtacatttctaacatggtttcatagttgacaagacattatttgcagtgggttagaagagagtggatggtgggaggacggatcagcagaaaaaataagctgatagaaccaagccctctggtattagggagtgatagcctagcattggggtggggaggaaggagagggacccagaccaaaccctaaatgctgaaaggacatgtcagttagcagtggtagagacaaagggttgaagtgtctcttttgtagcagttagcagttgtagcaga

SEQ ID NO: 7882 - DNA, 363 bp, Homo sapiens
caatgcttatggaaagccagttagttagaattggaaatctgkcttgtcattttacaagcattagattcctttcctgtgtgaagaaagcctcagtgaaacaggtctttgccakaactttatgaagtgctacagaaagcacaaagaattgattcatgttcatcaatacctgctgagagtactgtcccaggaatatccagkggatggattcatcatccaggaggttcaaaagtaagatggttttcaaatcakttktgagactggttgcataacagcagggkacctgaaagagccttctgggagttagtgaactaggtagattgttttgttcacataacgccaccatcaacttaaagtgaattgtck

SEQ ID NO: 7883 - DNA, 314 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctymgctgctccggaggctgaggcaggagaatggcttgaacctgggaggcggagattgcaagatcgcaccactgcaccccagcctgggcaacaaagtgagactccgtcgcaaaaaaaaaaaaaaaa

SEQ ID NO: 7884 - DNA, 501 bp, Homo sapiens
tggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagcagtgggaaaacagtgcaattaatcatttaccttcctaaagatggctggtgaatgtatcacctccatgagagcccaattcagaaatgcagccagaatggtgtttgacagtggatgaagaccaagaactaagatgtagctggagtgatatca

SEQ ID NO: 7885 - DNA, 344 bp, Homo sapiens
atggaatactatgcagccaaaaaaaggatgagttcatgtcttttgtagggacatggatgaagctggaaaccatcattctgagaaaactatcacaaggacagaaaaccamacactgcakgttctcactcataggtgggaactgaacaatgagaacacvaggacacagggtggggaacatcacacactggggcctgtcgtggggtsrsgrgagakgssagggatagcattaggagatatacctaatgtaaatgacgagttaacgggtgcagcacaccaacatggcacatgkatacatacgtracaaacctgcatgttgtgcacatgtaccctagaacttaaagtak

SEQ ID NO: 7886 - DNA, 455 bp, Homo sapiens
tcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgwggcaatggaacag

SEQ ID NO: 7887 - DNA, 401 bp, Homo sapiens
tcccgcagaaaccagtagtcctgacttggtggaaggaaatgtacaggcatctgactggtagagaacggagcctactcttccaggggcgcccatctccagaacattgtgtctcccagaggattaccgactgatctcatgattttkttggcacttgccaaagttctcttcttttcctctgggttctgttgcctgcctatatgtgtgccctctcttgtacccagagttggcctgtcccaaattctttccctctatcccaaagttggtacgcattgacctacctatggatgacagtgatttctgtctcctgtccttagtcctctcagcctccaactctccttcctgcaggcattgatgttgaacaagtgtctgtcgtcatcaactttgatcttcccgtggacaag

SEQ ID NO: 7888 - DNA, 171 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtcccaaaaaaaaaaaaaaaa

SEQ ID NO: 7889 - DNA, 77 bp, Homo sapiens
ccggagggcggasttccagtgagccgagatctgcgctccaacctggggacagagcgagactccctctcaaaaaaaaa

SEQ ID NO: 7890 - DNA, 328 bp, Homo sapiens
  misc_feature 105..106,236,238: n=a, g, c or t
gcaaaacaagggcagcgggcccggcgcggtggctcacgcctgtaatctcagcactttgggaagccaaggcgggcgaatcacttgaggtcaggagttcgagaacannctggcccacagggtgaaactctttctctactaaaaatacaaaaattagcggggcttggttgcgggcacctgtaatcccagttactcgggaggctgaggcaggagaatcgcttgaacccgggaagcggagnmnvtagtgagccgagatcgcgccactgcactccagcctgggcgacagggcgagactcccgtttcgaaaaaacaaacaaaaaaaaaaaaaaaa

SEQ ID NO: 7891 - DNA, 395 bp, Homo sapiens
  misc_feature 120,222: n=a, g, c or t
tatgagaataaagaagtagaagcgatcttaaagttaaatggggaatagttatataaacttgtgatttatttttctctgtctaaaaaaagtacatatttctttgttttttgcacagtaaanatttagarrcagtgacaactgagtagcagtgaatattcttagtgccctgagtatggcctctaaatactgtttgccactaacaggaatagtgtctttgcagangtcatttattccagagctgagcaggaatgcaagatatcttcttgtgtcagaaagcaggaaagctatgaaaggccgctggagacatatcaaaggttagaaggtacaacttgaagggactctcactggccgaagatgagactattggaacaaccaaaagaatgaaagcaatgaat

SEQ ID NO: 7892 - DNA, 501 bp, Homo sapiens
cattgtattttctaattgtttgctggactatatggaaattgatttttggcatgctgatatatccagcaaaaaactttactgaactctaatgttttgtttctgagaggtttctgatggtctgtttcttgcaggatgtctgaatcttccaagtaaaaatgagtagactcctattttccttagaccacgatttatcacattttaatgtgcacacaaattacctggggagtattgttacagtgtagattctgattcagcaggtttagggtggagcctcagattctgtgtttcctacaagctcagctagtattgcgamscccagaacacactttgagtagtgaggggctagccaattccttgcatgtggattcaacataaaatacatgttcctcttagattttatgtaatagatgactgttgctaatactcatgaaacaagaacatctgtagtaaagtcaggcaagactccagggaagattgtgaatgtcagagttggaagagctt

SEQ ID NO: 7893 - DNA, 329 bp, Homo sapiens
gtttgatcggaacagttacacattcctttaaatagtgcctacacctgcttttgcactgcagtttcagagttgaatacttgtagttgtgatgttgattgtatgacctacaaagcctaaaatatttgtgtatttgatgctttaaactttrgtgacccccagtctattgccttcctactcaaaagtatggtctctggaccagcagtcttggcatcacacatggtataactaaatatgcagaatcataggcttctckckgcactcacaaatacaggcacattgatgctcaaagagaatccaaggaatgtattaggaatatatggccgtacgtv

SEQ ID NO: 7894 - DNA, 419 bp, Homo sapiens
  misc_feature 258..259: n=a, g, c or t
cattatggtgctgttctctcaaatggttacaaacttgcaaagagtaaagaagacttttcattcttagtcctctgagccattaactgtaacataactgtaaagttatcttgagatgtggtacaatttcaatctgaaagagaaagcaaaaatattacagatatgcttgaaccaatcattacttaccaaaaataaatataggaaatgagttattagggaatgtactgtaatctctgagaggaaaaaaaaactattwvmawnnvacagtgtcaacttctatgtccagtagtgacctaaggaaaagagttggaggattctgaccatatctctttaactgtgatgagtgcacagaccaagactgatcaattgtgtgagtgtgatcccatcactgatcattaatatgaaactctcttacattttaa

SEQ ID NO: 7895 - DNA, 170 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtccaaaaaaaaaaaaaaaa

SEQ ID NO: 7896 - DNA, 170 bp, Homo sapiens; identical to SEQ ID NO: 7895

SEQ ID NO: 7897 - DNA, 437 bp, Homo sapiens
  misc_feature 257: n=a, g, c or t
aagaaccatggcactcgggagtccctggaagcactcctgcagagggctgtggccactgccccaaagcagaggtgctgtggctcatgggcgccaagtccaagtggctggcaggggatgtgcctgcagcaaggagcatcctggccctggccttccaggcaaccccaacagtgaggagatctggctggcagccgtgaagctggagtccgagaatgatgagtacgagcgggcccggagctgctggccaaggcgcggasagntgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagc

SEQ ID NO: 7898 - DNA, 475 bp, Homo sapiens
taaatacagtatacttctccaaaaatagttttctttcgtttatgtcagtgatgttttatagttctcagtgagcagggctataccatcttttcttaaatttcagtgtgatttactcttcaagtgagaaatcacaaggcttcttggaccaatctctaaatctgagactttggccagaattaagactgtataggctgggtacggtggctcacgcctttttaaacccagcactttgggaggccagagcaggaggatcaattgagtcaggagttcaagaccagcctggccctgtctctactaaaaatacaaaaattagccgggcatggtggcgggcacctgtaatcccagctacttgggaggctgaggcacgagaattgcctgaacccaggaggcagaggctgcagtgagcggagatcacgccattgcactccagcctgggcaacagagcaagactccatctcaaaaaaaaaaaaatgtw

SEQ ID NO: 7899 - DNA, 314 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaakkagcggggtgtggtggcacgtgcctgtaatctcagykgctccggagsctgaggcaggagaatggcttgaacctgggaggcggagattgcaagatcgcaccactgcaccccagcctgggcaacaaagtgagactccgtcgcaaaaaaaaaaaaaaaa

SEQ ID NO: 7900 - DNA, 476 bp, Homo sapiens
ctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatcatgtggatttgtcccaagattatgctagatgcaccaagcatggcccaaattggttcttttttaaatcccatgggggaagtgcaggctccttcctgtggtgcctctttatagvctcaccaccatgctaacactgagcatggtgaggaggaggaagctttggctagctaaacatgtttaataaggccataaaaactgagaaagaaaaacattcaacttttagctgaagctcctttgatacaaaagtttcattctgtcagaataagccatagtacagactcagagatagaggcagtttctagaga

SEQ ID NO: 7901 - DNA, 440 bp, Homo sapiens
tcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggctggacgaagaggcctaggacctgaagagactcc

SEQ ID NO: 7902 - DNA, 357 bp, Homo sapiens
catataatatttttggactacagctgactacgggtaactgaaactgtggaacatgaacccaccgataatggaaggctactgtattttaatatttgccaacactgagcatttgavatgagctactttggcaggaaagattataaatvattgagtagatatcaatggatgagcatcatagtgctctatcagccctttgggagaccatgagtaacctatcatttggttttagctctttgtcttgattcactttatcaaaatgggactatagatgacttgtggtaggttctagagtgcaagaaatgagaaaataagtgaatgagctttgcccagccacagattcttaacagtgctgaggga

SEQ ID NO: 7903 - DNA, 334 bp, Homo sapiens
cctgtattgtgccagttttcaaagggaatgcttccagtttttgcccattcagtatgatattagctgtgggtttgtcataaatagctcttattagtttgagatacgtcccatcaatacctaatttattgagagttttttagcatgaagggctgttgaattttgtcagaggccttttctgcatctattgagataatcatgtggtttttgtctttggttctgtttatatgctggattacatttattgatttgcgtatgttgaaccagccttccatcccagggatgaagcccacttgatcatggtggataagctttttgatgtgctgctggatcccgt

SEQ ID NO: 7904 - DNA, 164 bp, Homo sapiens
caaaaaattagccgggcgcggtggcgggtgcctgwagtcccagctactcgggaggctgaggcaggagaatggcgtgaacctgggaggcggasdtgcagtgagccaagattgtgccactgcaatccggcctgggctaaagagcgggactccgtcccaaaaaaaar

SEQ ID NO: 7905 - DNA, 429 bp, Homo sapiens
cattgataggtgttggcaaaggagcatggagcataaggctgtagtattcacagtaagcttttcaaaaacttaagtttcaaatgcaaatctaaaggatgtctctgctcttcctaagccttctggtagatagtactagaaattcctaagtgaatgctttataggatattttattattgattattgataacaattgtggcaaaatatggtgttgttgatagaagtatcgaagaagtccatagaactagcataatttcttctgaccaaccacctcactgcagtattattgtgttggcttggatgcctccagtttcagtgattaggactcacaggctgcaacaaagacaggccattccacagtgacacctctgccagggctttctctctaatccaaaatgcaactgggcaactacctctggacatgggtagagt

SEQ ID NO: 7906 - DNA, 170 bp, Homo sapiens; identical to SEQ ID NO: 7895

SEQ ID NO: 7907 - DNA, 170 bp, Homo sapiens; identical to SEQ ID NO: 7895

SEQ ID NO: 7908 - DNA, 431 bp, Homo sapiens
  misc_feature 254: n=a, g, c or t
gtactatatataaaacctttttaccttttttatatataaaacctatgattcataggttttatgtcctattaaaatatgagctaacaataattggtaaaattagttggaaaattatcagttttaaaagaaaattaaattgaaggttatgttgttagtaatttaaagatctcctgtgttttgatgtaaaaacactattttttagcagtcaaagggcttaagtagtatgactttttgtgtaacttggattgtgcaanhgcttttaaaaatgaaactatttctcatttataatgagrtwaatggactcagtgtatcggagagcagactgaacacacacttctacctcctttctccccgcaaaccctacagaagtgacaaaaaagacacatatcacaggggagtgaaacccagcagtactcagactgtgaagcaga

SEQ ID NO: 7909 - DNA, 445 bp, Homo sapiens
gacgccgagggsgctgcgacgcgccgagaggcgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtaccagttcggatggcctctctggcccctgccgcgctcctgcctcctgccccagcaggtaccacggtcctcggsccatctccaaccaaggagcagctgcggttccccgaggtgcccgggctggccggtggtatcgtggacgc

SEQ ID NO: 7910 - DNA, 51 bp, Homo sapiens
atgttasctgtsgccactgtsgatttttcgcaagamcattwataaactaam

SEQ ID NO: 7911 - DNA, 479 bp, Homo sapiens
tccagttgtcatattaatgctatataactgagattcttgaagagattatccattcttcctcattacaagataaacattttttgtttctgattatttacactgttaataattatttattatggatctttgtttacaatacatactgaagtgccagcttttcatcagacccatctgttattcacttagttatatactcattatataatacactctgttataaactcagttatatacggagttacatgttcagcacatactgattgtctaccatgtgccaggcactgatttaggtactgaggatggaataggggacacttactttgcttctgttttgtttgtgcctcactttgcaggagttccactatatagcagaagatctttatcgaacaaagaacacattgcaaagcagaattaaagatcgagacgaagaaattcaaaaactcaggaatcaggtatgaatcactattcacaacttgtga

SEQ ID NO: 7912 - DNA, 84 bp, Homo sapiens
ccggagggcggasttccagtgagccgagatctgcgctccaacctggggacagagcgagactccctctcaaaaaaaaaaaaaaaa

SEQ ID NO: 7913 - DNA, 413 bp, Homo sapiens
acaagccacgggctggaggctagagcctgtggcaccatgatttgcctccgatggaggtggctgaattaggcttcccagagactgcagtgtcccaatccaggatctgtctatgtgctgtattgtgtggccactgggactttgcagacatgatggtgataaggagcctgagcctcatcaggttagagggtgtggaagggcgtgacccagtgggaggtgggaatctcaccaataaaaggccctcgtgtgccccttccccacaagacctgagcgcccagtggaagcagctggaggacagaggagcttccagcagaagagtggacatggctgcactcttccaagaagcaagcagctgtcccgtctgctcagactatctggaaaaaccaatgtccctggagtgtggatgcgccgtctgc

SEQ ID NO: 7914 - DNA, 52 bp, Homo sapiens
caaaaaattagccgggcgcggtggcgggtrcctrtagtcccagctactcggg

SEQ ID NO: 7915 - DNA, 123 bp, Homo sapiens
catcagaaggtaaattggaaagaggccgggcatggtggctcacacctgtaatcccagctctttgggaggccaagacgggtggatcacttgasgtcaggagtttgagaccagcctggccaacak

SEQ ID NO: 7916 - DNA, 61 bp, Homo sapiens
ccggagggcggasttccagtgagccgagatctgcgctccaacctggggacagagcgagack

SEQ ID NO: 7917 - DNA, 321 bp, Homo sapiens
tttacaaaaagtttctgccgaagatggcagggtgtgatggctcacgcctgtaatcccagcactttggggaggccgaggcaggtggatcatgtgaggtccacgagtttgagaccagcctgaccaacatggcaaaaccccatccctactaaaaatacaaaagttagccaggtgtgtggcgcacgcctgtatctcaagtactcgggggactgaggcaggagaatcgcttgaagctgggaggcagaggttgcagtgggccaagatgccccgcagcactacagcctgggcaacagagcgagactccatctcaaaaaaaaaaaaaaa

SEQ ID NO: 7918 - DNA, 65 bp, Homo sapiens
ttttaatgactaratactgtctttgattttttgttccaggtctgtcratattaacttcttataab

SEQ ID NO: 7919 - DNA, 271 bp, Homo sapiens
  misc_feature 254: n=a, g, c or t
gataagtatctccaatttagtatatccacattgagggacccaccatggataagtaggcatttttaggtatgttaagatatgttgtatttcctctgaggaattctttgtttataaatgaattacatttatttttttctggcccattaaatgttaatatacaagtagctgcagtggttttctatctggtatacatttgtattcattaatgttaccttttctggaaacccttctagataatgaaattttcaccaganagtgttgcagcgtttat

SEQ ID NO: 7920 - DNA, 171 bp, Homo sapiens
ctttccgctcggctgttttcctgcgcaggagccgcaggccgtagsagcccatggcgcccagccggaatggcatggtcttgaagccccacttccacaaggactggcagcggcgcgtggccacgtggttcaaccagccggcccgtaagatccgcagcctggaggagctcaggg

SEQ ID NO: 7921 - DNA, 356 bp, Homo sapiens
  misc_feature 264: n=a, g, c or t
aacgaaagactgcgactccccggactatcaggccgggagagtccacttccagctcacctcggagctccgggagcctttcagcacctgcttggtgagcgcgattacgtcagtaccacaggtggtcaccttctccgtgagaagccccttcacggactgaccgaaccgcgcttgaractctggcgttccagtcgccatcatttcagttagcgaacggttgcgcactgacgatggtgagtcgccggggccaaaagwcaagcaaagcgnaaggaaaagaggcgtctcttcctccatgggaaaaggaagggacgcatgcgcctgatggaggttgacctttgctcactaaactcatgaactat

SEQ ID NO: 7922 - DNA, 299 bp, Homo sapiens
taccttgccgggcgcggtggctcacacctgtaatcccagcacttwgtgaggctgaggcgggcagatcacgaggtcaggagatcgagactatcctggccaacacggtgaagccccctctctactaaaaatataaaaaattagccgtgcatggwtgcrggcgcctgtggtcccagctactcaggaggctgaggcgggagaatgatgtgaacccgggaggcggmccttrccgtragchaggatcacgtcactgcactccagcctgggtgacagagcaagactctgtctcaaaaaaaaaaaaa

SEQ ID NO: 7923 - DNA, 354 bp, Homo sapiens
tgtaatgcttgcragtktatkctttttgcttaggattgckttggctatttaggctcttatgggttccatatgartttkataattgtgttktctaattctgtgaaatataacattggtaatttgataggvagttgcattgactttctagattgctttgggcagtatagtcattttvrtgacattgattcttcccgcccatgagcaagggatgtttttccatctgtttgtgtcatctacagtttcattgttttataattctcctttgtatttcaccatcttaaatgtattcctagatagtttatgtttttgtatggctattgtaaatgggattttcaccatcttaaatgkattcct

SEQ ID NO: 7924 - DNA, 455 bp, Homo sapiens
  misc_feature 266: n=a, g, c or t
atcttaattgttcttcctactcaggcttataacatttccatattttcccaaacaatacaaacacaggcaaatccatcaaccattgtgactactgagcactctctcctttcccatcctttaatttctcaccagcccttcctccctcacagctggttcccagcatctgtgcattgtgggcctccatggtttagttgcccctgggccaagcctctgacatcttcccagtctttaacttccttgacctctttgcagcatggaaccccatngacaaggccttcttcgaaccgtctattctttgctgccatcctactatatcctcttgatattcctaccagggttcagccttgggtctgttttggtttttktcctctamcttcttctcatggtgatctcatgcattcctatagctgcaattttcatctctgtccagatgcctcccagatcgagatctctaa

SEQ ID NO: 7925 - DNA, 425 bp, Homo sapiens
abtattgttctttttttgcgatgggtctctgttacctaagctggtctgagctcctgagctcaagcgatcctcctgcctcggccacccaaagtgttgggattacaggagtgagccaccacgtctggcctctcgtcgtttttattttttaatttttgagtgggggctcgctccgtcgcccaggctgtgatgcagccgcgcgatcacgacctactgcatcctggacctcctgggctcaagcgaatctccggcttcagctcccaagtagctggaactacactcccgcgccaccacgtcccgctaaattaaaaaaaaaattgttgtagagatgggggtctcgttgtgttgccctgacaggtctcgaactcttgggctcaagcgatcctcccgtctcggtgtcccaaagtgttgggattacaggcgtgaca

SEQ ID NO: 7926 - DNA, 83 bp, Homo sapiens
ccggaggcggasttccagtgagccgagatctgcgctccaacctggggacagagcgagactccctctcaaaaaaaaaaaaaaaa

SEQ ID NO: 7927 - DNA, 313 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggagctgaggcaggagaatggcttgaacctgggaggcggagattgcaagatcgcaccactgcaccccagcctgggcaacaaagtgagactccgtcgcaaaaaaaaaaaaaaaa

SEQ ID NO: 7928 - DNA, 314 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggaggctgaggcaggagaatggcttgaacctgggaggcggagattgcaagatcgcaccactgcaccccagcctgggcaacaaagtgagactccgtcgcaaaaaaaaaaaaaaaa

SEQ ID NO: 7929 - DNA, 313 bp, Homo sapiens; identical to SEQ ID NO: 7927

SEQ ID NO: 7930 - DNA, 328 bp, Homo sapiens
  misc_feature 108: n=a, g, c or t
gcaaaacaagggcagcgggcccggcgcggtggctcacgcctataatctcagcactttgggaagccaaggcgggcgaatcacttgaggtcaggagttcgagaacagbanggcccacagggtgaaactctttctctactaaaaatacaaaaattagcggggcttggttgcgggcacctgtaatcccagttactcgggaggctgaggcaggagaatcgcttgaacccgggaagcggaggttgtagtgagccgagatcgcgccactgcactccagcctgggcgacagggcgagactcccgtttcgaaaaaacaaacaaaaaaaaaaaaaaaa

SEQ ID NO: 7931 - DNA, 483 bp, Homo sapiens
aatgtttgctttgttttgttttttctattgcattgtcaggctgaaaattctccaaacttttatgctctgttttacttttaaaactgaatgcctttaacagcacccaagtcacctcttgaatgctttgctgcttagaaatttcttctgccagataccctaaattacctctctcaagttcaaggttccacagatctctagggcaggggcaaaatgccaccagtctttttgctaaaacatgagaggagtcatcttcgctccagttcccaacaagttcctcatcttcatgtgagaccatcttagcctggatttcattgtccatatcattatcagcattttgggcaaagcattcaacaagtctctggggagttccaaactctcccacattttcctgtcttctcctgagcccttcaaactgttccaacttctgcctgttacccagttccaaagtgacttctacatttttgggtatctcttcagcagtgc

SEQ ID NO: 7932 - DNA, 125 bp, Homo sapiens
aaagagaaatgagactaraaggtcgkkcccccaactgttaaraatgtgtgcagakatcaacgtctcttckacatactggtasaggkgcgactgsagggycccctgwtataacaagagtaaccaaa

SEQ ID NO: 7933 - DNA, 314 bp, Homo sapiens; identical to SEQ ID NO: 7928

SEQ ID NO: 7934 - DNA, 294 bp, Homo sapiens
catcagaaggtaaattggaaagargccgggcatggtggctcacacctgtaatcccagctctwtgggaggccaagacgggtggatcacttgagggtcaggagtttgagaccagcctggscaasatggtgaaacacccgtctctactaaaaakacaaaaatdagcggggtgtggtggcacgtgcctgtaatctcagctgctccggaggctgaggcagggagaatggcttgaacctgggaggcggagattgcaagatcgcaccactgcaccccagcctgggcaacaaagtgagactc

SEQ ID NO: 7935 - DNA, 408 bp, Homo sapiens
  misc_feature 116..117: n=a, g, c or t
ggggcggcggaagttcgacggcgccgggcgagtggctgttgagcggcgccgcgggagttccgcaggtttctcgtgttcgcagcggascggaggcagctgaacccggcmgtgggatnnvggataggaggaggaggggacccataggacgcgttaacatggacctggaaaacaaagtgaagaagatgggcttaggtcacgagcaaggatttggagcsvsttgtttaaaatgcaaagaaaaatgtgaaggatttcgaactgcacttctggagaaaaatatgtcgtaactgcaagtgtggccaagaaagagcatgatgtcctctttgagcaatgaagaggatcggaaaagtggggraaactttttgaagacaccaaggtataccactctgattgcaaactaaagtcagatgg

SEQ ID NO: 7936 - DNA, 279 bp, Homo sapiens
  misc_feature 279: n=a, g, c or t
tatataaaaagggggtttattagggagaattagctcacaagattacacagtgaagtcccatgataggccacctgcaagctggggaaagggaaggtggtagtggctcagtccaagttcaaaagcctcaaaaccatggaagccaacagcgcascttcagtcggtagccgaagbtgagagccccaggcaagctgctggtgcaggtttcagagtccaaaggccgaagaatctggagtctgatgtccaaaggcaggaattaaggaggcaagcatctgacgcagn

SEQ ID NO: 7937 - DNA, 65 bp, Homo sapiens
caaaaaattagccgsgcgcgstsrcrrgtgcctgtastcccagctactcgggaggctgaggcags

SEQ ID NO: 7938 - DNA, 380 bp, Homo sapiens
cagcaaaacctttgatggatttttcaaaaagtattgaaggcatttagcgttasttctgtttagctcagctttgggccatggcggtggagtgctagctaggaaaacccatagaatgctaacttgctgctgagatgccggggaaggactcaacgtggatgccaccttgggaatttttctttctgtagttttcactcttctaaacaacaacaaaaaatgtctagtgaattaaaataaaatatgaaagtaaagctttcaaaaagtaaagtaaagggtgtgtttggatttgcaagtgggagcagattgggctgcaaggccaagagctgtgtgatagccctgagtttgaacattccctgcacaggtttgggggtctgatgctggag

SEQ ID NO: 7939 - DNA, 369 bp, Homo sapiens
actttcctcttggaagtggcgactgctgcggggctgagcggtgctcgcacgcgtctcgggagccaggttggcggcgcgatgaggcgcasaaggccgatgtggagcggtacgtcgcctcggtgctgggtctcaccccgtcgcctcgacagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttga

SEQ ID NO: 7940 - DNA, 263 bp, Homo sapiens
ctcctgccccagcctcccaagtagctgggattacaggcatgcgccaccacgcatggctaatttttgtatttttttagtagagacggggtttcaccatgttggccaggctggccatgaactcctggcctcaagtgatccaaacgcctgggcctcccaaagtgctgggattacaggcgtgagccaccgggcctggccgaacaatgtcttttgtatcccttccctcacactaacaatcctctggagatcatggcctgctagactgs

SEQ ID NO: 7941 - DNA, 320 bp, Homo sapiens
acatctaatcaagggctggtgaaacaggctggcagcttgggggcattcaagcagcacgcctgccagtcctggggaagcaggaaatccaggcagaaagccccctgacaacaggcttcctgcagtttccaggtgcttaggaacaaaagcatgscttgaggccggcgcggtggctcatgcctgtaatccaggcaccttgggargcccaggcggatggatcacctgargtcaggagtttgagaccagcctggccagcatggtgaaamcctgtgtctactaaaaatataaaaattggctsggcgtggtggcggacgcctgtgatc

SEQ ID NO: 7942 - DNA, 315 bp, Homo sapiens
aaaattaaattaaattgactgggcgcggtggctcgcgcctgtggtcccagcactttggggggccgaggtgggtggatcacgaggtcgggagttcgggaccggccgggccagcatggtgaggccccgtctctactaaagatacaaaaaaaatttggccaggcgcggtggcgggcgcctgtggtcccagatactcgggaggctgaggcgggtgaatcgcttgggcgtgggaggcggagtttgcggtgagccgagatagcgccactgcactctagcctgggcaacagagtgagactctgtctcaaagaaaaaaaaaar

SEQ ID NO: 7943 - DNA, 458 bp, Homo sapiens
cacttctgcttttggtgtcatatctaagaaaccattgcctaatccaaggtgacaaagatttacccctaagttctcctctaagagttttatagttttagctcttacttttgggttctgtggtcagttttttagttaatttttgtgtatgttaatgagctgggtgttcaacatcattcttttacatgtggctttccagttatcccaccaccgtttgttgaaaagactattatttctccattgaattgtctcaacacctttgttgaaaatcagttgaccatagacacaggttatttatgaactcttaattctgtgccactgattcgtatgtctatcattttgccagtaccacactgtcttgattactgttgctttgtagaaagttttgaagtcaagaagtgtatgttgccaagtatggtggtacatgcccataggcacagctactcaagagactgagacag

SEQ ID NO: 7944 - DNA, 309 bp, Homo sapiens
gcaaaacaagggcagcgggcccggcgcggtggctcacgcctgtaatctcagcactttgggaasccaaggcgggcgaatcacttgaggtcaggagttcgagaacagcctggcccacagggtgaaactctttctctactaraaatacaaaaattagcggggcttggttgmgggcacctgtaatcccagttactcgggaggctgargcaggagaatcgcttgaacccgggaagcggaggttgtagtgagccgagatcgcgccactgcactccagcctgggcgacagggcgagactcccgtttcgaaaaaaca

SEQ ID NO: 7945 - DNA, 238 bp, Homo sapiens
gaatacaggaaaacagtttttctaaaaaagcaataaggccatgttttttactttagctttaaaaactttttttattttatttttcagtagctacaaggttgtctttaaatattctttatagtaactaacaccctgtaggcatgaccagtaatagaaataatttcctcttttccttggctccactgatgcccactgcctcttctttgtgatcagttaaatgtacactttagatgattct

SEQ ID NO: 7946 - DNA, 336 bp, Homo sapiens
aaaattaaattaaattgactgggcgcggtggctcgcgcctgtggtcccagcactttggggggccgaggtgggtggatcacgaggtcgggagttcgggaccggccgggccagcatggtgaggccccgtctctactaaagatacaaaaaaaatttggccaggcgcggtggcgggcgcctgtggtcccagatactcgggaggctgaggcgggtgaatcgcttgggcgtgggaggcggagtttgcggtgagccgagatagcgccactgcactctagcctgggcaacagagtgagactctgtctcaaagaaaaaaaaaavgaaagcaaaaaaaaaaaaaaa

SEQ ID NO: 7947 - DNA, 166 bp, Homo sapiens
  misc_feature 93: n=a, g, c or t
aaaaattggccggacgcggtggtgctcrcctgtggtcccagctgctcgggaggctgaggcgggagaattgcttgagcctgggagatggaggtngcggtgagccaagatcgcgccactgcactccaggtgggcaacagagcgagacttcgactcaaaaaaaaaaaak

SEQ ID NO: 7948 - DNA, 140 bp, Homo sapiens
attatgkcattgaaacccaacacgtcctgtaarggaccattatgatcccctctctarcgatgargaaactccaggttagagaagstgragaaattgctcaagrtcatactakwacattaagtggcaaagccagacttagr

SEQ ID NO: 7949 - DNA, 316 bp, Homo sapiens
  misc_feature 233,235: n=a, g, c or t
gcaaaacaagggcagcgggcccggcgcggtggctcacgcctgtaatctcagcactttgggaagccaaggcgggcgaatcacttgaggtcaggagttcgagaacagcctggcccacagggtgaaactctttctctactaaaaatacaaaaattagcggggcttggttgcgggcacctgtaatcccagttactcgggaggctgaggcaggagaatcgcttgaacccgggaagcgnmngttgtagtgagccgagatcvcgccactgcactccagcctgggcgacagggcgagactcccgtttcgaaaaaacaaacaaaw

SEQ ID NO: 7950 - DNA, 412 bp, Homo sapiens
ctgatgtcttggtggagttcctcttggatgtaagcatttatacacagtgaccctgcatggagctgcctctcctcaaatatagggagagatagaaccccaaagaaaagggacaagctggagaacctggcctcatctgtgacaggtttttcaggattcacaaaaaactaaggagcacctatattattgcactgtctactctactgggaaagtgatctttaagccaccctagaaactgttgggggccatgtagtagtaatatgctaattctgttaccagttatacatagacgtctattgaaatctccttggttttgctccactgctactgaagaggagctggggaatgtggggagtgagggggctaaccagccacctgaagagagaggagggatgggagtaccaatcagccaggt

SEQ ID NO: 7951 - DNA, 431 bp, Homo sapiens
  misc_feature 321..322,324: n=a, g, c or t
ttaaaatgttcatactacccaaagctagctctagacacaatgcaatccctatcaaaataccaatgacattcttcaaagaaatagawaaaacaatactaaaatttgtatggaaccacaaaagaccccaaataaccaaagcaatcctgaataaaaagamwaaaaactggaggcatcacactgcctggcttcaaaatatactacaaggctatagtaaccaaagcagcatggtactgccataaaaacagacacatagaccagtggamcagaatagagaacccagaaataaatggatcggctataaatgcatggaatyattgahtnnhnggagacaacgtctcactctgtcatccagcctggagtgcagtggtgtgatcttggctcactgcaacctccgcctctcagactcaagctgtcctcccgccttggcctcc

SEQ ID NO: 7952 - DNA, 83 bp, Homo sapiens
ccggagggcggagttccagtgagccgagatctgcgctccaacctggggacagagcgagactccctctcaaaaaaaaaaaaaaa

SEQ ID NO: 7953 - DNA, 280 bp, Homo sapiens
atttttccattgaagaaattggtatgaaaggatatatgacaaaaaggaccaagaaaaaatgagtaactggaagtcagcaaagtgaattaaaaaaaaaacttttttaaaaagacaagaaggctatttgcaaagagtcttgtwattatagccargcctagttacatatgtgactttgatttattaatttgttttagttgtgacgatccagaagtggaggattatggaaacaaatggagcatgagtgctatgcttaggtacctgaaacaagaaggcagagata

SEQ ID NO: 7954 - DNA, 171 bp, Homo sapiens
caaaaaattagccgggcgcggtggcgggtgcctgtagtcccagctactcgggaggctgaggcaggagaatggcgtgaacctgggaggcggasttgcagtgascmaagatkgtgccactgcaatccggcctgggctaaagagcgggactccgtcccaaaaaaaaaaaaaaaa

SEQ ID NO: 7955 - DNA, 459 bp, Homo sapiens
  misc_feature 123: n=a, g, c or t
agagaaggctttaaaattttttttttaatttgcatttgctggggggatcgctttcacctcttttagattcttctttttggtatttatgtccacatttyccaaataacatgcttaagtgtctcnwggatttttccggagtcagcatgagctgctgacgcccgmtgcagaagatgagggcttagagccacacawttctggtctgtgccctgcacacatcacctttmvacctcctgttgcttcctgttttctcataacggagttgcatcattgtttagggttaaatcatcaggacccacacggatcacaagtgaaccacgaaagaaaccgtcatcattttacaatttttgcacaaactctctgttttccacagaattacatttcctgtcagatgctgttttcactgcgttaatgatacgctgttttcattgtattaatttctaattccatcgcaatctctgc

SEQ ID NO: 7956 - DNA, 391 bp, Homo sapiens
  misc_feature 306,313,315: n=a, g, c or t
tctccctgtggtcgtcttccacgttgtggaaggtttgttgtttcgcttcttgcaataaatcttgctactgcttgccgtttgggttcaggctgcttttatgagctgtaacactcactgcaaaggtgtgcagcttcactgctgaagccgttgagaccacgaatccaccgggtggaacgaacaactccagacgtgccaccttaagagttgtaacactcacctcgaacgtctgcagcttcactcctgaagccagcaagaccacgaacccaccagaaggaagaaactccgaacatatcctaaagtcagawnghamaananwacgtatacgctgcctttaagaactgttaacactcaccgtgaggctccgcggcttcattcttgaagtcagtgggac

SEQ ID NO: 7957 - DNA, 384 bp, Homo sapiens
ttcatgtagttcctcataagcaggggccagaatatctcagccacctgcagtgacattgctggacccctgaaaaccattccakaggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgckgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggckcagcag

SEQ ID NO: 7958 - DNA, 171 bp, Homo sapiens
caaaaaattagccgggcgcggtggcgggtgcctgtagtcccagctactcgggaggctgaggcaggagaatggcgtraacctgggaggcggacttvcagtgagccaagattgtrccactgcaatccggcctgggctaaagagcgggactccgtcccaaaaaaaaaaaaaaaa

SEQ ID NO: 7959 - DNA, 397 bp, Homo sapiens
ctacctacctgacatatttaaaataaaagcacttctcggccgggcgcggtgtctcacgcctgtaatcccagcataggccaaggcgggcagatcacgaggtcgggagttcaagaccagcctggccagcatggtgaggccccgtctctgctaaaaatgcaaaaattagctgggcgtggtggcgcttgcctgkaatcccagctacttgggaggctgaggcaggagaatcgcttgaaccagggagtcggaggttgcggtgagccgagatcctgcctgcactccagcatggtgacagagtgagactctgtctcaaaataaataaatagataaaagtacttttccacctaagtactwatcaaaagcagatgcatctgttttgacaggggggttctagaagcaa

SEQ ID NO: 7960 - DNA, 377 bp, Homo sapiens
agatcgcgcgagacagcggaaggagcaagagtgggaggcgcgcgcggaggccgcgacggacgcaagatggcgacggcgaccatagctctcctctcatggggaggttgaatggagcagctgaacttggctgacagtggcctggtggggaaggaagccagaagatgcagaagggcctcccctcccatgggcatgccttctgcctggtggctgcagaatgaggccggctgcctctttgcagcaaggcaggtcaatggccagcaaggaggggggtccgagccggcggcggcggcggcagtggtggcagcgggagacaaatggaaacctccacagggcacagactccatcaagatggagaacgggcagagcacagccgccaa

SEQ ID NO: 7961 - DNA, 95 bp, Homo sapiens
ckacctasckgacatatttaaaataaaakcacttctcggccgggcgcggkgtctcacgcctgtaatcccagcataggscaaggcgggcagatcas

SEQ ID NO: 7962 - DNA, 429 bp, Homo sapiens
cactgatcattagagaaatgcaaatcaaaaccatagtgagataccatctcacagcagtcagaatggctattattaaaagtcaaaaaataacaaatgctgaggagattgtggagaaaatggaatgcttatacactgttagtgggagtgtaaattagttcaaccattgtggaaagcagtgtggcaattcctcaaagagctaaaaacagaattaccgccggcatgctgactcacgcctataatcccagcactttgagaggccaaggctggtggatcacctgaggtcgggagttcaaaaccagcctggtcaacatggtgaaacctatctctactaaaaatacaaaaaattagctgggcttggtggtgggcacctgtaatcccagctactcaggaggttgaggcaggagaatcgcttgaactcaggaggtggag

SEQ ID NO: 7963 - DNA, 334 bp, Homo sapiens
ataggtagttccccgtttccaggaccccagacggcctgctgggacagtgtatatgagtccggaatgggctggaccagggtcaggctagcccagacttcaggaggaagcactcaattgaacaagtgcaggaaccagctggctgcctcagcactgacagaagcaaattccatttgcttggacccactgcattccatcccttgtggaagagagcatgtaagcaagtgagtgcaggaactggctggctgctttggtgctggcaggagcaaacaccatgaaggccccatggcagagtccaggacaggaccttcaggcctctgaaaaaaaaaaaaaaaaa

SEQ ID NO: 7964 - DNA, 293 bp, Homo sapiens
tttggttttgtgtgtttttctactgtatgacacttctgacccttaagggatgttgtacaggaactgtataattttctcctcaacttcatatggtctacttgtataattatatttcttatgtaattctgaaaaactttagacatgccaactctttttgtgtctgaagagaatagtacagtattataaattcctctgtatccgttattcagcattaacagttagcataactcataaccagtctatttcatctgtaccattttgtactcttaaatataattggttacctagttctk

SEQ ID NO: 7965 - DNA, 442 bp, Homo sapiens
cacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaagggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctgggccacttggtagtgtccc

SEQ ID NO: 7966 - DNA, 152 bp, Homo sapiens
cttgctctttcgcmcaggctggagtgcagtggcatgatctcagctcactgcagcgtctgccttccgggttcgagagattctcctgcctcagcctccagagtagctgggtctacaggcgtgtrccaycacgcctggctgattgtttgtatttt

SEQ ID NO: 7967 - DNA, 86 bp, Homo sapiens
ctttttcagcgcctgcagsttccgggaggycagctcccagccsabgacrtcggmygtcatcgtccttsctgcwttgccaccccatt

SEQ ID NO: 7968 - DNA, 330 bp, Homo sapiens
  misc_feature 253: n=a, g, c or t
taatgtatggaaattcaactaatttttggtgctgttattctattcttcaaatccactgcatatgttttttagttccagttgcattttggttgactctttgtgattttctacacagaagatcatgtcatctacaaagaaatagttttacttctttcwbtctgatttggatgagtttgatttctkktgckattkcawtgctctagctaggacagccagtattgattgaatagaaggggtgasagcarmhttgcancatgtgagatcctacaggaaaagcattccgwtttccctgactggwtatttctgctgtggtcatttcatggatggtct

SEQ ID NO: 7969 - DNA, 442 bp, Homo sapiens
  misc_feature 260,395: n=a, g, c or t
actcttaccaggaggcaggaaagctagaagcagagctagagccaacagcatgccttcctctctggggtcttggaagtaagggaccagacgaagaggagcagaagaccctctcaaaactcaggtcccactcaacaaggaagtgatccctaacacagaagacagtaggaggagctggtcttcctgattcacaggcagagataagtgattgaggatctgtcttaggggactctgggtggtgcctaggaggacctgcagagghntttctgcctctcagctcaggccagttctccagcgccctctgtggcggctgagagcaggccctctaaggaagagagctccgggcatagagagctcaggcctgcagcagagggagtgcagatgtgggggaagctgancctggagttaacaggctcagaccttaaagggggtagtctcacagcag

SEQ ID NO: 7970 - DNA, 67 bp, Homo sapiens
atctccctcaccagctgaaagtacgagtcggctcagcctggagggacccaaccagagcctggcctgr

SEQ ID NO: 7971 - DNA, 206 bp, Homo sapiens
caggtgaagaaactaaggaacagaggggttaagaagcttgcctggccacctgcagtggctcacatctgtaatcccagcaatttgggaggctgaggcgggaggatcgcttgagcccgtgaggttgaggctgcagtgagctttgattgcactactgcactctagtctggaccacagagcaagcctgtgtcccaaaaaaaaaaaaaaaa

SEQ ID NO: 7972 - DNA, 73 bp, Homo sapiens
  misc_feature 39: n=a, g, c or t
ctatctatctatctatctatctatctatttttgtccagntttcctggcttgtaattcccatagcccttgttac

SEQ ID NO: 7973 - DNA, 332 bp, Homo sapiens
  misc_feature 234: n=a, g, c or t
tcaataataggaattttaagagctcaaaagctgcttcttagtcaggtgcggtggctcatgtctataatcccagcactttgggaggccgaggtgggtggatcacttgagtgcaggagtttgagaccagcctggacaacgtggtgaaaccccatctctacaaaaaaatcgttaaaaattagctgggcatggtggtgtgcgcctgtagtcccagctacttgggaggctgagatghhnvggattgcttgggcccgggagatcaaggtgacagtgaaccttggtcatgcgactgtactccagcatgggcaatagagtgaaaccctcctcaaaaaaaa

SEQ ID NO: 7974 - DNA, 449 bp, Homo sapiens
  misc_feature 270,435: n=a, g, c or t
caggtgcctagtcttgagtgaattgttagatgtgcactgaactcgggatgttggggattggagagagagaattgccaaagtaacagcaaaaatatctcttactttgctttgtttataaataaatbagtagattggaaaaactagtgttagggaaagaaatcacatgttcagagcctaattcagtaggaagggcttttctctaccctgaaatgaaggtaatccaaaggcatccatwttctaggcttaaaagatatattthwgatatatttnatgatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgtngtgactgagagata

SEQ ID NO: 7975 - DNA, 424 bp, Homo sapiens
ctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgac

SEQ ID NO: 7976 - DNA, 270 bp, Homo sapiens
  misc_feature 135: n=a, g, c or t
acgtaatttacaataaccaccaggattcctccgcgtcgcctaggaaacgaccgggcgaaggactgccgcctcctccgagatcaaagccctgcagcagacccggaggctcctggcgaacgcagggagcggacgcgngtgcacaccatcagcgcagcttcgaggcgctcaggaagcaggtgccgtgctactcatatgggcagaagctgtccaaactggccatcctgaggatcgcctgtaactacatcctgtcccytggcgcggctggctgac

SEQ ID NO: 7977 - DNA, 172 bp, Homo sapiens
  misc_feature 95: n=a, g, c or t
caaaaaattagccgggcgcggtggcgggtgcctgtagtcccagctactcgggaggctgaggcaggagaatggcgtgaacctgggaggcggagttnkcagtgagccaagattgtgccactgcaatccggcctgggctaaagagcgggactccgtcccaaaaaaaaaaaaaaaa

SEQ ID NO: 7978 - DNA, 321 bp, Homo sapiens
cacaacccagattaattagtttaacatgctgagtgcagtggcacacacctgtaatcccagcactttgggaggccaagatgggaggatcacttgagcccaggagttcaagatcagcctgggaaatatggtaagacctggtctctacaaaaaattttaaaaattaagcatggtgtcctgtgtgtgtagtcccagctactcaggaggctcaggtgggaggatcacttgagctcagaaggcagaggctgcagtgagctgagatcatgccattgcactccagcctgggtgacagggtgagagtctgtctcaaaaaaaaaaaaaaaa

SEQ ID NO: 7979 - DNA, 170 bp, Homo sapiens; identical to SEQ ID NO: 7895

SEQ ID NO: 7980 - DNA, 73 bp, Homo sapiens
atgttagctgtggccactgtggatttttcgcaagaacattaataaactaaaaacttcaaaaaaaaaaaaaaaa

SEQ ID NO: 7981 - DNA, 72 bp, Homo sapiens
atgttagctgtggccactgtggatttttcgcaagaacattaataaactaaaaacttcaaaaaaaaaaaaaaa

SEQ ID NO: 7982 - DNA, 328 bp, Homo sapiens
  misc_feature 102: n=a, g, c or t
gcaaaacaagggcagcgggcccggcgcggtggctcacgcctgtaatctcagcactttgggaagccaaggcgggcgaatcacttgaggtcaggagttcgagancagcctggcccacagggtgaaactctttctctactaaaaatacaaaaattagcggggcttggttgcgggcacctgtaatcccagttactcgggaggctgaggcaggagaatcgcttgaacccgggaagcggaggttgtagtgagccgagatcgcgccactgcactccagcctgggcgacagggcgagactcccgtttcgaaaaaacaaacaaaaaaaaaaaaaaaa

SEQ ID NO: 7983 - DNA, 58 bp, Homo sapiens
tcgcacgagaccaccatgttggacaggatggtctcgatctcctgacctcgtgatccay

SEQ ID NO: 7984 - DNA, 422 bp, Homo sapiens
  misc_feature 277: n=a, g, c or t
atgttaactttctgtctcgttgatctgtctaatgttgacagtggggtgataaagtctcccattattaatgtgtgggagtctaaagtctctttgcaggtcactcaggacttgctttatgaatctgggtgctcccgtattgggtgcatgtatatttaggatagttagctcttcttgttgaattgatccctttactattatgtaatggccttctttgtctcttttgatctttgttggtttaaagtctgttttatcagagactaggattgcdacccctgcntttttttgttttccatttgcttggtagatcttcctccatccctttattttgagcctatgtgtgtgtctgcacatgagatgggtttcctgaatacagcacactgatgggtcttgactctttatccaatttgccagtctgtgtcttt

SEQ ID NO: 7985 - DNA, 113 bp, Homo sapiens
ttgtaaatwttgttgattattttaaagaacaaacttttgcttttrtgggtttatwtwtctcttttgttctagcctcagttttgtwatctctgttgtaatgtttatwttcttat

SEQ ID NO: 7986 - DNA, 163 bp, Homo sapiens
aaaatctaaaaattagctgggtgtggtggtgcatgcctgtgatcctggctacttcagaggctgaggtggamggatcacttgaggccaggagtttgaggctgcagtgagttatgatggcactgctgcactccagcctgcgggacagagtgagaccctgtctgaa

SEQ ID NO: 7987 - DNA, 312 bp, Homo sapiens
ctttccgctctcttgtgccagcggcggtggtgtggctgagctatggcgtggccagctcctacgtgctggcggatgcattgacaaaggcaagaaggctggagaggtcggtggatttcctcctggactccagcctgcgcaastctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagct

SEQ ID NO: 7988 - DNA, 171 bp, Homo sapiens
caaaaaattagccgggcgcggtggcgggtgcctgtagtcccagctactcgggaggctgargcaggagaatggcrtgaacctgggargcggasydrcagtgagccaagattgtrccactgcaatccggcctgggctaaagagcgggactccgtcccaaaaaaaaaaaaaaaa

SEQ ID NO: 7989 - DNA, 379 bp, Homo sapiens
aaatccactccccagtcctgcagggagagcctctgctggtctagcttcctccaagctccccctccacccaccactattcctcaggaagactcaagatctgggagatggaccaggcatttggaaagacctgaagaccatgggctctgtgtctctctctatattcttcatcacactgcttgttctgggtagacaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgc

SEQ ID NO: 7990 - DNA, 171 bp, Homo sapiens
caaaaaattagccgggcgcggtggcgggtgcctgtagtcccagctactcgggaggctgaggcaggagaatggcgtgaacctgggaggcggacttgcagtgagccaagattgtgccactgcaatccggcctgggctaaagagcgggactccgtcccaaaaaaaaaaaaaaaa

SEQ ID NO: 7991 - DNA, 519 bp, Homo sapiens
ctactgcacaagaataacvcagaaatacaatataaaggaagggtggatctactaaaatacattttgagaaaattgtctawkttbctggatgtaatgggagggracactggattgagagtcagaagatcattcctaccattatatgaagtttaagaattacmaawtttttgagctgggctgtgtggtgcatgcctcaactactcaggaggttaaggcaggagaatccctttagcccaggagttggagggcatcctgggcaacatagcaagaccctgtatcaaaaatcaggaaaaaaagaaggataaatttttaaactttactgcatgtttcttatttcatagtgattgctttagtaaacatttatgaataaagaatgaatttctgataagatatgtttgtagtgaacttcatttttatgaagccagttataagtaaatcaaatgtatgtaatacmaaattgracttwaaaaacctttcctcytattcycaaagtgttgtgtgagatgtaycyatatatct

SEQ ID NO: 7992 - DNA, 67 bp, Homo sapiens
ccaaaatggaaaggaaatgttctatgttgttcaggctaggagtatattggttcgaaatcccaaaaar

SEQ ID NO: 7993 - DNA, 185 bp, Homo sapiens
tacgaaaaaaaagttggccgggtgtggtggcgggasctgtaatcccagctattcaggaggccgaggcaggagaatcgcttgaacctgggaaggcggaggttgcagtgggccgggatcgcaccactgcactccagcctgggcaacaagagcgagactccatctcaaaaaaaaaaagaaaaaaaagk

SEQ ID NO: 7994 - DNA, 171 bp, Homo sapiens
  misc_feature 88..89: n=a, g, c or t
cagaacacagatgtgcagacatggccataaacaatcccacagatacaaacataccttagakdcacacaccasacacagacacatggannmacagaggtgttggtgttccctactctgaatccacaacttttccaatcaggagtttcctacccccctacacacactgattta

SEQ ID NO: 7995 - DNA, 436 bp, Homo sapiens
gagaccctcgcgaggtctgagagtcactggagctaccagaagcatcatggggccctggggagagccagagctcctgggtggtggcgccccgaggsggtagcttcagagvctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccatttgtctcctggacctgctgcctgactacctggctgccatagatgaggccctggcagccttgcacgtgacgctvcagttcccactgcaagagttcatcctggccatgggcttcttcctggtcctggtgatggagcagatcr

SEQ ID NO: 7996 - DNA, 171 bp, Homo sapiens; identical to SEQ ID NO: 7990

SEQ ID NO: 7997 - DNA, 176 bp, Homo sapiens
agttcgaggcgccgccgccgccgccgcagccgccggagccgcaatgcctaaaggaggaagaaagggaggccacmaaaggccgggcgaggcagtatacaagccctgaggagatcgacgcgcastgcaggctgagaagcagaaggccagggaagaagaggagcaaaaaaaaaaaaaaa

SEQ ID NO: 7998 - DNA, 429 bp, Homo sapiens
tgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgac

SEQ ID NO: 7999 - DNA, 68 bp, Homo sapiens
caaaaaattagccgggcgcggtggcgggtgcctgtagtcccagctactcgggaggctgaggcaggaga

SEQ ID NO: 8000 - DNA, 385 bp, Homo sapiens
aaaactgagtgcgctgagcggggaagcgcaaaggggcaagttacccgtcctggcgtttctggggttcgsctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcggccttcagggccggctccaaggaggcggcgtccgggaaggcggatggccacgcagccaccctggtgatgaagctgcagctgttcatccaagasgtgaaccacgccgtggaggaaacaagtcaccaagctctccagaacatgcccaaagtgs

SEQ ID NO: 8001 - DNA, 324 bp, Homo sapiens
caaaggaaacttttgtatagttatacattgcttaatgtttatacatacatccatgtagcatacttctaataatatctttaattatactagttattttaaaataacccacaaatactcaaggaattgttcagtttgtgaactgtgtgagaactacagtttttcatggtaacatttatttgtgtggtttttaaaagtgatcacaggacatctcctaaaagatamtatagttaagcagatttgcttagttaagatattaccaagagcatctagatgaataattagaataaatacttgtctcttggagacgattttgggtgtagtctt

SEQ ID NO: 8002 - DNA, 481 bp, Homo sapiens
tctccctgtggtcgtcttccacgttgtggaaggtttgttgtttcgcttcttgcaataaatcttgctactgcttgccgtttgggttcaggctgcttttatgagctgtaacactcactgcaaaggtgtgcagcttcactgctgaagccgttgagaccacgaatccaccgggtggaacgaacaactccagacgtgccaccttaagagttgtaacactcacctcgaacgtctgcagcttcactcctgaagccagcaagaccacgaacccaccagaaggaagaaactccgaacatatcctaaagtcagaaggaacaaattccgtatacgctgcctttaagaactgttaacactcaccgtgagctccgcggcttcattcttgaagtcagtgggaccaagaacccgccaattccggacccaggattacagggtcttgctctgtctcccaggctggagtacartggtgcgttcacagctcactgcagat

SEQ ID NO: 8003 - DNA, 481 bp, Homo sapiens
  misc_feature 76: n=a, g, c or t
tctccctgtggtcgtcttccacgttgtggaaggtttgttgtttcgcttcttgcaataaatcttgctactgcttgcngtttgggttcaggctgcttttatgagctgtaacactcactgcaaaggtgtgcagcttcactgctgaagccgttgagaccacgaatccaccgggtggaacgaacaactccagacgtgccaccttaagagttgtaacactcacctcgaacgtctgcagcttcactcctgaagccagcaagaccacgaacccaccagaaggaagaaactccgaacatatcctaaagtcagaaggaacaaattccgtatacgctgcctttaagaactgttaacactcaccgtgagctccgcggcttcattcttgaagtcagtgggaccaagaacccgccaattccggacccaggattacagggtcttgctctgtctcccaggctggagtacagtggtgcgttcacagctcactgcagat

SEQ ID NO: 8004 - DNA, 421 bp, Homo sapiens
actttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggtttaaaa

SEQ ID NO: 8005 - DNA, 333 bp, Homo sapiens
mycgctgkyccccgcyccccttgcccctacccagccagtagtagttccccagcgtgcgcccggggagaccgggaacatggcgctgggagcstgtagcagctgagaaggggctgaggcaccgccgcttcgctgacagccggccaccagaaatacactgtggtgaaatgcttccacctcttgctaaaatgaacactgagaaaaaatgaagaagactgacaagcaccagcgaaaagttgcagaatagaaatagccacactcctctggagtctttaattcatccacagccatcatataaaggttttggcatcatgtttgggaaaaaaaaaaaaaaaa

SEQ ID NO: 8006 - DNA, 58 bp, Homo sapiens
  misc_feature 58: n=a, g, c or t
tgtctcaaaaaaaaaaaaaaaaaaaaaaaaaaaaaaaaaaaaaaaaaaaaaaaaaaan

SEQ ID NO: 8007 - DNA, 475 bp, Homo sapiens
tatataaatttatttcttactgtggatagcagttgaaaactttgaaacccagtggctttatgccatttctttatgtgactggaatgtaagattagggttaagttacataaggtaaagcctcagttgttgtctttcattaccttgaatgacaattcggtattgcaagatgttttctaaatataaaaataattgagcacaaaatatactctctgtttactagtggctctgtgagtaataaacttgtgagatttctgcttttaatgcttctggataaagcagctcttagctttttttgctactgtgaagaaggtttcctattcaaactagagatattttcttgagaatgtattttgtaaaagctagtgatctattagattgtgtaagatggttactatacgtgaaaacagaaagccacattattaaggctattacaaactacaaagatgtcatttattctttaattgatagaaattat

SEQ ID NO: 8008 - DNA, 435 bp, Homo sapiens
  misc_feature 238,399: n=a, g, c or t
ttatatgtggctatgcatattgaaaacttgggttctttttttggagacagggttgtacaggctgttgcacaggctgtattgcggtggtgtgatcatagctcactgcaaccttgaactcctgggttcaagtgatcctcctgcctcagcctcctaccaccccctgctaatttttgttattgttgttgttgttagagaatggggtctggctatgttgcccaggttggtcttgacctaaggncctcaagtgatcctcccacctcagcctcctaaagcactgtgaatttcaggcatgagcttgagttcttattaactgtcagcctgactggctctttcctagctaggctagtcagctcggctgaggagtcaagggaggctgaggcaggaggatcacttgaggsngggagtgcgagaccagcctgggcaacatggcgagac

SEQ ID NO: 8009 - DNA, 314 bp, Homo sapiens
acttcctgcgacgcccctgcagcagcagcagcgtggtcagagcgagcttctgagcggtggttcatctgcgttgctctwaaatgggactgtttcattattttgatggctgaagaatatttcctagtgtatgtatatgagagtttcttgatctctttatctgtggatgaacagctactttgaaatatatgatacatttgtgttaaggctagtcacgctgctgtggaatagaaggtcagaattgatcactatcatctgagagtaactttgtacccatcactgattccttccgagactgcctccamttccccagcags

SEQ ID NO: 8010 - DNA, 337 bp, Homo sapiens
araataattataacagttacatcttacatatcaggtgagatgtcatagttcagttcaggtagttttcgcgtggcagtgagttagkcccctgcatcagccagaaatcagacaaaaaacaagacaagttagaagtaccagtgggtgcaggattctttatctcaggacttttaagacctttatccatagagatcccaacattgttcakttgakccaagwrtagcacctatgcatgggataaaaaatagtatcacatctttgatttykctgattagttatttgggtcttgaaatgtccagtttatcagaaagtcttgtactgtcttctggggactatgtcc

SEQ ID NO: 8011 - DNA, 310 bp, Homo sapiens
catagtttacattagggttcactctggtgttgtgcattctgtgagtttagacaaatgtgtagtggtgkgtcktcawcawtawtagkktcatgcagagtagttttakkgacctaaaaatcctttgtgctcccctccattcccactaacccctataaacacggatctttttacatttctccatagttttgccttttccaaaatgtcatatagtagaaatcatacagtatgtaacctttcatattagtttctktctcttagtaatatacttttacattttctccatgtcctttcatggcttgatagctctttt

SEQ ID NO: 8012 - DNA, 60 bp, Homo sapiens
ctcagccgcgggtgatcgtagctcggaaatggcgggatttggtgctatggagaaatttty

SEQ ID NO: 8013 - DNA, 376 bp, Homo sapiens
  misc_feature 221..226,229,326..327: n=a, g, c or t
aagcgcctgggacgaarctgagatggggctgrggcggggcctgggggttcggggaagaggctgaagaggggtctcggaagaacccttgtgagcgagtgatcgcgggcsctgactacgtrcccggcacctttccggataaaagttcaaagctctccacgarggtgtgtcttctcaaggctcaccttttggtgsggagggaaaagcaattaaacascasccmnnnnnnvmnacggcgcaagavggtggtcggcaaagaccctgggaaatggggaagagcgagggtcagggcgcggtcgtttgagaggccggcgtctcgggacgtggmnnctcgggtgaggtctgagagttgggagggcccccgtcatgggcttacttc

SEQ ID NO: 8014 - DNA, 463 bp, Homo sapiens
  misc_feature 224,363,367: n=a, g, c or t
cacatatgtcaaggttcttgcacgtggtacccagtagtctgattagactgtcttatctcttcgtgggccagatacccaccttcatcatcctctgttctcctagtatataaacaggcctgtgatgagtgaatatttcttaggaggtccttggtttcgttgggtttacttctgtcagcattagccatcatcaagtcttgttcctgcccacatatgtgctggcavgnvttcacatacacatgtgggaatcccatcttgattttttctgctcataattctggatcacagttctctacaactggatgagatacactgatatattcaagaagccatatgcggtatgaatgcagtgtacagtaaatctgnaaanvaaagggtagtgggggtggaaagtaaagctacacagtaatttggtggtcagaaacaaatggcccatgcccacaagatcaccttcttggatagatgc

SEQ ID NO: 8015 - DNA, 329 bp, Homo sapiens
  misc_feature 9: n=a, g, c or t
cscgctgknscccgccccccttgcccctacccagccagtagtagttccccagcgtgcgcccggggagaccgggaacatggcgctgggagcgctgtagcagctgagaaggggctgaggcaccgccgcttcgctgacagccggccaccagaaatacactgtggtgaaatgcttccacctcttgctaaaatgaacactgagaaaaaatgaagaagactgacaagcaccagcgaaaagttgcagaatagaaatagccacactcctctggagtctttaattcatccacagccatcatataaaggttttggcatcatgtttgggaaaaaaaaaaa

SEQ ID NO: 8016 - DNA, 60 bp, Homo sapiens
cattttagcttttatgatggctgaagtctcaaatkckttctgctgtactatacgtacttt

SEQ ID NO: 8017 - DNA, 408 bp, Homo sapiens
  misc_feature 104,375: n=a, g, c or t
tagaaatataaaaagtaatagagtaaaataaaaacaagtcctatcagtagttataataactgtagtcagtatatttaacwraaagacatgctgatttgattaancccagctatactacattgtttacaagcatcatactaaaataacagtgtgaaagtaagtttaaagccacaagagatgcaaacaaaaagaaagcatgagtggaattttaattacaagggagatggagttaaggattaaaagcagtagacaggataaaggagcacattttgtaataggcacagtttatgggaacataacaaataaatgtaaagcctcccctaaaatagttaaaattcaagaaattcaacatggtaaaaccccgcctctattaanartacaaagattagccgggtgtgatggcatgcg

SEQ ID NO: 8018 - DNA, 103 bp, Homo sapiens
gaggttgagacaagagaatcacttgaacctgagaggcagaggttgcagtgcagcctgggtgacasagggagactccggccccctcccaaaaaaaaaaaaaaaa

SEQ ID NO: 8019 - DNA, 73 bp, Homo sapiens
gaggttgagacaagagaatcacttgaacctgagaggcagaggttgcagtgcagcctgggwgacagagggagab

SEQ ID NO: 8020 - DNA, 96 bp, Homo sapiens
gaggttgagacaagagaatcacttgaacctgagaggcagaggttgcagtgcagcctgggtgacagagggaagactccggccccctcccaaaaaaar

SEQ ID NO: 8021 - DNA, 121 bp, Homo sapiens
ctggacaaatgacttgaatagacagttctccaaagaagatatgcaaatggctcaacattattaatcattagggaacatttgtkrmtaattagkggtatctccacagtgagatatcacttct

SEQ ID NO: 8022 - DNA, 67 bp, Homo sapiens
gaggttgagacaagagaatcacttgaacctgagaggcagaggttgcagtgcagcctgggtgacagag

SEQ ID NO: 8023 - DNA, 58 bp, Homo sapiens
cttttgcgttctctttccctctcccaacatggcggcctcagcaaaaaaaaaaaaaaaa

SEQ ID NO: 8024 - DNA, 164 bp, Homo sapiens
ctggacaaatgacttgaatagacagttctccaaagaagatatgcaaatggctcaacattattaatcattagggaaccattgttaataattagtggtatctccacagtgagatatcacttcttacccattaggatggctataataaaaaacaaaaaaaaaaaaaa

SEQ ID NO: 8025 - DNA, 104 bp, Homo sapiens
gaggttgagacaagagaatcacttgaacctgagaggcagaggttgcagtgcagcctgggtgacagagggaagactccggccccctcccaaaaaaaaaaaaaaaa

SEQ ID NO: 8026 - DNA, 76 bp, Homo sapiens
acagttaactttaggaccatagccaaaagatagaaacagcataaacgccaaaataaaaagaagccaataaagataa

SEQ ID NO: 8027 - DNA, 163 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaaaaaaaaaaaaaa

SEQ ID NO: 8028 - DNA, 103 bp, Homo sapiens
gaggttgagacaagagaatcacttgaacctgagaggcagaggttgcagtgcagcctgggtgacagagggagactccggccccctcccaaaaaaaaaaaaaaaa

SEQ ID NO: 8029 - DNA, 83 bp, Homo sapiens
acagttaactttaggaccatagccaaaagatagaaacagcataaacgccaaaataaaaagaagccaataaagataaacacaaa

SEQ ID NO: 8030 - DNA, 104 bp, Homo sapiens
gaggttgagacaagagaatcacttgaacctgagaggcagaggttgcagtgcagcctgggtgacagagggagactccsggccccctcccaaaaaaaaaaaaaaaa

SEQ ID NO: 8031 - DNA, 104 bp, Homo sapiens
gaggttgagacaagagaatcacttgaacctgagaggcagaggttgcagtgcagcctgggtgacagarggagactscsggccccctcccaaaaaaaaaaaaaaaa

SEQ ID NO: 8032 - DNA, 104 bp, Homo sapiens
gaggttgagacaagagaatcacttgaacctgagaggcagaggttgcagtgcagcctgggtgacagagggagactccggcccccctcccaaaaaaaaaaaaaaaa

SEQ ID NO: 8033 - DNA, 77 bp, Homo sapiens
gaggttgagacaagagaatcacttgaacctgagaggcagaggttgcagtgcagcctgggtgacagagggagactscs

SEQ ID NO: 8034 - DNA, 74 bp, Homo sapiens
aataatagctactaaaaagtaacaaggttgagaccagcctgggcaacataaggagaccccttcttcacaaaaaa

SEQ ID NO: 8035 - DNA, 104 bp, Homo sapiens
gaggttgagacaagagaatcacttgaacctgagaggcagaggttgcagtgcagcctgggtgacagagggagactccggsccccctcccaaaaaaaaaaaaaaaa

SEQ ID NO: 8036 - DNA, 58 bp, Homo sapiens; identical to SEQ ID NO: 8023

SEQ ID NO: 8037 - DNA, 104 bp, Homo sapiens; identical to SEQ ID NO: 8032

SEQ ID NO: 8038 - DNA, 90 bp, Homo sapiens
gaggttgagacaagagaatcacttgaacctgagaggcagaggttgcagtgcagcctgggtgacagagggagactccggcccccytcccaa

SEQ ID NO: 8039 - DNA, 65 bp, Homo sapiens
aataatagctactaaaaagtaacaaggttgagaccagcctgggcaacataaggagaccccttctt

SEQ ID NO: 8040 - DNA, 166 bp, Homo sapiens
ctggacaaatgacttgaatagacagttctccaaagaagatatgcaaatggctcaacattattaatcattagggaacattgkttaataattaagtggtatctccacagtgagatatcacttcttacccattaggatggctataataaaaaacaaaaaaaaaaaaaaa

SEQ ID NO: 8041 - DNA, 103 bp, Homo sapiens; identical to SEQ ID NO: 8028

SEQ ID NO: 8042 - DNA, 79 bp, Homo sapiens
actcttttcctccttaactatctaaaratavatcaccatcatmaacaacaccataactatccacactaaaaaattcata

SEQ ID NO: 8043 - DNA, 103 bp, Homo sapiens
gaggttgagacaagagaatcacttgaacctgagabgcagaggttgcagtrcagcctgggtsacagargkagactccggccccctcccaaaaaaaaaaaaaaaa

SEQ ID NO: 8044 - DNA, 150 bp, Homo sapiens
  misc_feature 150: n=a, g, c or t
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaaaan

SEQ ID NO: 8045 - DNA, 360 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagattaagtggccgggcacagtggctcatgcctgtaatcccagcwacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8046 - DNA, 104 bp, Homo sapiens
gaggttgagacaagagaatcacttgaacctgagaggcagaggttgcagtgcagcctgggtgacagagggagactccggccccctcccaaaaaaaaaaaaaaaaa

SEQ ID NO: 8047 - DNA, 71 bp, Homo sapiens
ctggacaaatgacttgaatagacagttctccaaagaagatatgcaaatkgctcaacattattaatcattag

SEQ ID NO: 8048 - DNA, 92 bp, Homo sapiens
gaggttgagacaagagaatcacttgaacctgagaggcagaggttgcagtgcagcctgggtgacagagggagactccggccccctcccaaaaa

SEQ ID NO: 8049 - DNA, 103 bp, Homo sapiens
gaggttgagacaagagaatcacttgaacctgagaggcagaggttgcagtgcagcctgggtgacagarggagactccggccccctcccaaaaaaaaaaaaaaaa

SEQ ID NO: 8050 - DNA, 103 bp, Homo sapiens; identical to SEQ ID NO: 8028

SEQ ID NO: 8051 - DNA, 132 bp, Homo sapiens
gcattttatagcctgcctagagagccaaccacatcacggcatcgtttcggtatcatttccttggaaaaatgtctggcagcctgggcaacatggcgaaatatcacttctctacaaaaaaaaaaccccccaaaa

SEQ ID NO: 8052 - DNA, 92 bp, Homo sapiens; identical to SEQ ID NO: 8048

SEQ ID NO: 8053 - DNA, 103 bp, Homo sapiens; identical to SEQ ID NO: 8028

SEQ ID NO: 8054 - DNA, 103 bp, Homo sapiens
gaggttgagacaagagaatcacttgaacctgagargcagaggttgcagtgcagcctgggtgacagagggagactccggccccctcccaaaaaaaaaaaaaaaa

SEQ ID NO: 8055 - DNA, 88 bp, Homo sapiens
gaggttgagacaagagaatcacttgaacctgagaggcagaggttgcagtgcagcctgggtgacagagggagactccggccccctcccm

SEQ ID NO: 8056 - DNA, 103 bp, Homo sapiens
gaggttgagacaagagaatcacttgaacctgagasgcagaggttgcagtgcagcctgggtgacagagggagactccggccccctscsaaaaaaaaaaaaaaaa

SEQ ID NO: 8057 - DNA, 57 bp, Homo sapiens
cttttgcgttctctttccctctcccaacatggcggcctcagcaaaaaaaaaaaaaaa

SEQ ID NO: 8058 - DNA, 191 bp, Homo sapiens
ttaagcatgttaacaaaaatagcaaaatatgawaataagctgggcatggtggcacacgcctgtaatcssaactastcgggakgctgasgcatgasaatcacttgaacccaggaagcagaggttgcagtgagccgagatcatgccgccgcactccagcctgggcaacagggcgagactctgtctcaaaaaaa

SEQ ID NO: 8059 - DNA, 75 bp, Homo sapiens
gaggttgagacaagagaatcacttgaacctgagabgcagaggttgcagtgcagcctgggtgacagagggagactc

SEQ ID NO: 8060 - DNA, 365 bp, Homo sapiens
  misc_feature 117,223,230..232: n=a, g, c or t
ctgttattacttgctctctgtcatatagttcacaaaacttacaactccttgccccactctgaccacagtgtctcttcgtgtttgawrkckacccactckactcccagmckacttmmnkctktgtacaagggaacatggaaagcacctggctgctctctgctactgctctaggagtcatggaagattatctgaggttatccagatgccctctgcctagacatgnkattchnnnwttkkatactctactgtgtttcactgatgtgcacaaatgcaaatcccagagtatataggaaaatgtgaatgatattkkkttccttttcatattagattttccatttagaattkkataacatacagataagata

SEQ ID NO: 8061 - DNA, 65 bp, Homo sapiens
aataatagctactaaaaagtaacaaggttgagaccagcctgggcaacataaggagaccccttctk

SEQ ID NO: 8062 - DNA, 58 bp, Homo sapiens; identical to SEQ ID NO: 8023

SEQ ID NO: 8063 - DNA, 335 bp, Homo sapiens
caaacagaattaccagataagccaaaaatactgcttctaggtatacgccctaaagaactaaaaacaggtgttcaaakwaaaacctcgkatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgaggcaggagaatcacttgaacctgggaggtggargttgcagtgaactgagattgcgccactccactccagcctgggcaacagr

SEQ ID NO: 8064 - DNA, 198 bp, Homo sapiens
ttaagcatgttaacaaaaatagcaaaatatgaaaataagctgggcatggtggcacacgcctgtaatcccaactactcgggagggctgagggcatgagaatcacttgaacccaggaagcagaggttgcagtgagccgagatcatgccgccgcactccagcctgggcaacagggcgagactctgtctcaaaaaaaaaaaa

SEQ ID NO: 8065 - DNA, 165 bp, Homo sapiens
ctggacaaatgacttgaatagacagttctccaaagaagatatgcaaatggctcaacattattaatcattagggaacattgttaataatttagtggtatctccacagtgagatatcacttcttacccattaggatggctataataaaaaacaaaaaaaaaaaaaaa

SEQ ID NO: 8066 - DNA, 104 bp, Homo sapiens; identical to SEQ ID NO: 8046

SEQ ID NO: 8067 - DNA, 165 bp, Homo sapiens
ctggacaaatgacttgaatagacagttctccaaagaagatatgcaaatggctcaacattattaatcattagggaacattgttaataaattagtggtatctccacagtgagatatcacttcttacccattaggatggctataataaaaaacaaaaaaaaaaaaaaa

SEQ ID NO: 8068 - DNA, 104 bp, Homo sapiens
gaggttgagacaagagaatcacttgaacctgagaggcagaggttgcagtgcagcctgggtgacagagggagactccggccccctcccmaaaaaaaaaaaaaaaa

SEQ ID NO: 8069 - DNA, 84 bp, Homo sapiens
gaggttgagacaagagaatcacttgaacctgagaggcagaggttgcagtgcagcctgggtgacagagggagactccggccccct

SEQ ID NO: 8070 - DNA, 164 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaaaaaaaaaaaaaaaaaaa

SEQ ID NO: 8071 - DNA, 235 bp, Homo sapiens
  misc_feature 114: n=a, g, c or t
gctgggactgcaggcatccgccatcacgcctggctaatttttttgtactttattggagatcctggccaacatggagaaaccccgtctctacaaaaatacaaagattagccagcngtgatggcgggcaccggtagtcctagctactggggagactgaggcgggaaaatcggttgaacccagtggtggagattgtagtgagccaagatcgtgccactgcaatccagcctggcgacav

SEQ ID NO: 8072 - DNA, 104 bp, Homo sapiens; identical to SEQ ID NO: 8032

SEQ ID NO: 8073 - DNA, 177 bp, Homo sapiens
tttctttttacattgtgcctttatcagtttatggtatcagggtgatactagcttcatagtatgagttaggcaggagcccatcctcctcccattttttgaaatagtttcaatagaaaaaaaaaaaaaaaaaaaaaaaaaaaaaaaaaaaaaaaraaaaaaaaaaaaaaaaaaaaaaaa

SEQ ID NO: 8074 - DNA, 165 bp, Homo sapiens
ctggacaaatgacttgaatagacagttctccaaagaagatatgcaaatggctcaacattattaatcattagggaacattgttaataaatbagtggtatctccacagtgagatatcacttcttacccattaggatggctataataaaaaacaaaaaaaaaaaaaaa

SEQ ID NO: 8075 - DNA, 104 bp, Homo sapiens; identical to SEQ ID NO: 8032

SEQ ID NO: 8076 - DNA, 58 bp, Homo sapiens; identical to SEQ ID NO: 8023

SEQ ID NO: 8077 - DNA, 454 bp, Homo sapiens
tgtctgatttctttcactggtattttgtagttctcctcatagagatagttcacaaccttggttagacatactcctagtcattttttggggggtgtggctatttttaataggattgcattcttgatgatgtgkttctcagcttgaacattattggcgtttaagagtactgctgactgggccgggcacggtggctcacgcctgtaatcccagcgctttgggaggccaaggcgggcggatcacctgaggtcgggagttcgggagcagcctgaccaacatggagaaacccagtctctattaaaaatgcaaaattagccgggcgtggtggtgcgtgcctgtagtcccggctacttaggagggctggggcgggagaattgcttgagccggggaggcggaggttgtggtgagccaagatcgcactccagcctgggcaacaagagcgaaactccatcacaaa

SEQ ID NO: 8078 - DNA, 103 bp, Homo sapiens
gaggttgakacaagakaatcacttgaacctgagakgcagaggttgcagtrcagcctgggtgacagakggagactccggccccctcccaaaaaaaaaaaaaaaa

SEQ ID NO: 8079 - DNA, 96 bp, Homo sapiens
acagttaactttaggaccatagccaaaagatagaaacagcataaacgccaaaataaaaagaagccaataaagataaacacaaaaaaaaaaaaaaaa

SEQ ID NO: 8080 - DNA, 103 bp, Homo sapiens; identical to SEQ ID NO: 8028

SEQ ID NO: 8081 - DNA, 127 bp, Homo sapiens
cctgtaatcccagctacccaggaggctgaggcaggagaatcgctggaacccgggaggtagaggctgcagtgagccgagatcgcgccactgcactccagcctgggcgacagagcgagagtttgtctga

SEQ ID NO: 8082 - DNA, 102 bp, Homo sapiens
gaggttgagacaagagaatcacttgaacctgagaggcagaggttgcagtgcagcctgggtgacagagggagactccggccccctcccaaaaaaaaaaaaaaa

SEQ ID NO: 8083 - DNA, 170 bp, Homo sapiens
ctctttcccatcttggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccwtgtcagagg

SEQ ID NO: 8084 - DNA, 103 bp, Homo sapiens; identical to SEQ ID NO: 8028

SEQ ID NO: 8085 - DNA, 146 bp, Homo sapiens
ctggacaaatgacttgaatagacagttctccaaagawgatatgcaaatggctcaacattattaatcattagggaacattgttaataattagtggtatctccacagtgagatatcacttcttacccattaggatggctataataaaw

SEQ ID NO: 8086 - DNA, 164 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaaaaaaaaaaaaaaa

SEQ ID NO: 8087 - DNA, 103 bp, Homo sapiens; identical to SEQ ID NO: 8028

SEQ ID NO: 8088 - DNA, 103 bp, Homo sapiens; identical to SEQ ID NO: 8028

SEQ ID NO: 8089 - DNA, 58 bp, Homo sapiens; identical to SEQ ID NO: 8023

SEQ ID NO: 8090 - DNA, 97 bp, Homo sapiens
gaggttgagacaagagaatcacttgaacctgagaggcagaggttgcagtgcagcctgggtgacagagggagactccggccccctcccaaaaaaaaaw

SEQ ID NO: 8091 - DNA, 72 bp, Homo sapiens
acagttaactttaggaccatagccaaaagatagaaacagcataaacgccaaaataaaaagaagccaataaag

SEQ ID NO: 8092 - DNA, 103 bp, Homo sapiens; identical to SEQ ID NO: 8028

SEQ ID NO: 8093 - DNA, 67 bp, Homo sapiens
gaggttgagacaagagaatcacttgaacctgagaggcagaggttgcagtgcagcctgggtgacagar

SEQ ID NO: 8094 - DNA, 114 bp, Homo sapiens
tttctttttacattgtgcctttatcagtttatggtatcagggtgatactagcttcatagtatgagttaggcaggagcccatcctcctccattttttgaaatagtttcaatagam

SEQ ID NO: 8095 - DNA, 67 bp, Homo sapiens
gaggttgagacaagagaatcacttgaacctgagaggcagaggttgcagtgcagcctgggtgacagak

SEQ ID NO: 8096 - DNA, 58 bp, Homo sapiens; identical to SEQ ID NO: 8023

SEQ ID NO: 8097 - DNA, 61 bp, Homo sapiens
  misc_feature 35: n=a, g, c or t
gaggttgagacaagagaatcacttgaacctgasangcagaggttgcagtgcagcctgggtb

SEQ ID NO: 8098 - DNA, 74 bp, Homo sapiens
acagtyaactttaggaccatagccaaaagayagaaacagcataaacgccaaaataaaaagaagccaataaagak

SEQ ID NO: 8099 - DNA, 377 bp, Homo sapiens
  misc_feature 327: n=a, g, c or t
agcttaggacaatacaaattctacacagagaaataggtagcattatgatgtaaactgtccccctcccaccaaacaaaaaccacatgggcctgtctttatcagagctattttattttagctgaatcattttgtagattgtagtacgtttccctgaattttattactcagaatcctttgaaataggccaggcacmwvggctcacacttgtaatcccagcactttgggaggccaaggtgggcagattactttaggtcaggagttcgagaccagcctggccaacatgacgaaactccatctctactaaaaataccaarattagccawrgwntgccggcacgtgcctgtaatcccagctacatgggaggctgaggcaggaga

SEQ ID NO: 8100 - DNA, 148 bp, Homo sapiens
tttctttttacattgtgcctttatcagtttatggtatcagggtgatactagcttcatagtatgagttaggcaggagcccatcctccctccattttttgaaatagtttcaatagaaaaaaaaaaaaaaaaaaaaaaaaaaaaaaaaaaa

SEQ ID NO: 8101 - DNA, 82 bp, Homo sapiens
acagttaactttaggaccatagccaaaagatagaaacagcataaacgccaaaataaaaagaagccaataaagataaacacaa

SEQ ID NO: 8102 - DNA, 58 bp, Homo sapiens; identical to SEQ ID NO: 8023

SEQ ID NO: 8103 - DNA, 58 bp, Homo sapiens; identical to SEQ ID NO: 8023

SEQ ID NO: 8104 - DNA, 55 bp, Homo sapiens
ctttttttcctttcsgctcggctgttttcctgcgcaggagccgcaggscgtaacc

SEQ ID NO: 8105 - DNA, 234 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatccc

SEQ ID NO: 8106 - DNA, 102 bp, Homo sapiens
gaggttgagacaagagaatcacttgaacctgagaggcagaggttgcagtgcagcctgggtracagagggagactccggccccctcccaaaaaaaaaaaaaaa

SEQ ID NO: 8107 - DNA, 95 bp, Homo sapiens
ctgctgggattacaggtatgaggtactgtgtccagccagaaaagattcttgatatgattttaattcttgtaaakkagttgagatttgtgtttttt

SEQ ID NO: 8108 - DNA, 72 bp, Homo sapiens
aataatagctactawmaaagtaacaaggttgagaccagcctgggcaacataaggagaccccttcttcacaaa

SEQ ID NO: 8109 - DNA, 147 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaah

SEQ ID NO: 8110 - DNA, 103 bp, Homo sapiens; identical to SEQ ID NO: 8028

SEQ ID NO: 8111 - DNA, 104 bp, Homo sapiens; identical to SEQ ID NO: 8032

SEQ ID NO: 8112 - DNA, 138 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaaaaaaaaaaaaaaaaaaaaaaaa

SEQ ID NO: 8113 - DNA, 103 bp, Homo sapiens; identical to SEQ ID NO: 8028

SEQ ID NO: 8114 - DNA, 103 bp, Homo sapiens; identical to SEQ ID NO: 8028

SEQ ID NO: 8115 - DNA, 104 bp, Homo sapiens
gaggttgagacaagagaatcacttgaacctgagaggcagaggttgcagtgcagcctgggtgacagagggagactcccggccccctcccaaaaaaaaaaaaaaaa

SEQ ID NO: 8116 - DNA, 103 bp, Homo sapiens
gaggttgagacaagagaatcacttgaacctgagaggcagaggttgcagtgsagcctgggtgacagarggagactcsggccccctcccaaaaaaaaaaaaaaaa

SEQ ID NO: 8117 - DNA, 58 bp, Homo sapiens; identical to SEQ ID NO: 8023

SEQ ID NO: 8118 - DNA, 164 bp, Homo sapiens; identical to SEQ ID NO: 8086

SEQ ID NO: 8119 - DNA, 58 bp, Homo sapiens; identical to SEQ ID NO: 8023

SEQ ID NO: 8120 - DNA, 75 bp, Homo sapiens
gaggttgagacaagagaatcacttgaacctgagaggcagaggttgcagtgcagcctgggtgacagagggagactc

SEQ ID NO: 8121 - DNA, 76 bp, Homo sapiens
gaggttgagacaagagaatcacttgaacctgagaggcagaggttgcagtgcagcctgggtgacagagggagactcc

SEQ ID NO: 8122 - DNA, 83 bp, Homo sapiens; identical to SEQ ID NO: 8029

SEQ ID NO: 8123 - DNA, 104 bp, Homo sapiens; identical to SEQ ID NO: 8115

SEQ ID NO: 8124 - DNA, 58 bp, Homo sapiens; identical to SEQ ID NO: 8023

SEQ ID NO: 8125 - DNA, 433 bp, Homo sapiens
aggatgacactgagcctgtcgcagccacgttggggttccgcactgaagccaaaaggtttcgcgtctcccagcgtccccgaccggaagtcgcctcttggtctttgcgatctttttctctggctcaatttgggctgattccgtttgtgtccgcaattcctaaatcgagkttycttgaaaagagacactcgtcttaagggttaagacgaaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgscatgtattccagaaaggccatgtacaagaggaagtactcagc

SEQ ID NO: 8126 - DNA, 76 bp, Homo sapiens
ctttttcgcaacgdgtttdccgccagaacacaggtgtcgtgaaaactacccctaaaagccaaaaaaaaaaaaaaaa

SEQ ID NO: 8127 - DNA, 165 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaaaaaaaaaaaaaaaaaaaaaaaaaaaaaaaaaaaaaaaaaaaaaaaaaam

SEQ ID NO: 8128 - DNA, 104 bp, Homo sapiens
  misc_feature 35: n=a, g, c or t
gaggttgakacaagakaatcacttgaacctgakangcagaggttgcagtgcagcctgggtgacagadggagactccggcccccctcccaaaaaaaaaaaaaaaa

SEQ ID NO: 8129 - DNA, 236 bp, Homo sapiens
aatgataattagtcgagaggatttgtgaaaagtaagaaccaatttttggtgctatttctgtttgttgttaggtaatttagaagccctatggtacctgattttgtgagtggttatttttatgaagagatgtagtaatggactttacgagaaaattgagagtatactgtccttgaattgagttgacctctctctgaaagagccaagaaataaaaataaaaccaaaaaaaaaaaaaaaa

SEQ ID NO: 8130 - DNA, 317 bp, Homo sapiens
atgaagtcttttgactaagatttgttctaatgggcccagcgcagtggctcacgcctataatcccagcactttgggaggctgargcaggcagatcacgaggtcaggagatcgagaccatcctggccagcgtggtgagaccccatttctactaaaaatacaaaaaattaactggttgtggtggcgcgtgcctgtaatcccagctattcgggaggctcaggcaggagaatcacttgagcctgggagtcggaggttgtagtgggccgagatcgcgccactgcactccagcctggcgacagaatgagactctgtcaaaaaaa

SEQ ID NO: 8131 - DNA, 463 bp, Homo sapiens
catcacgattagctcaacacaaaaatggatgagaaatagactgctaacagatttgtcatcagcaacactgaatgccagaagtyaakgggatcarcatcttcagagcttaaggaaaatttttgtacctagaatttcatagtaaggcagactgtcaagaagaacatcaaagtgaagacattttctgtcaggcaaattttcagaaagtctcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagagcatactgtctcgggctttctgggaagaatgtgcattcagtgccatagatagtatcattgaagag

SEQ ID NO: 8132 - DNA, 54 bp, Homo sapiens
aattgtgttcgcagccgccgccgcgccgccgtcgctctccaacgccagcgccgs

SEQ ID NO: 8133 - DNA, 352 bp, Homo sapiens
agatgactctcaaggataaggagtaacatttgtgatgacagaaatgctgccagtcaggataaagcttgagrattmmtaggacacaaaaggaaaaaactgaagcagcaggggcttagtccagctataatcaagacagtgtggtactgacataagaaaagacatgtagatcaatggaagattaagaagaatatagaaataaatccttacgtttatggacggagttaacaaaatgcagtgggagaacagtctttaaacaaatgctgctagaacaactggatggccacatgcaaaagaatggacttggacccctgcacctcacaccctgtgcaaaaattaaagtgtatcatggacc

SEQ ID NO: 8134 - DNA, 390 bp, Homo sapiens
agatactgtattctttctgctcttgttagtgccttatgtgatttgctccctggagaagtaccaggacaaraarscmraatyctttggaattacagaaagagamatgaagaaaaatgtgaatcccagatggagtctctctctgtcacccaggttggagtccagtggttcaatctcggctcactgcaagctctgcctcccaggtttacgccattctcctgccacagcctcccgaatagctgggactacaggtgcatgacacaaggcctgactaattttkkgtaattttagtagagatggggtttcactgtgttagccargatggtctggatctcccaacctcgtgatccgsccgcctcagcctcccaaagtgctgggattacaggtgtgagc

SEQ ID NO: 8135 - DNA, 441 bp, Homo sapiens
taaacataaaattaccatatgatccaggctttctacttctgattatagacccccaaaaaagtgaaagcaaaaamctgraacagatagttgtacatccatattcatagcagcagcattcgcaataatcaaaagaaagaagcaacccaagtgcccataggtggatgaataaacaaaatgtgtatacatacagtggaatattattcagccttaaaaaggaagaagattctaatgcatgttacaacatggatgaaacttgaagacattatgccaagtgaaacaagacaatcacaaaagggctgggtatggtggctcatgcctgtaatcccagcattttgggagaccaaggcaggaggatcatgtaagcccaggagtttgagaccagcctgggcaacatagtgagacccacacacaagaaaattggccaggcatggtggcgtgtac

SEQ ID NO: 8136 - DNA, 528 bp, Homo sapiens
ccattgcagcaccattccaatccaaaacaacagtgaaggcattgaagccttctgtgtctttttaggaagagatggaagtgaccgtcttgttcctcttccaggctctccttttctggttttgtccttctgtaataacaatttaaaccatttttcttttcttttgtttttcaagtaatcttagcagacaaagaaattctcttcagtctttcgttcaaggtattgctgtggttatgtgtgtttaaaatccttaatttactgatcatcccgaatcataattgtgcagtttctgtctcaaaaaaaagaaaaaaaaaagaattatacaaactgttagccagttgattagatacagtactgcwagaatgcyctttcccccagaatgtaatcattatgagattcaaggaccttgcctgtkgttgttcctctwacgttctccagaggtacaggagattcatgctaaatagtctgataaatcaattatggttataaggaagtgtataagattctatgaggccaggcatggtggctcam

SEQ ID NO: 8137 - DNA, 243 bp, Homo sapiens
acctactgcctggacctcttctctatcacaacaggttgaagtctttaaggcctctgtcagatggtagtttgtgacattttcttcataccacagaatttgtaatttccttgtgcttctaaggtgttttggaccatggttggagtacaagttttactatattgtcttgtgttgtagttaagtccatatatattcaacttcactaaactataaattccatatgtcagtgaatcacctagaattttk

SEQ ID NO: 8138 - DNA, 368 bp, Homo sapiens
cagggttgtwaggcaactcttaactgacaatatagttagtatattctgggccttcatcttcaaaattagtaggtagtatttattgagtgcatatcatgtgccaggcctggtgctgagtgcttacaatgatcattttatatatgggaaaattgaggctcagcagggtcaagtgccttgtaagaggtagcactagtaagtaacagtgctcaaattcaactaggtcttgtcagctttttaagcgtctgtcccactgactaccatatctctacaagagaatagatgaggaattgaggttatgtgggaagtacgtgtaagtttacagtattaagaaatgtacaataaaatttgtttctatgtcagcgtataaa

SEQ ID NO: 8139 - DNA, 63 bp, Homo sapiens
ttgtaaatactgcttgaccgtactctcacatgtggcaaaatatggtttggtttttcttttttt

SEQ ID NO: 8140 - DNA, 407 bp, Homo sapiens
agtatttagaagtcaaatgcttcgtttttaataggaacttacacagtcttttatgtttttttatagccctcaatgtcactgatgtggattctcccaaactcgatactttgtttgtttttatgtccccataataagtctttaagaaaacagggcaagtgagctcaaaatcaaaagaaaacccaccaacagtgaatgcattcagggctatttccaggtctttcttttgaagaaagataagactcagtccagagagcacatcttgacacaccgtgcctcttgcctttggtgcgtggcagtcatctttggctcatgctgtacattattctacattagaaaactcactgtatgttgctaaataattttttgaaaacaggcagattaataaatggacatcttatttattgcaa

SEQ ID NO: 8141 - DNA, 390 bp, Homo sapiens
agctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtcagtgagaaggtgcgcatcgcttgggggtggatgtgggtatcagaggtga

SEQ ID NO: 8142 - DNA, 393 bp, Homo sapiens
cattttctttatccattcatctgatggacacttaatttggatccatatctttgctattgtgattagtgctgccttaaacatggcagtgcaggtatccctttgatagactagtttcctttcctttggtacctaattttattagtggcttcacatgtgccaggcactgcacttggtgctttttgcattgtcccatttaatcctcccagcagttttgcaagatggataagaattatcttttatgttttacaaataagggactaataggaactgaagctttgagagatttggaaacccaaagttacgtggctggaagtggcagactgggatttgtctgaacccagatctttatgacaccaaagccgatgctcaattatgagcatttttgcttgctta

SEQ ID NO: 8143 - DNA, 499 bp, Homo sapiens
accatccatccccgagggaccaggaggttgcggaagtaaacaccgatgactcccagatctacagctccaggctgttcccttctccgtgtctcatatcagatttgccaactgtttattggacatcaccgcctgagtatccctgagggacacgattatcctgtttggagtgtattgaacttcttggatacatcgattagtgtctttcctcaagtttgagtaatttgcagtcatttttcctttgaaaattctttcttctctattctgtttctctccttgttgaacccccatcatgcataggtgtgctctgttcatttttcacattacttttatttttctgctcctcggactgaataatctcaattgacctattttaagttcactgattcttttgcctgcccaaacctactgttgtacccctctagtgacttttagttattgtacttttcaaataaagaatttctatttattttataaaaaaaaaaaaaaaaaaaaaaaaaam

SEQ ID NO: 8144 - DNA, 537 bp, Homo sapiens
ttttttttccaccttaaaagtaacaccaggaaactattgtgtaggaactgagactacataaatcattacacagggataagaccaatctcatctgcctcctgcaagaaataccatctttgtgcttgttcagactcacttgaaatagcttttctctttgtttttgtttgatttttatacctggtttatgagtactaaacatccaaaaggcaaaaaagttaacagatttaaatattaaaaaacaaaaacagcctgggtatggtggcgactcaggaggctgaggtgggaaggtggcttgagcccaggagtttgagaccagcctgggcaacatggtgagactcctctctctaaaaaacaaacagggaccaggtgcggtggtggctcatgcctgtagttccagcactttgggagcctgaggcaggtggatcacatgaggccaggagttcgagacgggcctggscaacatggtgaaactctgtctctaccagaaatacagaaatcagccgagtggtggtgcacatctgtggtccaggtactcag

SEQ ID NO: 8145 - DNA, 266 bp, Homo sapiens
attcacactggctgatatggcaacaaggctggtggccgcgcggctgatggtccgcaatgcagcagtggctctgcaggaggagaggaaggatgcagtggccttgtgctccatggccaagctctttgctacagatgaatgctttgcvatctgcaaccaggccttgcagatgcacgggggctacggctacctgaaggattacgctgttcagcagtacgtgcgggactccarggtccaccagattctagaagagctgktctggcaggggc

SEQ ID NO: 8146 - DNA, 455 bp, Homo sapiens
tcttcttgacacatggctctttttaaatgtatgttatttaattcctaaatatttggggattttgcttatctttctggtagtttctgcaataattccattgtggtcagagtacattaagacttgaattatttacatttattgagatttgctttgtggcccagaatatgggctatcttggtatgagttacatgttcacttgaaatgtatactgtactctcgtttgatgaaggggttctacaagtgttgattaggtaaaaatggttgatgttatttaagttttttctatctttattgacattctgtggttttggttccagcaattattttaagaggattgttgacatctctgaatattaaattggatttacttctctgcagttctgtcagattttgcttcacatattttagtatgtttttattaggtgaataataaatatttcctattttatgtccaa

SEQ ID NO: 8147 - DNA, 503 bp, Homo sapiens
cagtattcttgggagtcagtgttatgtgtttcagcagagtattattttgtatatgtatgccattttctccctgcaaagcagctcaacaagagaaaaagctctagttatagggcttaaattgatttctatttcaaataatttcctaagagattctagagtagaactgaagagtattctattggaaaagtgaaaggaaagaaatgtaattttctttgaacatgaaaaagaaaacaactttgagagtagtcatttagcagtagatgtgcattattatgagaaaacagttctataagtccagggttaattatattaattggaatgtcagtctttaatgtcgagcttattgtagggtagaaaagagctttctactcagctaacgattactcattgatccaaaacttaaatacatctataatttcctggggctattgtgagtactgtgtatgtatttagcaaatatttaagacctagtaagtgctcaataaattgtagctgttaaaaaa

SEQ ID NO: 8148 - DNA, 460 bp, Homo sapiens
gtccttagaacagttctgtaagaggctgggcaggccaagccaggcattcccagttacaggtggtgacttcaaaatccagagcaggcagggcatggtggctcacacctgtaatcccagcactttgggaggctgaggtgggaggatcgcttgagtccaggagttcaagaccagcctcggcaacatagtgaaaccccatctctactaaaaataaaaaaatttggccagactccgtggctcatgcctgtaatcccagcactttgggaggtttgaggtgggtggatcacctgaggtcaggagttcaggaccagcctggtcaacctggtgaaacctgcctctactaaaaatacaaacattagctgggcgtggtggtgggttcctgtaatcccagctactttggaggctaacgcaggagaattgcttgaacctgggaggtggagcttkcagtgaactgagatcacac

SEQ ID NO: 8149 - DNA, 428 bp, Homo sapiens
tcamaaattgattgttatacttacacattaggtataatttatcatttatctgaaatcacatgtagcagattgcatagtctgtaatcctctcagagggaaacttcttgtttaaacagctctatatggatttatacttktatatttataaatbtataacttcatacaaatttataaacatttctttataaattgtaatttaatagattatctcagaaaaacctctctgaatgatgacccttccttaatactgggtgatgtgygaatatttgtttgttggcagacagggkctcactttgtcacccaggctagagtgcagtggtgcaatctcagctcactgcagcctctgcctcctgagttcaagtgatcckcctgcttcagsctccctagtagctgggactacaggtatgcaccaccatgcctggctaatk

SEQ ID NO: 8150 - DNA, 412 bp, Homo sapiens
gtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgcaaaaa

SEQ ID NO: 8151 - DNA, 160 bp, Homo sapiens
tcactccatcttgatgagagttggtgtttgtgggttatttgtgaagccggaaagaagccgtgtcctggagaatgtagctgaaggcctggccactttcgacaagaacgggaaagagacgactaacttgtactaatatcttagtgcytggcagggcattttt

SEQ ID NO: 8152 - DNA, 165 bp, Homo sapiens
agaaccaggaaggcgctgagcttaaactgaagcaagttcggtggacgccggcggsyyctgatctaaagaaacgactcagggactgcggcgcttgcacgtcaacgggaggtgtgagcccaaaggtctggacccagaaatgggacgtcggtcatcagatactgaaga

SEQ ID NO: 8153 - DNA, 111 bp, Homo sapiens
araagaataaggaagtcagaggttacatcttcttaaggtgtggaaatataatattttcctaagaaactatttaaactakckcttktkkgtaaatggaagaagcagaacaca

SEQ ID NO: 8154 - DNA, 395 bp, Homo sapiens
tacttctagaacaggagctaggcctcccgaagcctttgcatgttaactaactaatcaaggggctccagcctgttgggctcacattgcctggtctttactcacttgactttccacaggcctcgctcttgaaaactgaaattgctgcatggcattcattacacacacgtatgtatatatgtgcatatgaaaatacatttgcataggtacctatccatatgtatatacacacatacacacgtttttcctcataaatgaaactggattaaattttatttccaatattcaggtgactcttaaaactgaggggaaaaattggggataaaaagcaggacaaggcaataattatcctgkagcttatctcaaaatggraatttccccaacaacattagttctaa

SEQ ID NO: 8155 - DNA, 445 bp, Homo sapiens
aggctctgcggagagcggctgccactcgcctgtttttttcttgagacctagtctggctctgtggctcaggctggagtgcagtggcgtgatcaccgctcactgcagcctcagbmtcctctcgcctcagccgctcggtagctgggaccaccagcgggcgccaccactcccggctacatttttttgtatttttagtagagacgtgggtctcgccatgttggctaggctgctgccgaactccggggctcaagcgatccgcccgcctgggcctcccaaggtgctgagactgcaggcatgagccaccgcgcccggccgagagcvtcttttggctcctcctttcgcctttccggggccaggcgtgtgcagctctgtgaagggtcccctccctctgcgggacgtcctcgctgccgargtcagargcgcggagaacatgagaccgaggtctcaa

SEQ ID NO: 8156 - DNA, 407 bp, Homo sapiens
  misc_feature 309..311,407: n=a, g, c or t
ttaaatgtattatgttagaatgatagctgtagaccggaaatggccacacttatttaaaccaaaaagtgtagagaacattacatgttcatcttaatacaagtgctgtttgttttagaagggttatcatttgaagtatagatctaagacattttagaaatattcatgtaaaaggatcaaaaattgctttgggggctgggcacggtggctcatgcctataatcccagcagttagatagagaggcctgggcgggaggaacacttcagcccaggagttggagactaagctgggcaacatggtgaaactccgtmnnntctgcccaacctcccccaccgccgcctccccgcccaaaaaaaagctgtgcgtggtartgtgtgcwcttgtggtccagctgctcaggaggcttgagn

SEQ ID NO: 8157 - DNA, 69 bp, Homo sapiens
ttgtgttcgcagccgccgccgcgccgccgtcgctctccaacgccagcgccgcctctcgctcgccgagct

SEQ ID NO: 8158 - DNA, 56 bp, Homo sapiens
aaattcaattgtgttcgcagccgccgccgcgccgccgtcgctctccaacgccagcg

SEQ ID NO: 8159 - DNA, 396 bp, Homo sapiens
agattttgagagcagccagtccagactgcagcaaggggagagagagctccaggaaggatatcttccaaaaaagggtttacgctggcagaacatatggagaggagatttscatttctgaagcagggtttgggatgatttcagtagaggtaaggagtctcctcctatccgtggggatatgttccaagacccccagtggatgcctgaagccacagatagtctgaaccctacatatactatgtttcttcctatatgtacagacctgtgataaaatttaattaggcacagtactcttggggccattattaagtaaaataagcgttacttgaacacaagcacagcgataactgcaacagttgatctgrtaaccaagatggctactaagcaaccaatgggcag

SEQ ID NO: 8160 - DNA, 377 bp, Homo sapiens
  misc_feature 140: n=a, g, c or t
gacttggatgtgaactgtcttcagaataatttaacctaaagcagagcaagaagagaggaagcgggggtagtgggtggggggtaggggaagaaacattatctcctcttgtacagagtctatttcttgtaaccatttgttangctcttttctttttctgatctcatggcatgcttttatgtattttgtacaggaggcaaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgttttttactggtatttcaaaaaaaaaaaaaaaa

SEQ ID NO: 8161 - DNA, 385 bp, Homo sapiens
ctactgaagaaaacacctggaaatacaaaaaatgtggcaaaacttgtaaccaatgcttagcatttttgcacatgatagtatttatatgtgagactacttgtacaaacataaaaatatacaaaagctattgtctacttgaaatttatagttaataaaagcattataaatgtaattdctgttgadagaccttttagaaaatataggccattaaagtgaagaatagtcttaagacagagaatacaaagataaagagggctctagtacctgtacttgtatcccagaacttactatatgcattttgtactagaggaaaactctgaagcagttgcttaaactttgttcaacatcagagaatttatattggagagaaatcctacaaatgtaa

SEQ ID NO: 8162 - DNA, 367 bp, Homo sapiens
tatgactattaccagttcttggtttatcttatgagtaagtatacatttacctctttgggaagagccaaaatcttcaagcaaaagacacatagttatgtgtgtgtatatatatgtaccacacacacacggattaaaacttcttatataaaatcactgtagtagacacaagagctctgataggtaacatgctattaaaaagaataacattgaggccgtgcacggtggcttacgcctataatcccagcactttgggaggccgaggtaggcagatcacttgaggtcaggagttcaagaccagcctggccaatatggtgaaactccatctctactaagaatacaaaaattagctgggcatggtgatgcacac

SEQ ID NO: 8163 - DNA, 153 bp, Homo sapiens
tatgttcacataggaagcactagtgtagagaaatagggtctgagggacaaggagcctgtgtgcccgtgtcggcagccgagtaactgccaagggtcccctgcttggcamtctgctgtccsacttgcttyctgccytctctggattctaacactk

SEQ ID NO: 8164 - DNA, 385 bp, Homo sapiens
  misc_feature 145: n=a, g, c or t
aggggagtaatagcttgctgaaaaacatgccaactgagttatgggtcttcacgcagccagcatgctgtgttttgggctctgctcttgtaatttttagaaattaattagtttatyctktatktatatttatttatktatttatdtncagatgggatcttactctgttgcccaggctggagtgcagtggtgcgatctcggctctctgcaacctccgcctcccaggttcaagtgattctcctgcctcggcctcctgagtagctgggatttcaggccatgaaagatcactgttttagtctgcgtggtgcagtggaacagatagacctcggtttgaatctcagctctactgtttactagacgtgaaatggggaaatctaaaatgagatgc

SEQ ID NO: 8165 - DNA, 89 bp, Homo sapiens
cgtaccccagactacttcctgtaatgaaattttaaacttgtacagtattgccatgaascatatatcgacctaatggaaatgggaagagc

SEQ ID NO: 8166 - DNA, 325 bp, Homo sapiens
tggcacatgcaggactttcctgtgtaaactagtttaattttgatgataattaagtgttgtggtgattgagagaagtcttacatttggatataatatttatgtgattgaawtttyccatggatttcttcatattattktctatatctcttatattattcaaagttaattaagaagtttttaaaaagacgggtgcagtggctcacacctctaatcctagcactttgggaggctgaggtgggaggatcacttgagcctaggagtttgagaccagcctaggcaacatagagagaccctatctctacaaaaaagaaaagaaaccagctag

SEQ ID NO: 8167 - DNA, 433 bp, Homo sapiens
tacatggcggccttagcaagctatagctgcgagatttgaattactccactcgtagctattgcattcctgacgatggcctctgtggcttcgtgcgattcgcgtccgagctcagacgagctccctggagacccctcttcacaagaagaagatgaggactatgattttgaagatcgggtcagcgactcgggttcatattcctcagcgagtagcgattatgatgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaaaaaaaaaaaaaa

SEQ ID NO: 8168 - DNA, 423 bp, Homo sapiens
tttatcacgctattttctaagaattttatcttttgttattgttataatgggatcttctgtgaaacagggtacttagaaaagaataaagataagacacacagaagcactttacttgaatagctttttcctttttggagcccactgaccaaagatgagaaatatccctgtaataaaaagatgtgtttgtttagcttaggtggctgcaggcagggaggatgcagtcctgaggagccccaggagcactgtggaaagggggaggtggggctgtagtagggttggggtgtgtgttagatgactcttaagagggagtggcatcatgaggaggggtggtcctcaactggctgctctcaagaagctgggggtacttttgtgattaggtattttaatttttatctaggagacaggaggattgaagtggggcag

SEQ ID NO: 8169 - DNA, 418 bp, Homo sapiens
cataaaattcactgttgtacatactgtactacttaatataataatttcatagccaattcttcttgctattgctgtgagctcaagtgttgcagatacacgcttaaaatgctatgtgatgctaatcatctccacataagcaatttgtctctctggtaagttggatgtagcagtaaaaagtgatcacttgtggttcttgtgtatttttcatcatgttaagtggaatactgtaaagtttgaataacaccatggcacccatatggagtgccactaatcatgccagaagtgctcccaagaagcagagagaagtcatgacattagaaaaaaaaagttcagttccttgatatgtactgtagattgaagtctgcagctgcagttgctcaccatttcaagataaatgaatacagcataaggatcataa

SEQ ID NO: 8170 - DNA, 399 bp, Homo sapiens
attcttctacatgtggcttgccaattatctcagcaccatttgttgaatatggtatcctttccccacttttatgtttttgtctgctttgtcaaagatcagttggctgtctggttttacttgtcaggagggactgaagaaagcacaggacgtaagttcctccaagagcattcttggagcagcatctcatcgctgtccttgggtgtagcctcccttttgtgaggttcactccctcagctggaggatgaaccacagtgctgctgcagacctagctgatgtcacagttgttcaaaaggttcctcttgaagaatgaaatccttgggctgccattaggaactgcatgcagttaagccgtataacctctctgatttttagtttctccatctattttataaaataaaa

SEQ ID NO: 8171 - DNA, 56 bp, Homo sapiens
aattgtgtkcgcagccgccgccgcgccgccgtcgctctccaacgccagcgccgcck

SEQ ID NO: 8172 - DNA, 72 bp, Homo sapiens
attcttctacatgtggcttgccaattatctcagcaccatttgttgaatatggbatcctttccccacttttaw

SEQ ID NO: 8173 - DNA, 425 bp, Homo sapiens
ttttcatcctctgtttggtgagcatgtgttctggcatagtgaactgttttgtttttatttatttattatttttttgagacggagtttcgctcttgttgcccaggctggagtgcaatggcatgatcttggctcacctcaacctccgcctcctgggttcaagcggttctcctggctcagcctcccgagtagccggaattacaggcatgcaccaccacgcctggctaattttgtatttttggtagtgacggggtttctccatgttggtcaggctggtcttgaactcccgaccttaggtggtctgcctgcctcacgcctgtagtcccggcactttggggggccggggtgggtggatcatctgaggtcgggagtttaggaccggcctggccaacatggtgaggcccgtttctgctagaatacagaaaatg

SEQ ID NO: 8174 - DNA, 444 bp, Homo sapiens
ttaaatgtatgcactaaacatatataaaaatattcattgtaattttktacagttgtttagaaattagaaacaatattaaatgtttatcaacagakccgcatatacattaaaagattgaggaagaagttgcgaaaagagacatataagaagatattcttgatatctaatcaaaacctacaaaacaggccgggtgtggtggctcatgcctgtagtcccagcactttgggaggctgaggtaggtggatcgcttgaggtbwgaagtttgagaccggccggccaacatggtgaggccctgtcactgctgawaatataagaattggctgggcgtggtggcgcatgctgtaatcccagtacttgggaggctgaggcaggagaatcacttgaacccgggaakgggagtttgcagtgagcagagattgcaccactgcactccagcctgggcaa

SEQ ID NO: 8175 - DNA, 403 bp, Homo sapiens
taatgataataatttgtgttcttaaccaacagagaaagggtgtttatagtactgttattcatggtgcaacagcatttcctggcacacaaatcaaacctctcctgtttgcctttggagtgckgtggcctttggcgagaagccaggtctgcccacagccccaggctctgtcctttctgcctgtgcaaggtgggagccggatattagagaagacttggccaggggctctgagcagagagctgtgctgggaaccctcaggacccctatccactccagcttcctaagatgtgttagctgcatacctctgggtgagaaaacgggcagaggaagagtgactttccgaaggtgatgcgaaccaccagctcttacagaggggagatgccggatcacgsctctgggtgtgaga

SEQ ID NO: 8176 - DNA, 386 bp, Homo sapiens
gatacataggaagatggaattagaccatctcggaccaccaggtttacaattccacctgcagatacatgcaagaagtattgtcacaatacttatgtcacgttattccgttgaggtcatcaccaactaagcttataattaatgtgtggtcaatttggtcaatgtcaccagcgtagatactaacaaaaacaagggttgcaaagtcaaatgcctataaggcagaacgtaagacggtaggaagcaaagtctatagggagctatataatagaggctgcagattcatggcagattctaaagcacagcagtccccaacatttttggcaccagggaccggctttgtggaagacaatttttccacaggcggcaagggatggggcgcaggatggtaa

SEQ ID NO: 8177 - DNA, 438 bp, Homo sapiens
ctatattcatagcatctttcatatccttaaagattctatgtacttttcagcacattgttctgtttcaaggggctctgcaaagtatacttgctgtctgtacatttccactgcgaaaactccttgaaatcatgtagacaaatgaaagctaaacatcaaataaataacctaaactggtaatactcccatttggctctcctttgtgtcttttcatgkgggktaacycythmaaccggdtcagcatataaattgagtatgtatggttatatggtgactttcaaaagtaaatactttttctgtggaacaaaagagatggatttgtggttttccaggattccttttccctgacttggtagaaagatagccaggcatagstcagcagacctgaaaataggtgagctgtcaagttgttggcagggagaggctcctctgggtgggact

SEQ ID NO: 8178 - DNA, 298 bp, Homo sapiens
  misc_feature 107: n=a, g, c or t
cattcattgtaacaataagagggctgagcgcggtggctcattcctgtaatcccagcactttgggaggccgaggtgggcggatcacctgagatcgggagttcaagacnagcctgggccagcaggctgaaaccccgtctctactaaaaatacgaaaaakkagctgggcatggtggcgcatgctgtdrtcccagctactcgggaggctgagtcaggagaatcacttgaacckgggagacagaggttgcagtkagccgrgatcacaccactgcackccagcctgggcaaaaggagtgaaact

SEQ ID NO: 8179 - DNA, 292 bp, Homo sapiens
ggaaacatttctaggtccgagccagcggcctaactggagtgtgcgcattcgaccgagcacagacacgttgcccaccgctcctctcccgaggtctgtagtcgcggagaaacacatgttgcgttactaacgttcagaggtctgcgacasttcgatttgaatgactagccgggaacaccaagtkkcactgtgtaattgcgtccccctactccggcgcctyckttkssrackctccckggagaaaagcacgcccactgcacgcgctcagtcgctacttccgctctcgagtgtctcc

SEQ ID NO: 8180 - DNA, 153 bp, Homo sapiens
  misc_feature 99,103,128: n=a, g, c or t
tcgatactttaaaaagattcatgcttaavaaataataataggccgggcgcggtggctcacgcctgtaaaaatagataataagttacacagatagaaganaganacagagaggaaggaaagahggaagnhaggaaggaaggmaggaaggaaggm

SEQ ID NO: 8181 - DNA, 352 bp, Homo sapiens
aattactttaagctcatgtttaaacaatattgatgttttcctccttgtatagcccaagaagattccagtaatttcagcatcaaataactgttttaaatgaacttaaaatkkgccttggcaammtatcatgaaaatagttaatatgctgcacaaaagcaaaatcatagtacactcctgagctaaatagaagcaatattttgattagatgcattggtyttyattctcttgtggattttgtgaaaatgttatcaaackkgcctgtgcaggtgagttttarcatgcgagccagaggatctcatttctttagtgtggtttatttcgggaaattagatgamtaataagggcataacag

SEQ ID NO: 8182 - DNA, 70 bp, Homo sapiens
caaagcaatattggggaattgatttcacagttcgttaccttagtaggtaacggtaaggttattctctttt

SEQ ID NO: 8183 - DNA, 347 bp, Homo sapiens
agaactctagaacagtgttagatagtattgctagtagtgcccaaacatatcttattcttacctttaacacaacaacttagtattctgcaaagatcctgcagaagtacagtcatgtattgctttaagatggggataccttctgagaaatttttcattaggtcatccaggcacggtggctcaggcctgtagtctcagcactttgagaggccagggtgggtggatcgcttgagttcaggagttcgggaccagcctggttgacatggtgaggccccatctctactgaaaatgcaaagattagctgggtgtggtggcacacgtctgtggtctcagctactcaggacgctgag

SEQ ID NO: 8184 - DNA, 382 bp, Homo sapiens
  misc_feature 192: n=a, g, c or t
ctagcataggccagttcatggaaccagaaagaagaggttagcaagggctggggagatgggcagttaatttcttaataggaacagagtttctatttggatgatgaaaaagtttggaaatagatggtagtgttggttgtacagcattatgaatgtaactgataccactggattgtacacttaaaaatggttaanatgggccgggcgcagtacgcctgtaatcccagcactttgggaggccgaggtggacggatcacaaggtcaggagattgagaccatcctggctaatgtggtgaaaaccaatctctactaaaaatgcaaaaaattggccgggtgaggtggcaggcgctgtggtcccagctgctcgggaggctgaggcaggaga

SEQ ID NO: 8185 - DNA, 318 bp, Homo sapiens
cggtggcccaggcgcgttaagctggttgggacccgggaaggcctccctcttaaggtctttcccacacctctgstssttgttaacctgackkdcggsttcaggatccgcagcgtgcacccgcgttccatctgtcttctgagactttgcccttctccaggaagagcactcaggagaccaggaaaatggccacagggctsstgagagccaaaaaagagctggcaagcagatgaattaactsssccaagckkctagctgtgtttctactcagtgggagagaktkggagtgaatcakgagggtcaaccacacagtgtctacaa

SEQ ID NO: 8186 - DNA, 383 bp, Homo sapiens
cttaagacaaaataattaaacatttggaacatttgaatttgaaactttaaaaaaatgttgtacgaaattttactacgtgtgatttaactgctatttgtatgaagttgtattggattacattaagttggaattgtgattatgtctgttttagttgtttaaaagaattttcctattatatggtatccaaggatgtagacacattagaattataagaagacatgaggagcaaatcatgaagagcggattggtctttgttcaacaagagctggcagagtagttaagacaaggrgttcaaaaattccatgaatcttggccargcatggtggctcatgcctgtaatcccaccactttgggagggtgatgcaggaggatcacttgaggcc

SEQ ID NO: 8187 - DNA, 430 bp, Homo sapiens
tagttttatgatttgacatcacccatcaaaattatacaagcataaatgttctaagtcatcattctcatttgataccagacttaaaaaggttgagcaggcagagaatgggcaaaaggtatcagtgagggagacaaataagataaattgagcatgatccttgatgctgacaaacctggttacagttattttaatgtgcataatacttgcagtggtgaaggattgctgccattcacaatttgtgcatcatcattatgtccccaggagttgtcagcatccccactttcatcagctttacccagaagatgcaaagatgctcttgtcacagaggaaattatccctgacctattctgagctcagaaatggtcttctcccctcattctaaaccagtattttaaagtgtattcttagctactgaactgagtttggaaaa

SEQ ID NO: 8188 - DNA, 370 bp, Homo sapiens
tacatttataattaggaaaaggatagtttcttttaaatggtagaacttccccaatgagtcagctacctgtatttctggcctgtcaggcwagacactggagaccattctgcatagaattgtacctccctgaactactgttaggccttagggtggggattcatctttcccttctmcccaccatggagacaaaatcctcttaaacatatccgggcctggcatggtggctcacgcctgtaatcccaacactatgggagtccgaggagggtggattacctgaggtcggggratttagaccarcctkamcaacatggagaaachcggtctctactaaaaatacaaaattagccgggcatggtggcacatgcctgta

SEQ ID NO: 8189 - DNA, 283 bp, Homo sapiens
ctggggtagattattgcctgccccttatacataggaatatgctgcataattgcgcataacttccatctcccttactggsyttgtaggcagaggaaactgtatatgttactgccttgtacttttctcatacaccaaaaacacaccaaaaaaatcaataaaataagcaatcttctattctcattccttttcccagcagcatattttagaggcacatacaaaacctacattctctagttgggagtggatttttaaagttttccttttatcttttattttttttttk

SEQ ID NO: 8190 - DNA, 379 bp, Homo sapiens
agaagacccggccgcccagatgatgcggtggtgggggacctgccggcacgcgactccccccgggcccaaattgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcasagccagatctgtccaaagcagtttcactctcaatgggactgtatatgggagagacagaaacaaaagtgatggga

SEQ ID NO: 8191 - DNA, 63 bp, Homo sapiens
atactttctttgcattttgtcacacaaaatattaaaaagatatgagctcaaagattgagattt

SEQ ID NO: 8192 - DNA, 50 bp, Homo sapiens
ctttccgctcggctgttttcctgcgcaggagccgcaggccgtaaccacca

SEQ ID NO: 8193 - DNA, 310 bp, Homo sapiens
gccgccgggggcttgggagccgccgatcccggagcccgagccgggagagggagccgccgcagscgccggcgctggtdgagakrtkctctaagccgctktsatcatgggagaaatagagcagaggccgaccccaggatcacgactgggggccccggaaaattcggggatcagtaccttggaacgtggacagaagccgcccccaacacctkcaggaaaactcgtgtccatcaaaatccatatgctggatgacacccaggrggcatttgaagttccacaaagagctcctgggaaggtgctgctggatgcagtk

SEQ ID NO: 8194 - DNA, 157 bp, Homo sapiens
acagttggtggtaagtatttggctttatttctgggttctctattctgttccattctatgtgcctgtttttatgccagtaccatgctgtttttggtaattacaggcttgtagtataattagaagtcaggtaatgtgatgcctacagatttggttttty

SEQ ID NO: 8195 - DNA, 183 bp, Homo sapiens
cagcaagatgatacaacaattttaaatatatatatgcacccaatatgggagcacccagatatataaagtaaatattaatagagctgtacagataaataggtcttctacaataagaacaagagatttcaacaccccacttctggcactggacagatcttccagatagaaaatcaggccgggcac

SEQ ID NO: 8196 - DNA, 408 bp, Homo sapiens
agacacatgagaaaatatgggaaagtcggagagtggaagaaaatgtaaagacccccctcctccccaaagagtacgttgtgtagtggggtagagtggaaaatcaatccaagaaaagtagcaaacggacccaaagatgaagaggaagaaaagaaacagcaacacgaaacgaaaaaaaaagccaccagatttgttgcaacgttgatgtaaacctggccgtctgaaccagtgacccagggtttccgcttccctttgctgtcatcttgctcaagtctagaagctgaaatatcatcatcaactcgacatgaggggataacctctagatccactcatcagatgctcatcagacgttccaattacaaaactgaacctcttcttagtgctggggcggttagaatgcaaacatttcaa

SEQ ID NO: 8197 - DNA, 460 bp, Homo sapiens
tgaatgctatgaggaagatgcatgcttacctcattggttattatgaagcgccttagcctactgagttctttttgtgtgttacttgkttattatggcttatactccggccccacctcctgaagcaggaagggccaaatcgcagaatgatgagtttatttcctgttcacagtggaagaatctaggtactgatcaagcatcgttttgcagagtagcacagactaccctatgaggttggtccccagatggatctgtatgttgtctctgatagcaaattaaatccattaaagtaataatggacctcaggtgaagagagcagcagtctctggagggagctgtgagtatgaacaggtgattgggtttaagagaaacttccatatttcattttggttttaaaactgtttggtacccagtcagccacaggccttatgtatcaactggatgaaataatttaagaggccta

SEQ ID NO: 8198 - DNA, 459 bp, Homo sapiens
tactaaatatgaaaataagtcatttgaaaaaaatacagtatgtaaaatttgttcattcgttgaggtaatggtgctatgttttttacaaaattgttcctacaccttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagagtagaaaatgtttaggttaaagagcatctgtcaacagaatctacaaaaaagattcccttgcatttgaattagttctctattctcctattgctaaatgtgtgatatatagagaggatgtataaaaggaaatggaaatagactatgtacttgtctgg

SEQ ID NO: 8199 - DNA, 447 bp, Homo sapiens
aaaagttacgtgtgaccttgcgacgcgtgttgcgctccggtcgcataagcgtcagtgcctgtcgctgcggctgcgtggcgggttgtccaggtaaccacgggagttgtcgctgtctaggagcatctgaaagacaggtgtgcgtcatgcacttgaagcacctgaggacccccctgagccctcaggatggagctgcaaaggtgacctgcatggcttggtcccagaacaatgccaaatttgctgtctgcacagtggaccgagtggtcttgctgtatgatgaacatggagaacggagagataaatkctccaccaaaccagctgacatgaagtatggcaggaagagctatatggtgaagggcatggctttttctcctgattccactaaaattgccataggacagactgacaacatcakctatgkctacaagattkgagaagattggggtgaca

SEQ ID NO: 8200 - DNA, 62 bp, Homo sapiens
gaagggatagaggccttggaccaagatatacaggtatctttttttttttttttttttttttt

SEQ ID NO: 8201 - DNA, 398 bp, Homo sapiens
caagtctttaaaatagttatgttcaaaatgaataaatatattaatgaaggaataaaaaaagagaaacaaagctcaacaaatagaagaagctaggtagatttgaaaaaagaatcaaatagaacttctagaacaatatagtagtcactgacattagaaactcaaaggaagagttatggagcagattagatgcagctaaaaagagaatcagcaacttagttaaaatcagtaagttagaaagtttatgaataaagaagagtgcaccagaaatagttaaaaagagattctttctttggataaatgaatacatctttttgggttatattggactagaagatcttcattctctaaggtgacttttatacatttctgttctgatccgtgctatattataaagtcag

SEQ ID NO: 8202 - DNA, 448 bp, Homo sapiens
aaatctattaaagactcaaatctaagatctgaaactatgaaactaccagaggaaaacactggagaaatgctctttgsawtcaccatgtttatkgcagcactgtttgctgcaataaccaagataatggagtcaatctaagtgcccatcaaagagcgaatgcataaagaaaatgtggtatatggttgagtgaggtggctcacgcctgtaatctcagcactttgggaggtggatcacttgaggtcagttcaagaccagcctgcacaacatggtgaagccccgtctctactaaaaatacaaaaattaaccggtggtggctcatgcctgtagttccaactactagggaggctgaggcchrrgaattgcttgaaccctggaggcggaggttgcagggagctgagattgcgctactgcactccagcctgggtgacagagagagacgctgtctcaa

SEQ ID NO: 8203 - DNA, 429 bp, Homo sapiens
  misc_feature 310: n=a, g, c or t
ataaacttagctgggctactcaggaggccgagagaggaggatcccttgaacccaggagtttcaggctgcagtgacctgtgattaaggccaykgcactccagcctgggcaacagagcaagacactgtctcacgaaaaaatattttaaaaaagaatgatgaaaatgtaatatgtcatttgggaacatgtcctaataatgtaataacatgtatatgtrgaataagttcatttttataaagcaagcatataattgtataaaagtacaaaaaaatggccaggcatggtggctcatgctcgtaatcccagcattkngggaggccgaggtgggtggatcgccagaggtcaggagttcgggaccaacttggtctacttggtgaggcctcgtctctactaaaaatataaaaaaattggctgggtgggcgtggtggcag

SEQ ID NO: 8204 - DNA, 344 bp, Homo sapiens
ctagcagctccatttttgtctgttttgcgtattagatttctgcttaagattacttgtgaagaaaagaatttgagaacattacattatgggagaggtcctaaccattatttagtgcagaatattgtccctaattttagatttgcctctccctgccttctttccttttttttcacaaagatctggtaaagccctgcttgtgccagtcgctagtaagtttggaggttttatagagatgagtaaaaaagccttaagttcaggaccaggtgcggtggctcacgcctgtggtcccagcactttgggaggctgaggctggcggatcttgaggtcaggagttcgagaccagc

SEQ ID NO: 8205 - DNA, 85 bp, Homo sapiens
ccactatggcttccagcactgtcccggtgagcgctgctggctcggctaatgaaactccctctcaaaaaaaaaaaaaaaaaaaaar

SEQ ID NO: 8206 - DNA, 321 bp, Homo sapiens
  misc_feature 146: n=a, g, c or t
actaaaaacatttcttgcagaaataggaaaatacatcctaagattcataaggaggccgggcgcggtggttcatgcctgkaatctcggcactttgggaggccgaggcgggctgatcacctgaggttgggggttcaaaaccagsvtgnccaatatggaggaaccccgtctctgccgaaaatacaaaattagccgggcgtggtggtgcatatctgtaatctcagctactctggaggctggggcggcagagtcgcttgaacccaggagccggaggttgcggtgagccgagattgtgccattgcactgcagcctgggcaacaagak

SEQ ID NO: 8207 - DNA, 452 bp, Homo sapiens
  misc_feature 322,325: n=a, g, c or t
catgacttagtatttggtaatggacccaaccttaaagaaaaagagtattttattaaattaaataaacatttcttaggctgtgaaataaaatcctgagaagagtctttgattaaggtctctacatgaaggaaagagatctagatacttaaatgaactacaagttcatctgcagtatgaacttgggagaaactggatctattgactaggaggccttctcagctgccagggtttccttatttccctttattcattgtttgtctgggtgctaggagcaaaaggtaatatttttaggcagtctttctgtttgaaatacaaakkatknbancaacttggtattgaattgttgctttatatcattaccttgaaggtaacaaagaagtgaagcgctggctgggcacggtggtttgtgcctggggtcccagtgctttggaaggctgaggcaggaagattgc

SEQ ID NO: 8208 - DNA, 231 bp, Homo sapiens
caatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcaaaaaaaaaaaaaaaaaaaaaaaaaaaaaaaaaaaaaaaaaaaaar

SEQ ID NO: 8209 - DNA, 490 bp, Homo sapiens
aacaaaaactgctaaacaaggagttatttaagagcagataaattccctgaagcctcaaggttggtgcagctgtagctcagtcgtgctttatgtctaactgagaattgacatttagaatgaagaacctgagccctgtatgatgctgagtcctatatggggacaaatcattttaaggtactttgttgaagaaggattatgggcaaaaatattttaaagcttttttaatcagctgaggttgaacaatagtggtaattggccgggcacggtggctcatgcctataatcccagcaccgtgggaggctgaggcaggcggctcacttgaggtcaggagtttgagaccagcctggccaacatggtgaaaccatctctacaaaaaatacaaaaattagctgggcatggtgatatgcgcctgtaatcccagctgcttgggaggctgaggcagaagaatcgcttgaactcgggaggtggaggtcrcagtgagctgagattc

SEQ ID NO: 8210 - DNA, 297 bp, Homo sapiens
actgccggccggacgccatcttgctggtttgcggccggtcttggatgaagcggcggccgtggtgagagcgtggggaagggtggggtsaggggrcgaggccgcagctagggcggcgaaactctcctcccctcggccccaccgcgtgggacggcgtgaacgtggtgtcggagggatgtcarccttctctgagrcggcgctggagaagaagctgtcggagttragsaactcgcagcagagcgtgcagaccttgtccctgtggctcattcascascgtaaacactcgcggcacatcgtcam

SEQ ID NO: 8211 - DNA, 167 bp, Homo sapiens
acagttggtggtaagtatttggctttatttctgggttctctattctgttccattctatgtgcctgtttttatgccagtaccatgctgttttggtaattacaggcttgtagtataattagaagtcaggtaatgtgatgcctacagatttggttttttttttttttttb

SEQ ID NO: 8212 - DNA, 403 bp, Homo sapiens
  misc_feature 257,270: n=a, g, c or t
caagaagtagaattttgggtcagaggatatgatcgtttaaaaacaacattgtttgatcagattggcagatacttaaarawkgggtggmcaggagccattgctggcaaaggtttgggtaaggggcacttgagtatgctgctagtgacagggaattctacacatttgtgcatagaatctgggaatgactattaagatttatttattccctctctaggtaaaatccctctctaggtatataaataaataataaataaatnvtcagtttcagcngggcacaatggctcacacctgtaatcccagcactttgggaggccaaggccgatggatcacttgaggtcaaggagtttgagaccagcctggccaacatggtgagaccccatctctactaaaaaaaaaaaaaaat

SEQ ID NO: 8213 - DNA, 466 bp, Homo sapiens
aagccatcgcccgagccgccggcgtctcctcccgcccagcagttcctccacgcaggggctccggaatcgsccgaccggamamsgktggccaccckgaggtctttctggaagtggatatctactcagacagtaagaattataagagctgtaagagctcattttggaggaataatggatgaaccatctcccttggcccaacctctgtagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggcttgcacataagttcttggattaaaaggtctggatcagtggttcttggttctcactgttcatcagaatcacctcggggagc

SEQ ID NO: 8214 - DNA, 389 bp, Homo sapiens
tacacataatctatgaatagcttaatcctttatatattccttaaaataggaattcctcgacatcactcctggccamacttttcytggcctgtgttgttgckatgtgtatttgaaagtaatatctgcattccttttaagatgttctgtaagtcatatttgtcagttatacagagtagtcttccttttccccacgttcagtgtaatctcactgaacagtaataatagcaatagckaacaacatctgcacagcaccttacagtttgcaaagaacgttcacacattctcatttgagttttgcatagtgaacctgttacgagatgtctcttgacgtcgatgctaaaagtgttagaatctttacatcactagagtcattgaatatgctgtagtat

SEQ ID NO: 8215 - DNA, 428 bp, Homo sapiens
  misc_feature 108: n=a, g, c or t
caaatgtttcttcatgctttgttcagttttctgcaagtttatatctgccataagatagggctactcatcttcaattttgaaaggatggattgtgctacttagtaactngcacaacaccttacatcccattaacccaagagcaggaacaatactggtttgacactgctaaatgtcagtcctatgcttccagtatccgaggcgcccattttaaaagtggttaaggcactttgggaggccgaggcgggtggatcacaaagtcaggagatcgagaccatcctggctaacacggtgaaaccgtctctgctaaaaatacaaaaacaaaaagccggatgtggtggcgggcgctgtagtcccagctactcaggaggctgaggcaggagaatcgcttgaamccgggaggcagagcttgcagtgagctgagatcatgc

SEQ ID NO: 8216 - DNA, 403 bp, Homo sapiens
agcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggaca

SEQ ID NO: 8217 - DNA, 368 bp, Homo sapiens
caagaaggaaaatttgatgaggaaggaaggaatggatatcttcagaagggcttcgctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgcctccaccatccctaatatcttctaattggtatcatataatgac

SEQ ID NO: 8218 - DNA, 292 bp, Homo sapiens
gcggggctgctggaggcggagaggcacggaggagccgctggggctgccgccacggccgcccggagtcctgggtcaagctgagtatctbcacgtttaggtgcacaaatactattttgtgaagatcttaaathtgtggtataagaacttgaaggaaatagaactgatttgttacttctaaaagatttgtaagactccaggcctcccagccgtgaataatctgatggttcctgaaatgactggggaagcagacgcttcgtatggcagttgaagagtgtgtgtctatgtgcattta

SEQ ID NO: 8219 - DNA, 377 bp, Homo sapiens
atctcattgtccaaaagccatgatctgctaagtttcaattccttgatacaatctgggaggcctgatggttgctttcctgagaaaggaactcagatttcaaaaccaagatcaaggcatggaaagtgagactaactacatcaggccagaaatgaaaagcaacttaggagtcaattttagaaacatcatcagtggtgtagaagagctcagggaagcaaggagggctgctgtgaatgacaccatgaatttctgaatgtgatgtcccttcaattcatgagtccaacttcaaagcactgacacatttggtgtctgatgatgtccagctttctcatagacggctaccttcttctcactgttacctcatatggtggaagtgagtg

SEQ ID NO: 8220 - DNA, 386 bp, Homo sapiens
cattcaaaaatccaaagggattacttagatcctggttgtcagcacatagaggttactcaagatcttaaaaatgaggagataaggccaggcatggtggcttacgcctgtaatcccagcagttttgagaggctgaggcaggcagatcacttgaggtcaagagttccagactagcctggccaacatgaggaaaccccatctctactgaaaatacaaaaattagctgggcgtggtggcatgcgcctgtdatcccagctactctggaggttgaggcaggagaattgcttgaacctggcagcggcagaggttgcagtgagtcaagactgcaccactgcactccagcctgggagacagagcaagactctgtctcaaaaaaattcttgttgtga

SEQ ID NO: 8221 - DNA, 50 bp, Homo sapiens
  misc_feature 2: n=a, g, c or t
anttgtgttcgcagccgccgccgcgccgccgtcgctctccaacgccagck

SEQ ID NO: 8222 - DNA, 359 bp, Homo sapiens
  misc_feature 65,94,183,219: n=a, g, c or t
aaaatcctgcattctatktaatgtcatattttttcaagacagccatctagtggcaaatdagaganatgaaggrtcccmaggkdcrcvatgarantbgtttcattagtatgcctatgagadatgaagtttgctgtgttactgaatgtagcagatgtttcagttggtatgttgcatgtatatganaaaatacacataggcaatcacaaatttatattttknrrtattaagagtaagctgggcgggtgcagtggctcacaccttaattccagcactttgggacaccaaagtgggtgtatcacctgaggtcaggagtttgggaccagcctgggcaacatggtgaggccccgtctctgcgaaaa

SEQ ID NO: 8223 - DNA, 468 bp, Homo sapiens
cctcttttctctgtatctctctgcccagttgcttagaaatgcttctgtttgtgtatttgtatccaccttctttggggagagttatgaccctggtccttatgccatcagtggtattgcaattttgtatgtagcatgaccatttttaaaaatgacatttcatagtgagtgattcagacacctatcattcagcttacctgccggggccctccaaaatgagcagaaggcctctgtctcattctagaagcttgaaggtctccacgtggtttgcccaggggcccacaacctccctgcagtccaggagtgctcccattaaccccagctgtgtgattcaggccagattcttaggactttttaagtgaaatgggacagaaaattgcttgatgtattttgccacatgaagtacattttgctgccgcttagttctttattgtcgttagattaaaaactctcctaacgttgtgtgggtaa

SEQ ID NO: 8224 - DNA, 407 bp, Homo sapiens
atttggaggaaagaagccacgatgcctttttgagttcccatggcagacatccagctgatcacactgtgtccacataaggcaaatgctgagctgtaatccatyaagckgtttccgcmtagagaaaaggccakatgagtacacagccagaaggkgtctgcctacaagacaaagagggaaaacttacctgaaaccaaccctgatggatattggatttctaagctccagaactgtgagaaaattaattttatgtgctttaagacactcaatttgtggtattctgttatggcagcctatgctagtcaatttgcattaccataaagcaacacctgagagtgggtaaattataaagaaaagaagttgaatcggctcatggttctgcaggcagtacagaagcatagtgctggcaa

SEQ ID NO: 8225 - DNA, 83 bp, Homo sapiens
cgaaagtgtgatgttctaccactttaccaakaactrattttaaatacacattgtcctctcgatttttggaccaaacagacgck

SEQ ID NO: 8226 - DNA, 473 bp, Homo sapiens
cagtatatggagagagtgaccatttcccaaatattcacaagcacatagtggggctgaccaagggccttttattcaaacagttgcaagaatccttaatctagagcaakkagcaacaacatttaactgaattgtgttactcatgccagaaatatttctgagaatttcactaggacagacaaattaggactgtaaaagtatatctgtatttgtgcagaatctctcataattcatctaatcaatattgactgtacatcttctgtgcattagtgattccagctatgaactgtttctcaatgcactgacaatttttgaccaatgtataaaatttatttgtgctacacctttgtatgcgtattgttacagtgatgccatatagagtggggttcaccttgctttaagaggttagaagcaactataattaattkcaagccactgtcacagaaatattgggtgtactggaaaaagacatgaat

SEQ ID NO: 8227 - DNA, 535 bp, Homo sapiens
taaagcaaatgggtaaaatgtcaacaaaaggcaaagataaacagtatagatatatatctatgcctatggaagatagaaggtacacaatttttttttactactttttcctacaactttgaagattggaactcattttcagataaaaagttttaaaatgcatggaaattatcaagtagatatcacaaaatgtctgtcaaaggacatttgctcttaatccccagtttgtctttatcttttcatgtgtttggagatgatatctctgctctttcttacagatgaagttgtttatttgtctaatatttgatgttgaaacaactgctgtcaaagattgtatgggactctagccatatctttgagtttagacaaagactggaagagtttagatttactgtcattttactttttgtcagatcagagctttgatagcctagtgattccagctttttaatactctgagatctccaaaatggatgatgtgcacatgtgtaagatgcatgaggccagcatttgggtgtgactctatcactttttgtcc

SEQ ID NO: 8228 - DNA, 378 bp, Homo sapiens
agactctctggaaagcctgggagctgaattccggaagatccccacatcgatgaaagcaaagcgaascamcaagccatcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagamagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagag

SEQ ID NO: 8229 - DNA, 432 bp, Homo sapiens
  misc_feature 113,297: n=a, g, c or t
caaattgcttttcagaaagaatatgccagttcacactacctacagcatatataaagagaattcctagctgggcacgggaawtcttttttgtacttttagtggtggcgtatgcntgtaatcccaactacttgggaggctgaggtgggagaattgcttgaacccaggaggtgcaggttgcgttgagcagagatagcaccgctgcattccagcctgggtgacagagcgagactcagtctcaaaaaaaggaaggaagaaggctgggcgcagtggctcacgcctgtaatccgagcactttgngaggctgaggcgggcagatcacgatgtcaggagttcgagactagcctgaccaatatggtgaagcccatctctgctaagagtgcaaaaattagctaggcgtggtggtggcgcgtgactctagtcccagatactcag

SEQ ID NO: 8230 - DNA, 404 bp, Homo sapiens
tctctaggcaattaaactatttaaaaaatcaaatgtgattatttcttcttttataaacaagtgctttttcccccaarcctamccsattgttttccaaccctccagagctatgctacattgtctgatttgtttctgtgtaacctaaaaatgtttttctttcattcttgtctatattacttttaacgtctacaataacaagctrtttgaacatccatctgttatcagacatacttacatcccccacacacaagtcttaaaagtctggcwgtgatctaaggcttcattgtccattttcttgttcttcacagtaattaaggcttttaggtgtggttatgggactatttaagataaacagacaggatccaaggtactttckactttcagtcacgtagaagttgcctgcy

SEQ ID NO: 8231 - DNA, 72 bp, Homo sapiens
gagcctagattrtgccattgcactccagcctgggcaacaagagcgaaactctgtcccaaaaaaaaaaaaaaa

SEQ ID NO: 8232 - DNA, 410 bp, Homo sapiens
caggtgtgatgctggttatactggacaacactgtgaaaaaaaaggactacagtgttctatacgttgttcccggtcctgkacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacwrcaagagcgtccacgaggttaatctaaagggagcatgtttcacagtggctggactaccgagagcttggactacacaatacagtattatagacaaaagaataagrcaagagatctacacatgttgccttgcatttgtggtaatctacaccaatgaaaacatgtactacagctatattt

SEQ ID NO: 8233 - DNA, 356 bp, Homo sapiens
  misc_feature 279: n=a, g, c or t
aagcaacgggatgccttggaaagcatcgttctgcagcaggactgctcaaccggccaatcagaacacagggaaccatgaaagagaggatagtgcatgcccagcatgcagactcgcttccatcgcgacacagaggacagcatggagcccagctcgagtgccgtccccccaccatgacagcgcasatgggccttccaagccacagagccacagggaagccagtcctcctggaccgtgtgtggctgttttggagccagttgtgtcctgtgaagagcgcaggcncgcaggtgaggcaggagtgaagatggaggaggcggccatctctctggggcctggcaacagcgagagcttttgccaag

SEQ ID NO: 8234 - DNA, 122 bp, Homo sapiens
accccatccgctggctctcacccctcggagacgctcgcccgacagcatagtacttgccgcccagccacgcccgcgcgccascaccatggctaggtamcaagcgactggggctgtccggactg

SEQ ID NO: 8235 - DNA, 452 bp, Homo sapiens
tgtttttcagagttgtataggttaaggtgttgggaactccataacccatggttcttgcctgtagttctaaaattctcacatttagcagtctgcactcatcaaacatctagttgaactagatgactgattaatcacctcgtgattcattgtgttttacttctcatctaggaaataaaagattatttctgaaattagggctgacttagttaataacggtttatcgtagaaagacagtctgttatgtcttactgtcctatataactaagtgataaggttatgacaacatttggtaatgcagtttaacaattttgttttaaatagaatgttcgttgaatacctggatataaatgtttggttagcttgcagatccaattcaaaagtttaaaaatttcagagcctgcccttggggaagtcagtgtggtgattcctcagggatctagaactagaaatac

SEQ ID NO: 8236 - DNA, 155 bp, Homo sapiens
acagttggtggtaagtatttggctttatttctgggttctctattctgttccattctatgtgcctgtttttatgccagtaccatgctgttttggtaattacaggcttgtagtataattagaagtcaggtaatgtgatgcctacagatttggttttt

SEQ ID NO: 8237 - DNA, 432 bp, Homo sapiens
ctgctgtttaaataaaatagaaacaatacaaaatggaacgtaattgagtgtgaatttgtgtgattcaggcggtaactgttttacagaaaattagagatgagacattgatataaacaaggcttcctagtttcttgttttgttttaagacagggtctggctgggtgcggtggctcacacctgtaatcccagcacttgctaactgaagatgcaaggaccgaggcgggcagatcacttgaggtctggagttcagggacagcctggctagcatggtgagaccccgtctctactaaaatgcaaaaataagccagccattgtggcatatgcctgtagtcccagctgctccagaggctgaagtgggaaaatggcttgagcctgggaggcagaggttgcagcgagccaagattgtgccactgcactccagactgggcacaa

SEQ ID NO: 8238 - DNA, 444 bp, Homo sapiens
  misc_feature 41: n=a, g, c or t
ttcataagttttaaagggcatggtgctcccagcaccagaanactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttg

SEQ ID NO: 8239 - DNA, 445 bp, Homo sapiens
cctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtgttctaagtgctgactggctacgtagttcgggcaaatcctccaaaagggaaagggaggatttgcttagaaggatggcgctcccagtgactactttttgacttctgtttgtctt

SEQ ID NO: 8240 - DNA, 455 bp, Homo sapiens
tacaaataacctagctgacaaagaaatcaagaaaacaatctcatttacaataacatcaaagaaaaacatatacttaggaatgaatttaaccaataagacggaagatgtgtacacttgaaaaccataaaacattgatgaaagaaatttagatatgaacaaatgaaaagatatcctatgtttatggatcagaagaattaatattgttaaaatgttcacactacccaaagcaaatatatagatttdacacaatcctcatcaaagttctggtggcattcttcacagaacagawaaaaacaatcctggccaggtgttgtggttcatgcctgtaatcccagcactttgggaggccgaggcaggtggatcacgaggtcaggacttggagaccagcctggccaatatggtgaagccctgtctctactaaaactacaaaaattagctggatatagcggcatgtg

SEQ ID NO: 8241 - DNA, 189 bp, Homo sapiens
agaagtcaaggaactggaggctgaggaacccagcggaccacgaaagcagggagataactagacagcatgctcggctggaaggaccaaagtcagagaaggaaaaatgaataagaaaatgagcagtcagaggcagctagggtgacggacagacagcatgaagcgcasagaatgaatagccagaagactcgg

SEQ ID NO: 8242 - DNA, 450 bp, Homo sapiens
tcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagtagcaaacattgtgttggggttataataattcattaaatgtcttgttgcctgtaaaaaaaaaaa

SEQ ID NO: 8243 - DNA, 243 bp, Homo sapiens
ccatttctactaaaaatacaaaaaaattagacaggtgtggtggcagttgcctataatcccagctacttgggaggctgaggtaagagaatcacttgaacctgggagtcggaggttgtagtgagctgagatcgtgccattgcactccagtctgggcaacagagcgggastccatctcaaaaataaataaataaatarracccaccackacrraaaaacagaawwattacccaggtgtggtggtgt

SEQ ID NO: 8244 - DNA, 463 bp, Homo sapiens
taagtcttaaatatgtctaatttggaaaaaatatatttcacaaaatatgaacatagaaggcaaggcttctggtagtataaggctagtagctatgattacttacccattatatgatatacttaatctagcactaaaccaagtgtttagcacctaattaaaaagggccaggcatggtggctcatgcctataatcccagtgctttgggaggttgaggcaggaggatcaattgagcccaggagttcaagaccagcctgggcaacatagcaagaccccccatctctacaaaaaatttaaaaattagctggacatggtggtttgtgcttgtagttccagctactcgggaggctgaggtaggaggattacttgagaccaggagtttaaggctgcattgagttgtgattgcaccactgcactccagcctgggtgacagagcaagactctgtctccaaaaaaaaaaaaaaaa

SEQ ID NO: 8245 - DNA, 446 bp, Homo sapiens
tagggctaattgttctcaggttgagagaataggaactatcgcatgtcggaatttatgtaatttaaaggatggctttaaattcacaataaagacaaattttgttaagtaccagccacatcgttcatgtttcataggaaagattaaaaaaggccttcaaagccaaccatgtttgtttcctgtttttatccttcctatgaaggaccaacagtgttggttggtacttgaggaaatttgtttttattgttggtttaaggccattctttaaatcacataaattcaggtctgtgatatctccttttctgtcaaattgagaacagcttcattactttatctctgcaagtaggatgtgaacagtataaatacagacttggtgcgtaastactcctggagccattggggcctgaaacggcgccttgtgtattccacaaacgcgttcctactgctaa

SEQ ID NO: 8246 - DNA, 473 bp, Homo sapiens
ttaccaaaacagaaatagtcattcagaattacttcaattgattttctaaaaggctgcttggagatactttctttggaaatagtcactagaattacagtagtttaaagctaccagaatgaaatattctggtttctgattccacttagtaaggtaacatattctgtagaatttgacagatttaacattgtgagaggactcagttcatgaaacaaacactaccatcttttttgttgttgttgtaattaaatgaccctaagaaataaaagtggaatgcacagtctcactgtaatgtgatttactaggatatgagctccctgagggcaggggcttgatctgttttgtttcctgatgttcttttcagtaggtggttatatttgttgtatgaatggatgatgaatgccacagagtaagcacaatgttttgttatttgaaattttgttaaaataactactaagatgtctggaaaacacatt

SEQ ID NO: 8247 - DNA, 549 bp, Homo sapiens
  misc_feature 155..156,159: n=a, g, c or t
ccagcttgagtttttctgtgtattacaaaataagaaaacaaaaatgacacaataatctattttgtctggttttgctctttattagtagaaatagacaagtgaggagttgaaggaagaaattgcttctgatctgttttagatacagatgaaactcnnccnmmctmcccgccccacccaatctttctctgtctccctccctgagcctattcttgcttcttccctttacaaataattaactgctcaggtcatgttgaaccaaaaaatagcatctgtagcccctgtgtgcttactttaagtatatgtwactgaaaaatgcggagtgagcacttacaactcattctcctgggaagcacagtgatactataccccaaatgcttttctttatcattttaattkttatcttctttacttacatttccaacatcagttaagagggtcttgtagttttctaactgaaaggagattgtaaaatctccttgctcaaaactcagatgcagaatattatttkkactacaataaatacatctacacaatggtattatatctggt

SEQ ID NO: 8248 - DNA, 506 bp, Homo sapiens
  misc_feature 262: n=a, g, c or t
caccaccacgcctggctaattttgtatttttggtagaggcagggtttctccatgttggtcaggctcgcctcgaactcccgacctcaggtgatccgcccacctcrgmctcccaaagtgctgggattacaggcatgagccactgcacctggctgtttttctatttttttaaacagagttattgaggtataattcacatgccatacaattcatccatttaaaatacacaattcaggccaggcatggtggctcacgcctgtaatsncagcactttgggaggccaaggctgggggatctcctaaggtgggagttcgagaccagcctggctattatggtgaaacccgtctctactgaagatacaaaaaaattatccaagcgtggtggcaggcgctgtaatcccagctactctggaggctgagtcgggagaattacctgaacctgggaggtggaaattgcagtgggccaagatcacaccattgcactccagcctgggcaacgagcaaaactcc

SEQ ID NO: 8249 - DNA, 525 bp, Homo sapiens
ctgtaacaaaagatgccaagccctctgtggcttaacacagtatatgttttatttctcgttcatgtaacagtttagtgggtgtttagtgggacatgttctatttggcaattcaaggacccaggctccttctagcttgtgggtttgccatcccctggggctgcagagccttctgctggaaactgtgcttctggcaggtagatgagagaagagagaaacttagaggatcttagagaatctgggtggcaggtatggtgaggaaattgacggtcacaggctattggccagaaacagatcacatggctgcctctcattgcaagggagcttgggatataccgtctagctgagtgcccaggaggaaaagggacaggaggtagggtgagcagcccgacttccttaggcttcagcagtgaggagactcatccaggccacatgaaaggaggaggcacgcctcacctcccatgctcctcctcgtttgaaattatgtgtgtcctggaccagtaccccagatgggagggtatagtggac

SEQ ID NO: 8250 - DNA, 435 bp, Homo sapiens
taggcagaagctcgtggcgttactgagtaacagtgatatttacgggtcttcagggtgtgttaatgaaatcactaraaaaattttttttcagatgctaaggtttatgtgttctcagtcttcaccgagtcttcattgataatgtttaaaactgctagcctgaggctgggtgtggtggctcacgcctgtratcccagcactttgggaggccgaggcgagcgaatcgcttgaggtcaggagttcgagaccagcctggccggcatggtgaagccccgtctctactaaaagtgcagaaattggccgggcatggtggcgggcgcctgtggtcccagctactcggaagttgaggcaggagaattgcttgagcctgggaggcagaggttgcagtgagctgagattgcaccactgcactccagcctgggcgacagagtgcgactc

SEQ ID NO: 8251 - DNA, 413 bp, Homo sapiens
aacagttttggtgagcccaggcaggagaacaagtcactctgctcagtttagaggctgtaaatgggaccctgggacaaactaacaaaaaagccagccaagaaagctatctacagtttacgggaatatgggaaggtgtacttttgtgtgcagaattgaaattttttttctccctacctgatccctccagagtttggagactattttcagagtgactctacacacttcctgcttccacgtttagcatccccaagtgaagagatatgaagagtgttcaaaagatgctacaaaatgagaggaggagaaccagtgtgagcttttattattctgccagggaaatgtcctgggcatcctgttaattgaaatggacaacttcctaggctcaaaaaatctgtcaggtggacttgttgcagcaa

SEQ ID NO: 8252 - DNA, 299 bp, Homo sapiens
  misc_feature 58: n=a, g, c or t
gattcaagaatctttctttgctgaaatgaactcggctaaacttaattttctaaaatdngtcttttaacacttggktaaggtggtgtctgataggtttctccctattttwccctttccagtctatatacagaagtgggtctacatgtccagcccacactcaaggggaaaggaaataagctccattttaaatttgtggttatatttktaaattaccacactgattagtaaattcagggagagattctttgagactatgcaaatacctatttctactttkctactgattttagttatcattb

SEQ ID NO: 8253 - DNA, 350 bp, Homo sapiens
  misc_feature 243: n=a, g, c or t
caaatattagctgggcttggtggcccacaactgtagtctcagctacttgggaggctgaggcaggaggattgcttgaacccaggaggtggaggttgcagtgagccaagattgcaccactgcactccagcctgggagacagagcgagactccatctcaataaataaataaataagtacttcataaaakkcaacattatttcataataaaacctgtgcaaggaaaccaaggtggctatcctccarnrtcattagcagacatcatactgaatggtacaatcttggaagcattcctaggaaaacagaggacaggacatggatgtctgctatttccgcacgtatcctgtaggttga

SEQ ID NO: 8254 - DNA, 430 bp, Homo sapiens
aaaacgtattgtttaattttcaaacatttagggatttcccagacatctttgttgttggtttctaatttaattccattatggttagggawcatackcattatgatgaattaaaaaaaatgtagaggtttgtatatggcctgaaacattgtttgtttaggtcaatgttcagtttgtaataggaaagatgtgttctgctgccgttagtaaagtgtttcataaataataattaggtcaagttggttgatcgtgttaaggtcttccctatccttgctgatttcctgtctgcttgttctagtgattactgagaaaggagtgttgaagtctgcaactatkgttatgggtttgtwctctttctccttgaaattctgtcwgttkatgcttcctgkatttkgaggcactgttattagatgcagaaacatttacagkktkt

SEQ ID NO: 8255 - DNA, 230 bp, Homo sapiens
tgaatgctgacatgatgtgcaaaggaaatgcttattggaacattttatgttttggatttgggatgcccaaccagtaggtataatgcaaatactccaaaatctgacagatttagaaatccaaagcacttctggtctcaagcatttcggataagggatactgaatctatataagcagaggcttagaggtaggaatgttcatgagaatgagtaagtcagtttaactagagcat

SEQ ID NO: 8256 - DNA, 54 bp, Homo sapiens
arttgtgttcgcagccgccgccgcgccgccgtcgctctccaacgccagcgccgc

SEQ ID NO: 8257 - DNA, 63 bp, Homo sapiens
gaagggatagaggccttggaccaagatatacaggtatcttttttttttttttttttttttttk

SEQ ID NO: 8258 - DNA, 426 bp, Homo sapiens
taaatttctttagagtaaatacctcggaataagattgttgggtcatatgattatgtttwaccatctgagaaactgccagactgttttccaaagtggctgcacaattttacatgcccaccagcagtgaattaaaggttctgacttttctccttcctcatcaatacttgttattttctgactttttgatgatagtcatactagtgggtgtgaaatggtatctcattgtggttttgatttgcatttctttgatggctaatgatgttgaaccatcttttcatgtgtctcctggccacctgtgtatctttggcgaagtattcagatcatttgcccattattaaattgagttatctgattattattgagttgtaagagttctgtatatattctagatacaattctctgtctgatacctggtctacaaatatt

SEQ ID NO: 8259 - DNA, 420 bp, Homo sapiens
  misc_feature 370: n=a, g, c or t
aataccttccttctaaatbacagaaagtaacttttccatacacactgtaaacagcagacactctaacagagcatcggttatgctccatctcctaacctgaaggactcttgtcacacacccacctctgagaacccaagctcctcagtttttttaatcttttggccacatttcatccaattaccatcataccttttatacgttagatttccaaggaggtaagtgaatcacgtaatgggggtgaactgtacccagtcaaaataaccttatctgactttttctatatttttgatattttttctctaaatattaagtctttctcccaagctcatgtctattccttcctaaaagtcaaattgacatgaagtgaaanvtgatgtgttgcttctgaagacaatggattgcttggcatttgggatcttt

SEQ ID NO: 8260 - DNA, 438 bp, Homo sapiens
tatttattaagagcatcacctgggaggacttcagcctgctggctcctggtatgaatgtttgctgcattggcasccagatttgaatggaaggatggagtattttthaacataaaaactaataagcacctggaaacgtaactttgtgggtggtgctgatgcagtgtatttctttatatatcagtaagctagtttttcagtgattcatcaaactaattagcatgggagcaccagaggtgacaaacccatgggttaactctggcttgatgtggtttgtttggcctgtaccaacgatatttaaaatgttattttaggccaggtgcggtggctcaccctgtaatttcagcactttgggaggctgaagcaggcgtatcacaaggtcaggagttcgagaccagcctagccagcatagtgaaaccccatctctactaaaaatacaaa

SEQ ID NO: 8261 - DNA, 419 bp, Homo sapiens
catcagcctagtcctaaaattcatttcctagtagttccagtattctcctgaattatgaggatacaattaatttattggatttttttctgaagaatttaaggttccctgccagcgattcacagtgaggaggcacactcccagagcaggatgggaagggagtttgtttcaaattatcttcattttgtctcataaattctgataaacctacttggaggatcagagtgggtgggaggttgccacttcccattctggtatcactctgcacacagttgtattgtgaactcaaaacagtggagatgcagaaaaaaaagattgaaccactattctatgcagaaacctcttgaacaataaatgttacttaaccactataatctatcacaaggaaagaaaggatcaggataaatatctgatgtgtgaga

SEQ ID NO: 8262 - DNA, 319 bp, Homo sapiens
gcaatatccagaagctattctctgaacgtattgatgtgttcagccctgtggagttcaacaaggtgtcggtgctgaccggcatcatcaaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgargtcatctgcgagcgcg

SEQ ID NO: 8263 - DNA, 89 bp, Homo sapiens
tgaatagatgatcgtggttcatgcctatactccctatactcccagcactttgggaggccaggcttgccaacatggcaaaaccctgtctc

SEQ ID NO: 8264 - DNA, 139 bp, Homo sapiens
  misc_feature 49: n=a, g, c or t
acggaagaaccaggagtttggcgtgaccatggggaagcaaaagaaaacnaggaagtatgcgaccatgaagcgaatgcttagtctcagagatcagaggcttaaagaaaaggatagattaaaaccaaaaaaaaaaaaaaaa

SEQ ID NO: 8265 - DNA, 188 bp, Homo sapiens
gtttttccgcgccavgccctttgaaggggtggtggtcgacgggcaagtagagaccgagagggtctggaggggcgaccsgsctkggcacagaaggggaaggawgagagcgggatgctaagtgccgtctggggagccggagggcccggggcgggcggggctgctcgaggacagccgagcagaaaagagtt

SEQ ID NO: 8266 - DNA, 459 bp, Homo sapiens
ttcattcagttggataaacagggcaggaaagaagaaaacccgattttactaaggtaaatgggcaaaaactggaagraaagggraktgtggttttggagagggtcccgatggtaagatcctgattggaaggtgtgttggttaaacaatttctgaactaaccgccagatggcatcactggccaggactgtttactacctgctagaaggggtagggcaaagtgaaacgaagccactctagggcgaatggggtaaggggaaagcaacgaataaattgccctttataaagatgatcacagattggatatttattactcagtgtgtctgtatgcagtactagggtggactaatgtctcacttcaaaaaaaatatgagtgtagtatacttggcctaaaattgttactcagtgttactaaagtgtaatcattttccacatctccaaatatattccaagtctctgaaa

SEQ ID NO: 8267 - DNA, 447 bp, Homo sapiens
gaatttgtaaatgctgacatagctatcaaagtaattctgtatttcataaagctaaagaaatggaaggaaaamgtttttcytcmagctggagcaaagtgtaacaaaatattgagatatctaccatttcaagaatttccaactttgtgccaaaaaagaatctagaagaagttgccagagaaagtatggttttcgttctttcagggataaattttcctctcctgccagaagttgctttgtagcttgcagtcatttcgagacattactggtcttttgctttatagttaggtgttcagcattcctaagaaattctcagtatagaaaaggaccatctgcactccaaaagcacatgtcccctccttctaccttactgtatttttaaatgagtgtctgtctggccacttttcattctttataaaaatatagtatcaacctgaagttctaaagagt

SEQ ID NO: 8268 - DNA, 451 bp, Homo sapiens
aattacttgctccaacagctagatcaaaggctgaacattttgctttagtatagatgagggaaatgagcaagtcctaaaaggktttgccctgttacggtgtttcatcactcatactggaaggagaaggaaaggagccatatgactcatttaaaagaaaaactgatctgacacatcctcttggtttcctaagtcttatgactagccaatgcgtgaaataatgaactcctccaaggcaagaaatctgttttgaagcttctctgcgttcacacacagcagcctggtttcctggaagggcattttccacattgtgcgttatggatgatcatcccaggcatcaggtgtgaagccctgcatccacatccaggggctatcaaatctctctgcaaaaggagaagctggactcagttctgtgaaggaagctgcagaagaaaaaggtgaaagaggtgaggaa

SEQ ID NO: 8269 - DNA, 467 bp, Homo sapiens
caattttcttaaatttattgaggcttgttctgtggcctctcatatggactatcttggagaaagtttcatgcactgaggaatagaatgaatattctgcagttgttggatagaatgttctgtaaatatctgttaagtccatttgctccagggtatagtttaaatccattgtttctttgttgactttctgtcgtgataacctgtctagtgctgtcagtggagtattgaagtcccccactgttattgtgttgctgtctatcttgtttcttagatctggtagtaattgttttataaatttgggagctctaggctgggtgaggttgctcatgcctgtaatcccagcactttgggaggccgagacgggcggattaccagtggtcgggagtttgagaccagcctggccaacatggtgaaacccttctctgctaaaaatacaaaaattagctgggtgtggtagcgagcgcctgtaa

SEQ ID NO: 8270 - DNA, 342 bp, Homo sapiens
agactcgagcagtctctggaacacgctgcggggctcccgggcctgagccaggtctgttctccacgcaggtgttccgykcgccccgttcagccattggtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggcgtacagcagctgbaggcggagggcctgagcccgcgcttccaccagstggacatcgacgatctgsagagcatccgcgccctgcgmracttcctgcgcaaggagtackggggc

SEQ ID NO: 8271 - DNA, 374 bp, Homo sapiens
gcggatttggtctctgtgaggtccctctctgtatatccactgtctgggttgggtgtgttgagaagcaggtgttgggaagttgtctcaggggactggktttycmaggggagttgaattagggcagccacagaagggaagacagaagggctggctgtcaggatgcatgactttgcccggggtgggttctgagccatgctgtgtgggagaccaccgctactgatggccagtctgggtgtagtgctctggggcagggctagacttgtttggggcaatgactttggcccatttataaatatgatcaggttttgcaagtaaaagctgtggccaccacagacagctgtgtctgaatgcctttggtggccgggtgtggtggc

SEQ ID NO: 8272 - DNA, 196 bp, Homo sapiens
ttttccactastcatttcacttctaacttggtataggaagcttagctctctacatacctatcatgtgccctgtatcacagaagattcaggraaaawkgcacttggggaatcaaagamaatggaacttctttttgaaaagacaagcaaccatgttaactgtattgacacatcctcaataaaacctgttgcaaaaaam

SEQ ID NO: 8273 - DNA, 468 bp, Homo sapiens
ccctcctcatcttgtgcatagctcagctggttcctggactgtgggcctgacagcggctttacttcattgccaatagtgtcttcctccttgagargktycakgtgttgcacagaacagtagccacacttattgagtattgtacttattctttgtttttgagatgagatcttgctatgttgcccaggctgctgtcgaactcctgggctcaagtgatcctcccagcactttgggaggctgaggcaggtggatcacttgaggtcaggagttcaagaccagccttgccaacatggtaaacacctgtctctactaaaaataaaaaattagccaggctgggtggcgcacacctgtggtcccggctgcttcagaggctgaggcaggagaatggcttgaacctgggaggtggaggttgcagtgagtgaagatcgtgccattgcactccagcctgtgtgacagagcaagactcagtct

SEQ ID NO: 8274 - DNA, 374 bp, Homo sapiens
tctaatctgatgtgagctcatgttacacagacttttagtaagtaacccgtgactagaaaataaactggatgcttaggagagagtgtcagatgtataagatgctaataaaacctgtttaatattattgttagctgtaagtttttgggaaatactgaacaaattagtccacaatcaagtgtctacttttcccttcactgtagggcctctccctgcacagagcagtctgtttagctgtgaacaccacaatctgcagatgttcaagtcccttacataaaatggcatagtatttatatgtaacctatgcatattctcctgtatattttaaatcatctctacattaaaatacctgataaaatgtaaaaaaaaaaaaaaaa

SEQ ID NO: 8275 - DNA, 395 bp, Homo sapiens
tgaatttataacactttacagtttatgaaagactatataaaggttccttctcacaggctgtaaggggtacaaggacaatgaaactcagatgacatccttaaatgcactctactattatatggctaatttaagattaaaaatctggtttcataattattagtctagtggtccttttataggcagcataatacagttgtaaggagtacaractgcctgtttttgratcactggtccatgctaactagctggcttaccttgggcaagttacttgagtttctctgtgcctcagtttccccagctatcaaatagatctaagagttgtgaaaattcaatgagttgatacatataaaaatacttaaagcagtgcctgtccaacataaatgcttaataaatgk

SEQ ID NO: 8276 - DNA, 498 bp, Homo sapiens
caaggtacacaccttttcctcatatgacctggttcaagagcaaatggaaattcctcagggagggtagagaacagtccctaaatgttactgctttcagggccactttgggtacatgctagaggtggttcaatttgggattatgtartatagtagtaaaaagcagggaccttgcatagaattatacacarraatataccacaaaarrtaatagtggtgcagtggctgggtgcagtggctcacgcctgtaatctcagcactttgggaggccgaggcggatggatcacttgaggccaggcgtttgagaccagcctgggcaacatggtgaaaccccgtctctactaaaaatacraaaatcaactgggcgtgttggcacacacgtgtaatttaagctactcagaaggctgacacatgaaaattgcttgaacctggaaggcaggttgtggtgagccaagatgacgccactacactccagcctgggtgacagagcgagattctatc

SEQ ID NO: 8277 - DNA, 240 bp, Homo sapiens
agtagaggttccacatcagcatcgacagcagtggcagaaacgtcaggccgtagccgaagcctcggaaggagcggsccacggcaaagagacatggtcttgctatgttgccagtctgggctcaaacttctggccttgagtgattctctcacctcagactcctgagtagctgggattacagatgcgggccaccacacctggctgtacaaactttaaaatgtttgagcaaaaaaaaaaaaaaaa

SEQ ID NO: 8278 - DNA, 479 bp, Homo sapiens
ttttcatcctctgtttggtgagcatgtgttctggcatagtgaactgttttgtttttatttatttattatttttttgagacggagtttcgctcttgttgcccaggctggagtgcaatggcatgatcttggctcacctcaacctccgcctcctgggttcaagcggttctcctggctcagcctcccgagtagccggaattacaggcatgcaccaccacgcctggctaattttgtatttttggtagtgacggggtttctccatgttggtcaggctggtcttgaactcccgaccttaggtggtctgcctgcctcacgcctgtagtcccggcactttggggggccggggtgggtggatcatctgaggtcgggagtttaggaccggcctggccaacatggtgaggccccgtttctgctagaatacagaaaattaaccaggcgtggcgatgggcgcctgtcgtcccggctactcgggaggctgaggg

SEQ ID NO: 8279 - DNA, 413 bp, Homo sapiens
  misc_feature 365..366: n=a, g, c or t
ccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaagtattttttcttataaaatccagccccggttacatataatcatctgtatctkatcaannatwcctgtaggtaaaagtacaagacgacctctagatgtcttttcttt

SEQ ID NO: 8280 - DNA, 70 bp, Homo sapiens
aattgtgttcgcagccgccgccgcgccgccgtcgctctccaacgccagcgccgcctctcgctcgccgagc

SEQ ID NO: 8281 - DNA, 180 bp, Homo sapiens
tcgatactttaaaaagattcatgcttaaaaaataataataggccgggcgcggtggctcacgcctgtaaaaatagataawtaagttacacagatagaagawagaaacagagaggaaggaaagaaggaaggaakgaaggaaggaaggaaggaaggaaggaaggaaggaaaaaaaaaaaaaaa

SEQ ID NO: 8282 - DNA, 62 bp, Homo sapiens; identical to SEQ ID NO: 8200

SEQ ID NO: 8283 - DNA, 442 bp, Homo sapiens
ctattttcaaaggctattagaaggcgttagtagcttttcagaccttgtagtaaaattgtgttaataaaaataaatraataaaagtcacccagtgaagacataaataagtgtagaaacacaccatgttaatggattagaagactcaacatagtgacaatgtctactttccccaaattgatctgtagatttaaagcagttccaataaaaatcccaacaagacttgtggatataagtaagctgattctaaaatttatatgaaaaggcaaaggaactcaaatagccawaacaattttgaaaaagagcaagaagataaggagactcacactagccaatttaaagacttactataaagctacagtaatcaagaatgtagtattggtggaggggtagacacatcgatcacaggaacagaatagagtcwagaagtagaccacacaattca

SEQ ID NO: 8284 - DNA, 480 bp, Homo sapiens
ataaatgactccatgagagaaaaatgagaagagttcaactttggactggatagccaaagaccttgagatagaaaagagtgaggatataaagaatggcaaacccactaaggaaagaggtgaaaagtgaggtaagggaggtgcccagggcttagtcattagaaccagttgtactcagaagccattaaaaaatcccagcaggagaggacccacggtccagtccatttctcaaagaagtaaggtaacctactttcatgttatatagctagtcagtaggaagacttagattcagcttgtagttttttaaagacacgtaacagattcagaaaattagataagtgaaatttttagatctgctcagaaatatcaaagtatatcatataaatatatctcccgggccgggcgcggtggctcacgcctgtaatcccagcactttgggaggccgaggtgggcggatcacgaggtcaggagatcgagaccatc

SEQ ID NO: 8285 - DNA, 404 bp, Homo sapiens
ccctctatgtctctttgtgtcgctttcattatgtctcttggtaactggcttcggttgtgtctctccgtgtgactattttgktctctytctccctctcttctctgtcttcagtctccatatctccccctctctctgtccttctctggtccctctctagccagtgtgtctcaccctgtatctctctgccaggctctgtctctcggtctctgtctcacctgtgccttctccctactagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaacccatctctactaa

SEQ ID NO: 8286 - DNA, 202 bp, Homo sapiens
  misc_feature 137: n=a, g, c or t
ctttttcaggckssggtcggctgccatcaccacagaagcggcttccaggccttcggcgggaggctggccctcttcctgcccggctttgatcgccacatgaccgcgacccccaacaactcggatctggggagtaccgncacggcccgcggcatcctggggtacgcccccctyctctgaaggcggtggaggcgggagcgcgacs

SEQ ID NO: 8287 - DNA, 353 bp, Homo sapiens
attgttcggctgggggtcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggavgagcagcagcgggaggaggagccgtgtgccctggcactgagcggccgcggccatggcgtacgcctatctstbgrrgkacatcataatcggcgacacaggtgktgggtaaatcatgcttattgctacagtttacagacaagargtttcagccagtgcatgaccttactattggtgtagagttcg

SEQ ID NO: 8288 - DNA, 296 bp, Homo sapiens
ttaatatgtgrkdktgagcaatatagagaagttgaaagacaaatatatagaaaggtccatgtttcctttgaccatataaactgtcattaaaaaaacaaacagaaaaatagaacaaaacaaaaacaatctggtaagagggccaggcactgtggctcacacctgtaatcccagtgctttgggagaccgaggcaggaggatcacctgaggacaggagtttgagactagcctgggaagtgtagcaagacctycatctctacaaaaaataaattagctgggtgtggtggcatgtgcctgtg

SEQ ID NO: 8289 - DNA, 316 bp, Homo sapiens
cacatttcaacatggggatttgcagaggccagtatctaaactatagcagatactgttccacgtctttggatttttttttgttttttgagacagagtcttgctatgttgcccatgctggagtgcagtggcargatctcagctcactgcaacctctgccgcctgggttcaagcaattcttgtgcctcagccaactgagtagcygggattaaggctggtctcaaattcctggcctctagkgakssrvacgggttggcctyccaaggtcctggcattacargagttgagccaccacaccctgcccagatctttggatatk

SEQ ID NO: 8290 - DNA, 290 bp, Homo sapiens
cttgcgatagttkvctgagaatgatgatttccagtttcatccatgtccctacaaaggacatgaactcatcattttttatggctgcatagtattccatggtgtatacgtgccacattttcttaatccagtctatcattgttggacatttgggttggttccaagtctttgctattgtgaataatgccgcaataaacatacgtgtgcgtgtgtctttatagcagcatgattcatagtcctttgggtatatacccagtaatgggatggctgggtcaaatgacaagcaatgggga

SEQ ID NO: 8291 - DNA, 327 bp, Homo sapiens
gaaaccggktgsscttagaggttagacttttgaagaaaaaaaaaaaaaaaagatacagatcttttcccctggccaaagggaagttgtattagtctgtgacatcttgtgatgctgtttatcttggtttgacattggagatacgctagtaactgkgataccatactataaaacagaagaattttctgctactaaaaactgcctttttacaaaatgactgtaaatatttgtaaaataaaataacactaaactttaagcccaaaaggagagatagagccatgtgttcagttgtggacctgtscgtggggcacagtgccaccccatcacagk

SEQ ID NO: 8292 - DNA, 457 bp, Homo sapiens
catgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctaaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaaaaagttttcccggt

SEQ ID NO: 8293 - DNA, 241 bp, Homo sapiens
aaaaaaaatcctrgagkgactgaaccagaggattggaaagaacattttctagggtgcattttccagatagtaatcactgttttgktttatttttgkttttctctatcttttaggtctgttttgcctgaacccatcaacagctgggagattaatcaaccacactgaaaatgtggagggatttatgggggagggggttgaaatkgggtgttttgaaacaaaagtgtataaacaaatgaattgk

SEQ ID NO: 8294 - DNA, 287 bp, Homo sapiens
cagtttarkbtgktcttttttcttttttctttttttttttttttggagacagagtctcgctctgtcgcccaggctggagtacagtggtgcggtcttggctcgctgcagcatctgcctcctgggttcaagtgattctcgtgcctcggccttgcgagtggctgggactgcaggagcgcttcaccacgcccagctaattttttgtattttggtggagacagggttttaccatgttgcccccatcattctcagcaaactatcgcaaggacaaaaaactgaacaccgcttgk

SEQ ID NO: 8295 - DNA, 218 bp, Homo sapiens
gccttttcccggaatcctgagagcaacgcaggccaaggcaaagtcccaaaaggaccagtgaggacatacagaccagctcgcaccagggcacggtcgccggctcctgacggsggggccctcggtccgcgaggtgaatgaaccagggctgaagagaaacaggccctyctygcacccgggcctycgcgcactctcggggaagcgaactaccgtcggccgcg

SEQ ID NO: 8296 - DNA, 292 bp, Homo sapiens
caagggctcagaactgaaggcaattatttcttttggtggacttggaatctccgtttgtctacactgtcctcttcacagtggagtctttttatttcagacctacagattgkttttatattggwttgtcacagtgtgacaattttttgtacagtcggttttaaggtcttctctgccattagagccagtaggttacagctattgatgtaactatagctgcaatttttgtgcaggactgakaaacacagtgcattatttattgcggaatcattgctgctaaataactactgwctgd

SEQ ID NO: 8297 - DNA, 280 bp, Homo sapiens
  misc_feature 120: n=a, g, c or t
acacrscgggcccggctcctgagggcgccagcgcggccccggggagcgcgaggagccggcgaagcgcgcggyctgccgttggcggcctggtccgmarcgccctgcgmccaayysgkcccngracktggggcccaagcccccgtgaagatggtgtmctggatgatctccakagccgtggtgctggtgtttggaatgctttatcctgcataattatttcatacaaaagctgwgaaaacaaaaaacgtgaaakgaatatgttcgatggatgatgtactggatt

SEQ ID NO: 8298 - DNA, 100 bp, Homo sapiens
agtgssagcggcggctacggtggtggcagttccggcggcggcggcggcggctacgggggcggcagctccggcggyggcagcagctccggcggcggatacg

SEQ ID NO: 8299 - DNA, 339 bp, Homo sapiens
actaakrrtcctctagaaagaaccctgttagatcttggtttgtgataaaaatataaagacagaagacatgaggaaaaacaaaaggtttgaggaaatcaggcatatgactttaatacstwaacwtcagawctttyctataatatcctactactttggttttcctagctccataccacacacctaaacctgtattatgaattacatattacaaagtcataaatgtgccatatggatatacagtwcattctagttggaatcgtttactctgctagaatttaggtgttgagattttttgkttcccaggtatagcaggcttatgtttgatggcattaaattggk

SEQ ID NO: 8300 - DNA, 369 bp, Homo sapiens
actckkstgttctattcttcctaactagatgttctacaaaattgcttgtgccaatagctcattatatttcctcttgtcagtcttttgcaaatacaccttatttggtctgtaacgccctcttttttgcagtgttttaaaactgcttggaatcatcttttttttgaatcattgtccgctttcccagatagaaaatagtttgcctacagccgggcatggttgcttacgcctgtggtcccagcactttgggaggctgaggcgggcggatcacgaggtcgggagatcgagaccatcctgaccaacacggtgaaaccccgtctctactaaaaatgcaaaaaaattagccaggtgtggtggcatgcaactgtaaty

SEQ ID NO: 8301 - DNA, 346 bp, Homo sapiens
ttacgtgtttcagagtttgtattgtgattatcaattaccacaccatctcccatgaagaaagggaacggtgaagtactaagcgctagaggaagcagccaagtcggttagtggaagcatgatttggtgcccagttagcctctgcaggatgtggaaacctccttccaggggaggttcagtgaattgtgtaggagaggttgttctgtggccakwatttaaacctatactcactttcccaaattgaatyaccgctcacactkctgatgattttakwgtgctgtycggtggagatcccacccgaacgthttaatctaatcatgaaactycctagkttccttcatgtaacttm

SEQ ID NO: 8302 - DNA, 168 bp, Homo sapiens
gagccggagccgccgccgccgccgccgccgccgcgggcttcgttcgtaaggaagggggcctaggcccgggcctgcggtggtgggggttgctgcgcgccgggggtygctyctgvtgrgyctttcgmtcyagcttcggcccayttccccttgccagyggggtgggcgcgk

SEQ ID NO: 8303 - DNA, 66 bp, Homo sapiens
cttsskgcggyggccgccaccagccggaatmgcaaccggcggagcccgtgcgcaccgcagcgcagc

SEQ ID NO: 8304 - DNA, 106 bp, Homo sapiens
agtskgcgcctcccgctccccgcctccggccgggtccgggacgccgcggctgtggggtcggcccgctaaggacaaggtcgggagactgggtggcgatgcccgagtg

SEQ ID NO: 8305 - DNA, 358 bp, Homo sapiens
taaagaaaaagaggtttaatggactcacagatccacgtgactggggaggcctcatgattatagcagaaggtgtaggrggragcaargtcacatcttacatggcagcaggcaagagagcttgtgcaggggagctcccctttataaaaccattagatcaggcagggcacagtggctcacacctctaatcacagcactttgggaggccgaggcgggtggatcacctgagatcaggagtttgaggctagcctggccaacatgttgagggccccgtctctaataaaaatacaaaaattggccaggcgtgatggctcatgcctgttgtcccagattcttgggaggctgaggcacgaaaattgct

SEQ ID NO: 8306 - DNA, 425 bp, Homo sapiens
acctgagcagagattgtttcctatttcagataaaatacagtgaaagtgagcaaggcagaaaaagtcaacagatgsccaggstycctactttattctggagatactgtcagagctctaatacagagcactggccataatgaaaagcagttcactccttgtgctcctctgcagatgtttttcccagtgttctaggttaatgttttatttggttgcctgcataatccctgttctgtttcactgatggtgtttgcagcaccactgttcatggtggtccactgttatcctatgccagggtgctaagaattgcatgatattcatcttccctgctctatttaaatttacatctataagagtcatcttgacattaacactgaaatgtgatctaggtccttaaccaaaattgctgggcaacttgtaataaattt

SEQ ID NO: 8307 - DNA, 393 bp, Homo sapiens
actgggctgtacggtgcgcgtgacggctgcgtgcggcgggaatcatggctgctcgcagcrkctgcacttcgtattcaagtgggaaaccgcttccagacggcgcgtttctatcgggacgtcctggggatgaaggttctgcggcatgaggaatttgaagaaggctgcaaagctgcctgtcaatgggccttatgatgggaaatggagttaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagcttggccactgacggaagttgcagaagggtgtttttgaaaccg

SEQ ID NO: 8308 - DNA, 338 bp, Homo sapiens
  misc_feature 31..33,36..38,45: n=a, g, c or t
ccactacacctggctgaggttcctctrcctnnnccnnncccagtncccacccctgcccccagccccggggkgagtycawkybkcccagggtaccagctgcgcttgcktkkctgtatttwatttagacaagagatgggaatgaggtgggaggtggacaagggagaagaaaggtgagtttgagctgccttccctarctttagaccctgggtgggctctgtgcagtcactggaggttgaagccaagtggggtgctgggaggagggagagggaggkcactggaaaggggagagcctgctggcasccaccgkggaggaggaaggcaagagggggtggaggggk

SEQ ID NO: 8309 - DNA, 272 bp, Homo sapiens
acttttccgggagtctccagctggccctcatttgtgtccggagctcaggagttcccaaaccgactcagtcgcaccaagtttccgtcttttggaattggggaaggagtttctttctttcttttctttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaar

SEQ ID NO: 8310 - DNA, 333 bp, Homo sapiens
caaacatattatccctgtcttcaacttgttgcccagatgatttcatttaaataatatagaagtacaaaaattagctgggtatggtggtgcatgcctgtagtcttagctacttgggaggctgagataggaggatcgcttgagcccgggatgttgagtctgtagtgagtgatcatgccactccactccagcctgggtgacagagtgagatcttgtctcaaaaaataataaaaaattaaataatatataagatacatatatatgtatgtgtgtgtgtatgtatttgaaattttaaaaagtgggatattctgccggacagctggtttgggttttttd

SEQ ID NO: 8311 - DNA, 414 bp, Homo sapiens
cactttatagtattattaatattatatttcagacaaactgtaggtcatgtaggtgctgagggaaagaattgggaactgtgaaaaccattgtttatatagaagctgtcttttgagttccaaacaaatgtggagaacgtaagacattgacagcagctgggtaccgcctgcactgtctccttctccaaggcagcaggatggcatagacccacaggaaggactctctaattatgctaattggccaagatccaggcagcagagttatctatgctaaatggaagaaagatttcttgtctgtgcatggtggcttatgcttgtaatcttgaccctttgagaggccaaggcaggaggatcacttgagcccaggagtttgagaccaacctgtgcaacaaagggagatgctatctctacaaaaaa

SEQ ID NO: 8312 - DNA, 228 bp, Homo sapiens
ttcttcttgataattttcctgtgttttacaaatatttaataatgaatatgtactactctaagaaaaacagtacaaaggttttcaaagttttttgacagtcatttacctgcagtaagtacgttatacatcccaaccccatataaactagcatttatgtatttataaacttaaaacaaacattagttaaccatttttttctacttgtcttgctttttttttttttttttk

SEQ ID NO: 8313 - DNA, 432 bp, Homo sapiens
caatggccagaaaataatctatatgttaatttgttaatttgatggttcatggttcaaggctgtacaatttaaaaatttgaagtcaaacaacacatgatggataatcctgatgttacagattctcagggcagaatatgtatttgttttttctaccaattgttctagtatttacagacaaacttcttaattatactgggttggttaataagtatttttctttactctttcaatctaggtccagctatgcatcaccccttcgctgatgagcatttagaaaatccaaatttggccgggcgcggtggctcacgcttgtaatcccagcactttgggaggccgaggcgggtggatcacgaggtcaggagatcgagaccatcctggctaacacggtgaaaccccgtctctactaaaaatacaaaaaaaaattagccgggc

SEQ ID NO: 8314 - DNA, 107 bp, Homo sapiens
aaaacctcgcctggctcctagctggtgctgaagctcgtcagttcaccatccgccctcggcttccgcggggcgctgggccgccagcctcggcaccgtcctttccttts

SEQ ID NO: 8315 - DNA, 361 bp, Homo sapiens
ctttgggatcccaaggcgggcagattacttgaggccaggagttcaagatcagcctggccaaaaatggcaaaaacctgtctctacaaaaaakrccaaaaaattagccaggcgtgatggtgcacacctgtaatcccagctacttgggaggctgaggtaggagaatcacttgaacctgggagacagaggttgcagtgagctgagatcatgcactgcactccagcctgagtgacagagcaagactctgcctccaaaaaaaataaaaaattagccaggtatggtggtgggctcctgtagtcccagctacttggggagctgaggcaggaggaacacttgaacttgggcgcaggagtttgaggttatg

SEQ ID NO: 8316 - DNA, 341 bp, Homo sapiens
gagccggcctttggtaacgccacctgcacttctgggggcgtcgagcctggcggtagaatcttcccagtaggcggcgcgggagggaaaasaaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagsgtggttcctttcgtgctggcgccgsgayctccggatgacccgggcttcggsccccamcagagactcgagaagcttgattctttgctctcagactacgatattctcd

SEQ ID NO: 8317 - DNA, 416 bp, Homo sapiens
ttatttgttgaggttatttcctctgagcagtctgcctctcccaagccccaggggacagtggggaggcaggggagggggtggctgtggtccagggamcccsaggccctgattcctgtgcctggcgtctgtcccggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggtdctttcagttcaaaagtgagatgtctggagatcatatttttttatacaggtatttcaa

SEQ ID NO: 8318 - DNA, 353 bp, Homo sapiens
taatgaattatccaagattcgatgggatttatcagtgtgtagatagctctataatgcttgaattgtacacttctaagtgtgcagtgcaagmrctttsdtkaawakkkcatacttkttatactttgaggaraaaaagtcaaagaaaaattgtatttgagggaaaaaaccatgaccaattaaaggataaattcaaaaaatagcctcatgagacttggcatacacactcgtgggattccagttatkatggagtgcttccatccctctccaccccttccccccaaaaggttttctttgcaagtgcttttggaactaagagctagtatcttggattaactgatgcctgctagkgcttt

SEQ ID NO: 8319 - DNA, 433 bp, Homo sapiens
acaatttatgtgtttagtgtagtttgcagtgttcccttattatgttttgctgtgtgatatgcccttcatttctgatattgataatttgkatatttctkatttctcagtcttgctgaggggatgccgattttattaatcttttcaaatacgcatgttgttcatcgatttctccctgttgtgctgttttcatttttgcgtacttgtgctcttattttctttctcttctgctttaggctgattttgctcttcttactcttgttttttgatattagacctttgattatagatttgagacttttcctcttttctagtttatacatttattgctattacttttgctgtgagcactgctgtagctgtgtcccacaaattttgatatgtggtatttkcattttcattcactccaatttckttktctttcacttgagacttc

SEQ ID NO: 8320 - DNA, 337 bp, Homo sapiens
caaaatttattatgaagctaaaataatcaagggagtgtggtactggcataaggtcagagagattgataaattaaatagaattgagaatccraraactaavccctaatatttatgaccaattgattttcaacaagtgtgccaatacatctcaatggtaaaaggaaagtcattttgggctgggtgtggtggctcatgcttgtaatcacagccctttgggaggccgaggtgggaagatcagctgaggtgaggaattcgagaccagcctggccaaaatgatgaaaccctatctccattaaaaatacaaaaaattagctgggcgtggtggagtgcacctatk

SEQ ID NO: 8321 - DNA, 398 bp, Homo sapiens
cgattttttgtagaaacggggtcttgcccagccatcccattactgggtatatacccaaaggattataaatcatgctgctaagrcacatgcacacatatgtttattgcggcactattcacaatagcaaagacttggaaccaactcaaatgtccatcaatgatagactggattaagaaaatgtggcacatatacaccatggaatcctatgcagccattaaaaaaggatgagttcatgtcctttatagggacatagatgaagctggaaaccattattctgagcaaactatcgcgaggacagaaaaccaaacactgcatgttctcactcacaggtgggaattgaacaatgagaacgcttggacacagggtggggaacaccacacactggggcctgtcgtgar

SEQ ID NO: 8322 - DNA, 396 bp, Homo sapiens
tcatgattagctaactttcaccaacatcagtaaggaagcagcctgaggcatccttctattcctttttcttcttcaaggttgttatgtttgtcctttgagttgtcagcacccttcaaaacgctctctgtaattttagaacctttaatatggtgaacatcaagcatctcatcatgccaaatgtaattttccacacccccagcatttaatgtgttcacaggaaatgaaaaaagaatcacacttcctctctttgcttgttccttatgctttatcgaacaccattttaatgccaggcacagagtgagagaccagagattaaaaaataaaagatgaacagggcttatcactgcccacaacaaactcatgatctaggcaacacattattttgtgtactgggga

SEQ ID NO: 8323 - DNA, 353 bp, Homo sapiens
ctaaacaaccttttctcctgagtctttggcatcagttagaagttaaaaagcactgcaagttttttgtaatcctgaagaggaggaaaagatgccaaaccagagtttattcaagataataagtggtatttttgagagatttattctctctcctctgaagcctgtttctactttagtttcacttccattttcctgcttctttgataggcagtgagatgatttttaatagcacatacactctgtcctgtttataggttgctatcatttaatgagaagaaagtcaaataggacaaaaccgcaaatctttgaaacaaaactagaaagccataatggaggctgggcatagtggctcatgc

SEQ ID NO: 8324 - DNA, 459 bp, Homo sapiens
gtaaaataagatattcacagtaaatgatagactattatagtgctgagaatgaattgttcggcactagaaagaaagaacaaataggtaggcagagattttgtgcatataggtatttgaaatgtccaattaataacttaagcaagatatggtgaaaacatgaatatagaagtgagggacagattgaggactagatttcataaatatttagaaaggcaaactgtcagtaatgaattttgatattggatgtagatataagcgttaagcagtctaaattccaaaatttttagtcagtgctgcatgaactgaaataagcagcaaaagaaaactaaaacaatgtctgtgtgctgatcccttgaaattaccttgtaacactgccaaaggaaaatggcactgagcaccaagtttgttatagtttcagttgtgcccaagtgagtctccagagttggtgaaatctcaagc

SEQ ID NO: 8325 - DNA, 401 bp, Homo sapiens
tagaagagagaggggaggctggtgggtgaatgggatgggagtattttaccgcagtggataattggttttgtcaagagtgatggatagtagacctacagtttgaaagtcagaaagactgagaaatttccctttaatctggtagatagtactcaatttgaaaactttttctttccaaaccagcaacagcatgttcgaaaaatgttgttcgttagcaaactaaaacatcttagtaaaaattaaggctaaaaatcatagtttctttattattttgtcagtttgagtaaagttgtktctttttctcttccagaagaatggttgagaccggtgatgagaaaagagaagcaagtgttagtgcattggggcttttacccagacagctatgatacttgggtccatagtaa

SEQ ID NO: 8326 - DNA, 412 bp, Homo sapiens
aatttctggatgatgatgattgttatttaatagccagaggtcatataattggcctctttggaagaggcctcatggctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactc

SEQ ID NO: 8327 - DNA, 277 bp, Homo sapiens
ttggatgtaccagttcttttttggtttatctcagagtgaaaactacttctttttccaaactgggagagagatacatgtttcaccacaagggcagccaggcaagggggcacctttactctcacacatctaggaggtgttttagtctaggctctattgctaaggggccaataaaaatatttttttctcactggaccatttttgtttatatacatatatatttacacaaatatatgtaaaattcaaaatgcaaaaatatatgtagtggccgggtgctgtg

SEQ ID NO: 8328 - DNA, 378 bp, Homo sapiens
gggactgtgtctgccgagctcggcgggctgtgcttggtgagtggaggagcggcgcgtggaggcagaggcgagcgcgggcgatcgcggcggcgggacgtctccggcggccgcggcaccagcgcggcgctctgtgtggagaagcaggggcagctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggktctttttgacctgttaaaa

SEQ ID NO: 8329 - DNA, 360 bp, Homo sapiens
ttttgatgtataggttttgatgcatagattttaaaagttcatgaaaatgttactttaatgttcaagagagagatgaaggtgaatggaaaacgkaacattattttgttggccctatttggtcgttctggttgttgctggagaatgtgagagattgtgattcaggtcagatactatcttgaaatcaaatatgagttccagatactcttatagcccagatatttccaaggctttgctgacagcttaattatttcaagcaatatttgatatggctgaagacctgttgtccaaagaatttggatgtccttttgggctctttttttcaatgkaagccttgccaaaagatgtgaaaatckgcatgak

SEQ ID NO: 8330 - DNA, 349 bp, Homo sapiens
ttgtgatattaaatttaactatgatagttaattaaaaagacatatcttgtattcattaraaatattttaatttarartattctgatttctaaagtgtgttagcttakcagttattyybgtttataaatagactttaatagctctctaagaatatgacctctaaaggaaaagatgattttttacaatacatacttctggaactttgagatttgagaaagcttccatgtatattgataaatctaataaaataaagagatcaattataaacvtggttgttctataaaagtagagtgcacaaaaaaatgtcttgtgttttatactgtctaagatttggaggaaatgtggcaaa

SEQ ID NO: 8331 - DNA, 457 bp, Homo sapiens
tggataaagagtgaaaatgaataaaaactaatggattgttcagtcgaatagcagatggtacaatggtacatggccagtagaatagggggacccaataaaattgaagaccagtcagagtgggagtgatcaatccagcaaagtggaatggcaggggatcgtaggcacaaggtccagagtgtaacagtgacaatgtgtggctgatgtgggatcgaggaagtgattgttttttttctaaaagttttccttgccatctcaggataccactccgttaaatattatggctagaaagaggaataagagatactaggaacataggaaatttttaaaattcttatctagcatgtatttcttaccttacatatgtcaggcagtaaaccccccaaaacataaaacgaatgggacagtatgttccttggtttaccgttgtgcttgagctcgktatgctgtacagtctcac

SEQ ID NO: 8332 - DNA, 90 bp, Homo sapiens
tgttacgctgcagatcggcgccgttacagacgtggctactatggaaggcgccgtgrscctccccggaatgctggtgagattggagagats

SEQ ID NO: 8333 - DNA, 167 bp, Homo sapiens
acagttggtggtaagtatttggctttatttctgggttctctattctgttccattctatgtgcctgtttttatgccagtaccatgctgttttggtaattamcaggcttgtagtataattagaagtcaggtaatgtgatgcctacagatttggtttttttttttttttg

SEQ ID NO: 8334 - DNA, 386 bp, Homo sapiens
ctttgagacctcctacctgaagggggctgctggctgtggggtcccgcttgtgcccgcctcctccttctctgtcttctatgtcatgtgaggctggcattcccacgcgtgattccaggcttgttgttcatctacacaaaacttttaatacgattttgacaaaaaacatagaaaaggatgacttgccctactgaatattgaaatgaaccgtggactaactatgaactttcaaacaatccattagtggctgagaaataaacagaaaaatcaatggcccaacacagacagtggagaaacaggctgaggagcatgtccaagtttgtatggtcaggagtgtgcctttcaagtctgtggggaaatacgtgtggaaaagcaagacaggagtgtat

SEQ ID NO: 8335 - DNA, 389 bp, Homo sapiens
agtggaatcgcgactatgggagctccggggggaaagatcaaccggccccgaacggagctgaagaagaagctgttcaaacgccggcgggtgttgaatcgggrascsggsgtctgaggcaccgggtggtcggggctgtgatagaccaagggctgatcacgcggcaccacctcaagaagcgggcgtccagtgcacgtgccaacattacactgtcagggaagaagcgcagaaaactsvtccagcagatccggsttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaa

SEQ ID NO: 8336 - DNA, 356 bp, Homo sapiens
  misc_feature 95..97: n=a, g, c or t
taattcggaatatacctctgtagatagcaaatatcaaatgcatattgttctccttttccccttctacttctccagacaactgagvcattttgagnnnwaatgcagaaccaaatcttcagttgagaatacttattttttaacgtataatctttatatacatattctctagactgttacttgaaaaaaaagtactattttgccagtgtagtcatattattttcatgtatgtaatgtgctagcttttaaggagcatcatatagacttccagactaggtttaaaatgctaaattgcctgcctatgtgtatcatttttcacagggtgaacaaaggagataatgattcctttgacttctgac

SEQ ID NO: 8337 - DNA, 56 bp, Homo sapiens
attgggtatcattcattacattcttgagtttttttgggtttttttttttttttttk

SEQ ID NO: 8338 - DNA, 311 bp, Homo sapiens
  misc_feature 66: n=a, g, c or t
gcgcggagggatctactacgagtcactggccccgtccgcatccttctccagcggccccgggggcgnkgcgccttaactcgatcagggctgcagcggctcgctggcttgaccagtgcagaaggggcgtgggggtgaggggggtggggtaggactctgaacttcaagcactggagtttgccgggatcgtgaacttgcagggagaggcggtcctcatccagtgaggtactaacagtctaagcagaaaaagaagaacagatggtggtaagacctagaatgtttaccccattaagatctatatctgaatccagaag

SEQ ID NO: 8339 - DNA, 289 bp, Homo sapiens
ctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacggtgtctcacagtccaggctggagttcagtggcattaacataactcactgcagccttgaacacctgagctcaaacgatcctttcaccttatcctccagagtagctgggactacagtcgcgtgtcaa

SEQ ID NO: 8340 - DNA, 289 bp, Homo sapiens
aggcaggccacggagatacctcgtggaaggaggaacagcaagtgcatgggccgagtgtgggacttgcctggtgtgctcaaggtggraggctttagggccaccatggcgcasgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgkgctgactccataaacattctctgttgag

SEQ ID NO: 8341 - DNA, 440 bp, Homo sapiens
ctttgctattgtgaatagtgctgcaataaacgtacatgtacatttgtctttatagcagcataatttataatcctttgggtatatacccagtaatgggatggctgagtcaagatggtatttctagttctagatccctgaggaattgccacactgttttctacaatggttgaactagtttatagtcccaccaacagtgtaaaagtgttcctgtttctctacatcctctccagcacctgttgtttcctgactttttaatgatcagatagcctcctatttttttaactatgagttggaatttgctgcttttgatatgataagaaagttcaaagtttctcttccttgctttgttgtgtgttctaattcttttctgcccatcccccagtaaagaaaaggctcagtatgatttcttgaatagattgtttaagctattttcaaaacag

SEQ ID NO: 8342 - DNA, 391 bp, Homo sapiens
tatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggagggatt

SEQ ID NO: 8343 - DNA, 422 bp, Homo sapiens
catgaaatctttgccagttcctatgttcaaagtggtatttatttggttatcttccagggtttttatacctttagcttttacatttaggtctttaatccatcttgagccccactttgttaacaagacgctattcctctttggactttagcttgatgaagccacattttgagaaagagtgcattttggaaatatagcatcttagaagtgatcttagaaagtgaaagattggtagtaacctgctgtgagcagtacaaggaaaataaaactgagttattcctgtgggactacagctgactctcaggtccagcctggcctggagagcatgtgcttttctgctcttccctccatactcttagttagtggtcagcacatgataataggatgtaagggaagaaataaatctctacttgttttattctcaa

SEQ ID NO: 8344 - DNA, 445 bp, Homo sapiens
taataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaa

SEQ ID NO: 8345 - DNA, 359 bp, Homo sapiens
ttttaagaatgttactagcacatttgctaaagaatttccagaatttttacaataaaaagcaatctcacctgattccacagataatcttttggatattgtctcctttcctagtatgatgtttttgaagttttcctgggactggaccagctggtccctctgaaactgtccatttataaaccaggaagagggagagctttggatcaaaatttccctatgtcagttttggaatatctaaattttcctctgcaccccaaccccattgaagttggtgagagaggcacacatactttgtttggggagattcattactctctagtgacttcctgtttccttagtcactgttaaacctacataaaaaa

SEQ ID NO: 8346 - DNA, 387 bp, Homo sapiens
aggagagcccggggactgcatgcgtctgcgcastgcgaggttaagccgccctttggcggtccccaggacggttcctggtgccagacggtcccmaggccytgggcaaggtggcttatgcctgtaatcccagcactttaggagaccgaggcaggtggatcacttgaggccaggagtttgagaccagcctggccgtggtgaaaccccgaatctactaaaaatataaaaattggccgagcatggcggctcatgcctgtaatcccagctacttgggaggatgaggcagaagaatggcttcaacctgggaggtggaggttgcagtgagccgagatctcaccactgcactccagcctgggcgacagagtgagactgtctcaaaaaaaaaaaaaa

SEQ ID NO: 8347 - DNA, 304 bp, Homo sapiens
atgaaacgtggctttccccatatctccctactttcactccacttaattaatatacgtggctgtacattgrcatactatatcatckawtbcttaatrgaggggttttgcttccttagattttaattatcaataacttcattgcagtattctctgctttcttggtttccagctaattgccccacttgttttttgtttgactagttactttcttcttcatttatgacccctgtctgtagcttatcttggcttctactttctcttatgttctcccctgaattcctttacgtatgttaatattaagctk

SEQ ID NO: 8348 - DNA, 365 bp, Homo sapiens
tatcattgctcttatacatgcatgcattaatgatacattcactccttgtttaatctagcattggcatcaggaataggtccttgataactcccattggaaacaaaattgtagtgacttataactatataagagtaaataaatttttttcacaaaacaagacctaactgagtaattctgcttacaaccactacattactctaccaccaactacatctggaaggaaaggaggcacatcttggagctggaatttattggtgcctagtaagagagagttctagagctagggctccaaagacctcccccccaccacctgstacatasacacatatacatatactcagtcaatctagttgtggacaagttgg

SEQ ID NO: 8349 - DNA, 327 bp, Homo sapiens
ttcagaaaactttcccaatcatttcacttcaatcttaattgaacccaagagtcaaagttattattttctccgaacgtgtttggtgrtcttctgttatattttggggcatgttacctttatggtatataagctgtagtgcatactctttgtattgcaaaaaactggtcagtaatttatgtacatgtattccacattttagtgtgcttgaagtgacaatccatagtttgtagtagtttgttatttgtcaactttaccctgtgttttaaggacatctaaacattccttgtcctatcaagatgacaaaagcagaatgtaattttttwwdrd

SEQ ID NO: 8350 - DNA, 393 bp, Homo sapiens
ttctctcccctccactccattctccacctacccacagtgggtcattctgatcaccgaactgaccatgccagccctgccgatgggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccctaccggccagtactggagcccctacccctctgttggaatccctgcccaccttcttctggaagtcggctctggagacatttctctcttcttccaaagctgggaactgctatctatt

SEQ ID NO: 8351 - DNA, 477 bp, Homo sapiens
aagatagaaacaaagaactggtagccagcccaaggggagggctgttggtagcaggaggaaagccagcagcatggactaattagtctcctggggctggaagttctgggaaaatatcactcaggtgatttgtgggtcctgggtggagtttccactcatggtctattgtaggctttaggtttggatcctgggtgggaaggatggaagagctggcgttgctggtgtttagtgaattgatgatattgaatattttaatgggaggatacagctgaagttgaggtttgatccagctcatggccaaatagtgctagagagaacagacaacagttagcctggggtggcaagctgaagacgctgtccccagagtcatcccgagaccacctttgtccttgcccccatggctgccactcaccggagctgaatagatgaagttaaacagcataagtgctataatcgatatgaccataaaggctatgagtt

SEQ ID NO: 8352 - DNA, 425 bp, Homo sapiens
aataaatccagttggagcagcagtgatgagaagaggggatcgacacgttccgatcacaacaccagtaccagcacgaagagsctycctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgsttttggtgtaaataatgtacaatttgtggatgtcattgaatctagaggactttcccctttttatakkkgtattaactttaacttatt

SEQ ID NO: 8353 - DNA, 272 bp, Homo sapiens
tgtaaataaagacaaggtatggtaaaaataaggtgtaaaatatttttaaatggtatacctaaggcacttaccatgaatgtggcttgcagcactgraaattatggtaggtgagccagtgagtgaatgcaaaggcctcagacataattgtacaccattgtaaactttataaatgctgtatacttgggttccactaaatttataaaatatttttctatctaaaaaaaaaaaaaaaaaaaaaaaaaaaaaaaaaaaaaaaaaaaaaaaaaaaawww

SEQ ID NO: 8354 - DNA, 203 bp, Homo sapiens
cactgtggttttgtattgagttttgaaattagaaagtrtgagtcctccaactttgttcttctttttcaaaattgttttgtttaatcygtgycccttgcatttctttgtgaatgcagggatcatgttgagactgtagatcatttgggggggcattgccattttaatggtattaaaaatcttctcatccaaaaaaaaaaaaaaaa

SEQ ID NO: 8355 - DNA, 83 bp, Homo sapiens
ttttcttctctttttatttgattcagggacctagcctctggattttgagtgtttgtggttacctaaaattttgttactttttk

SEQ ID NO: 8356 - DNA, 534 bp, Homo sapiens
ctctttggtatcttaatctatagattctctcttctctcactatttttcctttttctcttcttttccttgaattttattttcgaagaaaactggattttttgactaggtaggtgtatttctataaacgacaagtgattttgcctcagagatctaggcaggtttttcctcccaaggagcaatgtgacattcagaatctggaatcttaaatgtgacttaatgtttagagataggatttttaaatagtgtttggcaagtctcaactcactaaaatgtatttaacctgwatcctttaattgtagcttagaaatcaaaccaaatgtaaaacaccttgcaggatgtatcttggcagagaaatgtatacaatagaaataacttcagtggtaaacaaggttgckgtatagctgtakatttkkctkcattctgstctgttggttcacaagccattagaatacttgtttcacattggkagttactattcttcctaggagaataaaataagatgacacacaccctcatggatacactctgcatack

SEQ ID NO: 8357 - DNA, 211 bp, Homo sapiens
agaatttaggcgctctcaccctagctaaggccctgggagaaaagactgcctccagggaatcatgtccgattagggacaaaggagggcasaagcccaakkcagtcacacgtgagarcacgggggccgggtggggggagttaagagccaacagggaaggtggaggatgagtttgcaaaccagactatggtcactgcagagctgsttccagacs

SEQ ID NO: 8358 - DNA, 472 bp, Homo sapiens
ttacaatattttgtagagacagggtttcactttgttgcccaggctggcctcaaactcctggcctcaaacgatcctcctgcctcggcctccaaaagtgctgtgatttcagacgtgagccacctcacctggcctgacccggcctttctgagccttcagccctcatctttgtctgggggcattctaaaaaccaaggaatagaataccagggtcagactcagactttgcgttcagtaggccatgaatacttgggttttcgctcagtttctggggcattgagactgatagaagcaactgacccccttagctaaggcaggcaggcaggtattgtcaccaagagaccctggagatcaggagaggttatttggggttggggatctccaaggaggggcagggaagttagtaccatcgtcgggctggaaatgggaagcgtttggctcgttggaagtggtgaagctggggtgtgggacctcgc

SEQ ID NO: 8359 - DNA, 416 bp, Homo sapiens
  misc_feature 185: n=a, g, c or t
cttttgttttattataaaatattcaaacatggaagtatatacagtagaaaataagttttctccctgatttgatttgtattagtaccatctctgctatttagcccccactgttaaatttgactggcttaaaaaaaataccatctctgaagataactacttagaagttggtcatatgtttttccagnbttcccaatgtttatttatatataaacataaataattttaggccaggcgtggtggctcacgcctgtaatcccaagactttgggaggctgaggcagggggttcatgaggtcaggagatcgagaccatcctggctaacacggtgaagccccgtctctactaaaaatacaaaaaattggctgggcgtggtggcgggcgctgtagtcccagctactcgggaggctgaggtaggar

SEQ ID NO: 8360 - DNA, 424 bp, Homo sapiens
aacaaagaaaggtatgagaccagaaggtttcactggtaaattctattaaacactaacgaaaaactaaccaccaatctttttcaaattcctttcaaaaaactgaagaggagggaatatttactaactcattttatgaggctagcattgctctaataccaaagacagaccaaagacactataggaaaactacagactgagcaggcacagtggctcatgcctgtcatcccagcatttcaggaggctgaggtgggagcactgcttgagcccaggagttcaagactaacctgggcaacatagagagaccccatctctacaaaaaattaaaaaattagccgggtatggtagcatgcgcctgtggtcctagctacttgggaggctgaggtbagaggatggcttgagcctagaagatcaaggctgtggttag

SEQ ID NO: 8361 - DNA, 349 bp, Homo sapiens
ctgttttaaaaataaaaaaaaggccatgccagacaccatagccctatcccatatgcaagcatatctttggctgcaggtggctggtttgcatctgctggccaaagggagaggtccattccatccagtcttctgggtcctgttcagtcttatcagacagctttgaagactgagtgccaagattacgtgaacttagtactccccagagttccctttaccttgtgctttaaatggtctacaactttaattttaactgaaggttaacataagaagaaaccatatgaaatccacatatgtgtgaaactggctgaggagactggcatcacatcacttcacaccacgtatgaagtac

SEQ ID NO: 8362 - DNA, 307 bp, Homo sapiens
atacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagac

SEQ ID NO: 8363 - DNA, 361 bp, Homo sapiens
aaaggaaatttctgatttatcacttttctagttgataagtaggattcaaaacgtttgatatgtaagtatttatataagactaatgtaatttaaagttctgtattattgtgattaatcatacagaaattcaggaactgatcagaagtgagattcttttccacatctggttaatgtagtgagttgacaccctgtgggtggtaaagcattataaacatttcatcttgaaccatgatttatacacatctgtgttataagggaggcttgagtacatataccaatgaagagatattcagcatttgtctatttgataaggaattaaatgtcctagtgattataaagtaaaaccacagaccaatttgca

SEQ ID NO: 8364 - DNA, 344 bp, Homo sapiens
ttgctaaatggacaatcataggcccagtgtggtggctcgcgtctgtaatcccagcactttgggaggccgaggtgtgcagatcactgaagtccaggagtttgagaccagcctgggcaacatggtgaaacccatttctacagaaaactacaaaaattagctggacacggtggcacacacctatagttcctgctactcgggaggctaaggtgggaggatcgcttgagcccaggagatcaaggctatggtgagccgtgatcgtgccactgtactccagcctggatgacagaggaagaccctgtctcaaaacaaacaaaacaacagcaacaacaagaaaacaataatag

SEQ ID NO: 8365 - DNA, 180 bp, Homo sapiens
  misc_feature 9: n=a, g, c or t
cttcctccncagcgccggccccggggcgaccgcgggaccttttccggcgctggatgctttgctgccggggttcgggagtgacctgcgcctagagcaggtcgggcgcactgcagtcccgcactcggggctcttcttccggtcacctgtagagcccggccgaggaatggaataacaggcgtc

SEQ ID NO: 8366 - DNA, 268 bp, Homo sapiens
aaaacaaagaatgtgtatttcttcaatagccgggtatttggattgttctcttgataatatttgaatgtgactcttggatttaagtgcactattattcatggcttatacaataaaattgcactgtatggcaaatatgtctataatgtatgctttgctgaaacctcaagagtgctgtaaggtacaggtttccatattgtgaacctgtgtacgcacacacacatatacatacagtcttagggaaaaaaaaaagcrgaacttttgtaagtct

SEQ ID NO: 8367 - DNA, 370 bp, Homo sapiens
cgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtc

SEQ ID NO: 8368 - DNA, 327 bp, Homo sapiens
tgtatacccgttaccaggttaaagagttgctttctcattagtgtttttgttatgaatgggtgttgaattttattgcatgcttcaaatggtaatgaaaattttctttaatctgttaatatggtaaattatagtatttttctgatgttaaaatatctttgattcttagggaataaggacaccttggtgtcttgtattagtttttaatacactgctagattgctaatgttttatttaggactttgaaattaatgttcataaatgaggccagcctgtaatttttgttacactgtatttgtctagttttagtattgaagttacacaggcttt

SEQ ID NO: 8369 - DNA, 360 bp, Homo sapiens
ttatttattttaagtttttatgtttttgcgtgttgctaatgtaagctggcagtccatcttcaagtttgctaatgctttcttttgsccagttwaaatctactcttgtgcgcttctagtgaatttttcatttcagctgttatacttttcaatttaagaatttctggccgggtgcggtggctcatgcctgtaatcccagcactttgggaggccgaggcaggctgatcacaaggtcaggagattgagaccatcctggctaacacggtgaaaccctgtctctactaaatatacaaaaaaaaaaaattagccaggcgtagtggcgggcgcctgtattcccagctaytcgggaggctgaggcaggar

SEQ ID NO: 8370 - DNA, 498 bp, Homo sapiens
caatgtaatagtgaacactccacacagaaaactcatcaccaaaatgtggaggaacttcttcccaccagcaatgcattttccatccgacactaactgggtgaacttatacttcaactcaattctgacactgtccagctagaattaggatcagatgctgtttactggttggtcagttccacagggctacccccacttcaaatgccggtcacaagttgcaggttgggacctgaacttctgggcgaccaackgtaaattggggattcacttgacccccctcctcaggttgtagtaatttgccacggtcattcaccgaactcaggacaacacttagtttactcatttattataaagtatgttgcaaaggacacagatgaacagccagatggaaaagctgtgctagctagttattcaaacccaaggaaagtgttagggaagcacattgaccaggtcagtcagagcgtacagsatatgaagtgagggcagtctgtgcgactgaac

SEQ ID NO: 8371 - DNA, 77 bp, Homo sapiens
tgccctcccaaagtgctaggattasaggcgtgagcactrkcacctagsscactgatcactcttctgcttacagaatw

SEQ ID NO: 8372 - DNA, 389 bp, Homo sapiens
ccaggatgtctcctgctgccctttcacaaccacacctgctacccttgttcctgccatctatcccctcgaggttcctaaccccgwyactaatctgttctctatctctagaatgttgtcatttcacgagtgttatataaatgaaagtatacagtatgtgactttttttgtttttttttgagatggagtcttgctctgtcgtcaggttggagtgcagtggtgcgatctcggcttgctgcggcctttgcctcccgggttcaggcaattctcctgcctcagcctcccaagtagctggggccagaggcgtgcgccatcacacccggctagtttttgtatttttagtagagatggagtttcaccatgttggccggggctggtcttgaactctggac

SEQ ID NO: 8373 - DNA, 358 bp, Homo sapiens
cagaggagcaaaagttattgctacaggatttgctgatcttggttttgatgtggacatagcccctcttttccagactcctcgtgaagtggccagcaggctgtggatgcggatgtgcatgctgtgggcgtaasaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgkatttggtcctgggactcgaattccaaaggctgccgttcaggtgcttgatgatattgagaagtgtttggaaaagaagcagca

SEQ ID NO: 8374 - DNA, 398 bp, Homo sapiens
ttatatgtttatctgtgccttcattagactagaatggtctctgtcctgatgttcctaatttttattaagaatttcctctctamccbtatccctgtcccaactctcaccgtgaattttgtcattctttgaatttgagtcaaaattgatttcttcttggaaataatattttgcttagtcaaatttaatgacattactatcctgggacattaagttgaacatttcttctgtgaataaaatgcattacatgttaatatatatttatgtttgagtgtgtatgtttgagagacagggcatgagaggagaaggacggaaagagagagggaagaagagacggaggggaagagggaaggtggaagaaagggagagaaaagaaggtggggaagaagaggtggagggaa

SEQ ID NO: 8375 - DNA, 405 bp, Homo sapiens
caagtatagtaactaatattccctcatgttttcctgtgtgccaaacacttcacaagaagggaaagtacttgcaaattcctkggbagcgtataagaccacaagatacctcagaaggggcggaataagaatcaaatgtacagcatagagtaatggaacctgagaatggagaatctggtgtttgcttgtgtacagctgaagggggccagcccckccacacctgtgggtgtttctcgtcaggtgggatgagagactgagaggggaaataggacacagagachmggtatagagagggaacggtgggcccagggggaccggcactcagcgtatggaggacccacgccagcactggkctctgagtkkcttcagtakttattgatcactatctttacaatctcggtgaggggg

SEQ ID NO: 8376 - DNA, 383 bp, Homo sapiens
gcggacgcagccggcccttctcaggtgcattttagtggttaccaggttgccacgtatttgaagtggtgtgagarctactcgttttggraccgttgtggatttkcaaataggaaaatcaaaaggcccaaagagacagctcactggaatcaaaaaatacaacttgtatgtgaacttgtgcaaatgtgtgaaacaaattaaggtgacagggcagaagcaacaaaatgaagctcaaatgaaatccacctctcaaagcaggtgaccatgctttgggattttcatagtttgagtaattcctatgggctctaccacccagcgagttaaagaagacaagattccasccccagggggttgtggttctgggaatgtgagcagcttgttttcag

SEQ ID NO: 8377 - DNA, 150 bp, Homo sapiens
aaaacaattactttacagctcagtgcaatgtagtatttaaagaaaaggtaggcattttgattcccaagtaaactaaagagaagaaaactgaggcttaaagaggcaatctttaatattggtatccttatttacaaagaaaatgagtgcaga

SEQ ID NO: 8378 - DNA, 412 bp, Homo sapiens
catgaacatattacacaaatacacatataatgcatgttgtgaacacagatgaatacaagcaggttcaacattaacttagtrtttgatwattaatcchaatacacataaatagataactttaatatcctcaaaactctcatacatatacatacttgtccactttttgcttctctattgataatcaacctcttacagatgtggctctacatgcagaagctgaggagagtgtggtattacttaaatcaccacaggtatcagatctgaatttctcaacaaagttgatagttttactttcctggcatatgtaatatggcattgcttaakattactatgaaataatgatgcatttaaatataaattttgakatatkctgaaccagagttcatktgatattttgaaccagatttgggtc

SEQ ID NO: 8379 - DNA, 378 bp, Homo sapiens
tttctgtgtgtggttttttttgtttttttttttttgagacagagtttcgcttttgttgcccaasctggaatgcagtggcatgatcttggctcactgsgacctctgcctcctgggttcaagcgattctcctgcctcagcctcccaagtagctgggattacaggcatgccctaccaggcccgactaacttttttgwayctttagtararacggggtttcaccatgttggtcaggctggtctcgaactcttgatctcaagtgatccacccgccttgacctcccaaagtgctgggattacaggtgtragccatggtscctggctggtttgagcttttckgatattacatamaatgctgtaacaataaacgcgtgactaaagt

SEQ ID NO: 8380 - DNA, 464 bp, Homo sapiens
caataagaaaattagcctatgtgcaaaatttaactgtatatactttctaaaataaatccaaaatccaaaaagtaaggtcaaaaggcattctgaaattttaccagtttgctaaagatcatattgagtaattaatagattctagaatgattacttatctgctgtaatacatctaaaataattaaactctttggtttgtgaaaatttcatttttattacttgatgtctacagtggtgaatcttcagtttttgtctttacttggaaagattactgattgttcagatatattatatgccaaattaaaggaaagaaaaacagcaggtagagcatgcattaagtgattaattcaaatgagctaggcctaaactttaggattcctggaacaaaaaatcagaaatctctgttttccttgattaatttttaaaagttagatttctaactcctcgtttgtaaaaactattatgac

SEQ ID NO: 8381 - DNA, 351 bp, Homo sapiens
cactgatcattagagaaatgcaaatcaaaaccatagtgagataccatctcacagcagtcagaatggctattattaaaagtcaaaaaataacaaatgctgaggagattgtggagaaaatggaatgcttatacactgttagtgggagtgtaaattagttcaaccattgtggaaagcagtgtggcaattcctcaaagagctaaaaacagaattaccgccggcatgctgactcacgcctataatcccagcactttgagaggccaaggctggtggatcasctgaggtcgggagttcaaaaccagcctggtcaacatggtgaaacctatctctactaaaaatacaaaaaattagctg

SEQ ID NO: 8382 - DNA, 51 bp, Homo sapiens
gtttacgtctcgctccggggcggaaagtgggtcagggccgggccggcggas

SEQ ID NO: 8383 - DNA, 159 bp, Homo sapiens
ttgtaaattttgttgattattttaaagaacaaacttttgcttttgtgggtttatttttctcttttgttctagcctcagttttgttatctctgttgtaatgtttattttcttatggtataagactgttattgagtttttttttttttttttttttttttd

SEQ ID NO: 8384 - DNA, 440 bp, Homo sapiens
ctctgccgcgcgtctctcaacctccgtggctagtcttgacgtggcgggttgctttccaaaatggcgcgggtgctgaaggctgcagccgcgaaatgcccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgrhcatggagtatctgttgtttttgtcaacctgggaaataccaagatggaactgcttcatccattgggacttgacagtccaattgcaggttttctgcagaaaaacaaggctggaggaatgcatcacatctgcatcgar

SEQ ID NO: 8385 - DNA, 438 bp, Homo sapiens
  misc_feature 401: n=a, g, c or t
aaaaagggattttctgatactcagaagactcagagactgtcagtttaaaaaatgaaagtaatatagaaggggcaaagtggcatttatcattctatctctccaggctcctgtctctttaatcagctagcctgatttgcccagtaaatgattcctgagagtgtgtgtgcgtgtgtgtgtgtgtgtgtgcccgcgcgcgtgtgttgtagctctgtcaatccttggattagaaccaatgattgcagcttgtaggagggctgtccagggccagattgtacaatgtgtctcagtgccagagtatgagtggagataattacggagaagtcatactctctcacaccctcggctttcttgttgtgtccttcagcaaaacagtggatttaaatctccttgcacaagcttgngagcaacacaatctatcaggaaagaaagaaagaaaaa

SEQ ID NO: 8386 - DNA, 421 bp, Homo sapiens
tgtgaaacaattcagaatctggttgataatataaagactgtgctcactggtcataaccgacagcttggagatgtcaaacatctcttgaaaagctatggctaaggtaagactaataccatgaacacacatttactctccctctgttataaaatttacaagtagttttatttataggaaaaacagtgacattttgtaaataacagtttatctcatcacatcttccaatttgtttgtaactgagttaacttgtgttttcatcaactattttttaaagccagtagtagtagtttgaatttcatacacagagaagctaaggcttaattagattcctttattgtgatataacttgtaataaaaccaagatatgaacctagtctgagcattcagatatccagcttgtctttctctttcttagctatac

SEQ ID NO: 8387 - DNA, 401 bp, Homo sapiens
aaaagctaaccctcgggcttgaggggaataggctgactgtacgttccttctactctggcaccactctccaggctgccatggggsccmagcaacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccrctgctggaggtggcagagaaggagcgggaggcactcagaactgaggccgacaccatctccgggagagtgkwtcgtctggtagcgggaggtagactatctggagacccagaacccagctctgccctgtgta

SEQ ID NO: 8388 - DNA, 75 bp, Homo sapiens
attaattggatattgatgaaatcattggcctggcaaaataaaacatgttgaattccccaaaaaaaaaaaaaaaaa

SEQ ID NO: 8389 - DNA, 445 bp, Homo sapiens
cccagaggtctcacttcatcatctaggctggagtgcagtgcatgattatggctcacctcagcctctacctcctgtgctcaggtgatcctyccaacstcagctcccaagtagctgggaccacaggcacacatcaccatggctggctgatatttttttactatttttgtagagttggggtctcactatgttgtctcagctggtctcaaattcctggactcaagtgatccttccaccttggcctcctaaagtgttggtattacagttgtgaaccactgcacccagcccacaattttttttatttgcattaatatcaaagtaagattggagcatctcagaccatctaccatttacaatttacattaaccggccaggcacggtggctcgcgcctgtagtcctagcactttgagaggctgaggtgtgagtggatcaccggagtcgggagtt

SEQ ID NO: 8390 - DNA, 442 bp, Homo sapiens
acacacttgctccgttaggggcagaacacgagttttctctctgccctccaaccttcttagctgagactccctgtaacaaagaccgagtaagaagagaaaaacaaacagaagttwattagtatgtgtagctagtgtgcacttgggaggcacccagagaactgagtatgtctctggagttgatctcaaacaggtagtttaaacttcaggcttagaaaccttctccatggttcaggagtctagagatctagtcgttcttctctctctggtgcagagaggaaggcacccttacaaatggacagttcctttattgacggacatttcctttacaaaatggctgccaacatgaagacactggatgcggaatcaggaggagatgtatacagctcagtctccaaagccaggacaagccagctccaacacactactggctgaatctcaccaa

SEQ ID NO: 8391 - DNA, 419 bp, Homo sapiens
  misc_feature 1,242: n=a, g, c or t
nvccaccccccgcgcctacgcaagttttccggatccgtccacccccgcctccctcctagtgtacggaagctgagagggcccgcgggtaggcatggcggcgcaccttaagaagcgggtttatgaggaattcacgaragtggttcagccacaggaggaaattgctactaagaaactccgactaacaaaaccaagtaaatctgcagcactccacatagatctgtgtaaagctacctccccagcgnvatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgc

SEQ ID NO: 8392 - DNA, 74 bp, Homo sapiens
ctctttccggtgtggagtctggagacgacgtgcagaaatggcacctcgaaaggggaaggaaaaaaaaaaaaaaa

SEQ ID NO: 8393 - DNA, 463 bp, Homo sapiens
aatgccagatgatctatcattgtctcactttgcccccagataagaccatctagttgcagaaaaataagctcagagcttccactgattctacattatggatatgtgccgccgaagcaagcacaaagccctacttttacacatgcctagtgatgcgtcatggacaaggcttggctctgttgagtccaactaacctacctgagattctgagatttctcttcaatggcttcctgtgagctagagtttgaaaatatcttaaaatcttgagctagagatggaagtagcttggacgattttcattatcatgtaaatcgggtcactcaaggggccaaccacagctgggagccactgctcaggggaaggttcatatgggactttctactgcccaaggttctatacaggatataaaggtgcctcacagtatagatctggtagcaaagaagaagaaacaaacactgatctcttt

SEQ ID NO: 8394 - DNA, 393 bp, Homo sapiens
aaacaccacagcgttctcggtggtgggctgaatggactcgtccacatgagggggatcttcatcaccatcaactcttarrrtccgrgaacmtavssacgaaaggagsagcccccagatcagagagcaacgcatgactatctgcgtgtgcttctgtgactacgcggatgttgtgggcggctacatgcgtgcgggggcccggcgagctgggcaggtgccccctccgggccgtgggatctgctggtctcttgtggctcagcgccgtgcggaggttgaagcgtacctgcggaggtcgcaccagggcgtgaggasgaggaggaagggcatgagccgagcttgaggaatccgtgctccaaactctacactcaagggtggcccttgggtagggtgaagatc

SEQ ID NO: 8395 - DNA, 360 bp, Homo sapiens
cttttttttcctttcctgattccttgtgtatgtgtggctgggccgcccctcttctcggctcagagtcacggagtgccttgaactaggscccacstcgccggggcggctggttctctgtttgtgggacgctggtgtctctggaggcccttcctgagaagccgtcgccagagttacgtcgcggttttcttaactttagagcctgggggccggagaccctgattgcactcgacctggctctgccctactctctgcgtgacttccactgttcatcaaagaaaaagggttcttttggtcamccaccactggccccatggctgccgtgcagatggatcctgagctagccaagcgcctcttctttga

SEQ ID NO: 8396 - DNA, 314 bp, Homo sapiens; identical to SEQ ID NO: 7928

SEQ ID NO: 8397 - DNA, 439 bp, Homo sapiens
  misc_feature 268..270: n=a, g, c or t
atgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaannntactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaag

SEQ ID NO: 8398 - DNA, 328 bp, Homo sapiens
gcaaaacaagggcagcgggcccggcgcggtggctcacgcctgtaatctcagcactttgggaagccaaggcgggcgaatcacttgaggtcaggagttcgagaacagbmtggcccacagggtgaaactctttctctactaaaaatacaaaaattagcggggcttggttgcgggcacctgtaatcccagttactcgggaggctgaggcaggagaatcgcttgaacccgggaagcggaggttgtagtgagccgagatcgcgccactgcactccagcctgggcgacagggcgagactcccgtttcgaaaaaacaaacaaaaaaaaaaaaaaaa

SEQ ID NO: 8399 - DNA, 398 bp, Homo sapiens
ttcattttttccatgtggatgtccagtttttccagtgccatttattgaaaagagtgtcttttctccactgcattgtccttgctcttttgtcaaagatcagtttactatctatgtgggtctatttctgtgatttccaccctgttccattgacctgtttgttctttcaccaataccacactactctcttgattactgaagctttatagtaagtcttgaggtcaactaatgtcagacctctaactttgctcttttccttccatagtatgttgctattctgtgtttttttgctaatctgtataaactttaggatgagtgtcaatatcctcaaaataacttgctgggattttgattgggattgcattgagttagtttacagattagcaaaaaaaaaaaaaaaa

SEQ ID NO: 8400 - DNA, 96 bp, Homo sapiens
tacataagaaagcagtaagaagcaacattgcattatatacttttctccatccctgttcaaagaaataagtcccaccacaaaaaaaaaaaaaaaaaw

SEQ ID NO: 8401 - DNA, 557 bp, Homo sapiens
atgggttttcatggagttgatcttattacatccaccattatgctgcattctgtagggaacacaaaatgattcctctcctcaataaaccagtcacctagttgaagataaagggtgttcagaaaagatggtcacaaaacaattaggggctagattctgtgatccatgtgagatgccaatgatgtgattctggaaagcagaaggtgaggttgtgagataccctgcagcacataatgcccaaggctagggtggcgagtagagggcccctggtctggatctgtctacccagcttcattcctcccattcgtgaaacagtggctgcaccagccaggaagcatctgagaccacctgattctctggaataatagctgctgaggtttgtgctgtgagctataacactgaattgccatctggtttcccacagcaggtggccatttacatcaccacgacagtgtccacaggagttccagttccctaagttctcaccaagactggtcattttctgttggaaaaaaaatcctaataggtgtgarggaaagctgcacctgtgcacatgacag

SEQ ID NO: 8402 - DNA, 446 bp, Homo sapiens
aaaggccagcctgatgaggtctcagatggaaatgaggaagttatggggaactggagcaaaggtcacccttgttaagccctagcaaagaacttggctgcattgtatctatgtcctagggctttgtggaaggctgaacttaagagtaatgacttagggtatctggtaaaagaaatgtctaagcatcaaagcattcaagaaatggcctggctgcttctaatagcctatgatcagatattggagcaaaggactgacttaaatttggaactattaaatcaaactaaaatctggcctgagaaagcctcctcactcccatacttgagtccttaaggatgaaccataacctaactttgtaggtaggccaactgaaaacctaacttagaaggatgcttctgtagcaatagctgagcgtcascmaatcgcagcagccatgcttcagtgactcacag

SEQ ID NO: 8403 - DNA, 379 bp, Homo sapiens
ccttgtgcctttgtttttcagagggctctgaactcctacttcgagcctccggtggaggagagcgccttggaacgccgacctgaaaccatctctgagcccaagacctagtaagtgatgaggggagcgggascagtccgcacggaggcagtttgataccaggtagccctgcgcgtcctgggacctgccgtggagctgggcggacgatgctgaggcagatctccaagctgcgtascagaggagcagggcttgcgttgctgctgctgcgcggagttgcgccccagcagcggatctaacactgcaccagactgtcgcttcgaacgtgatttggggtccagggaggaaaagatggaaatgtaatgtttaactcaaatgaaaggaa

SEQ ID NO: 8404 - DNA, 155 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtcca

SEQ ID NO: 8405 - DNA, 73 bp, Homo sapiens; identical to SEQ ID NO: 7980

SEQ ID NO: 8406 - DNA, 221 bp, Homo sapiens
agcaaattgagattccagamagacctcacagccagcaagttggagagctgctttttgatgctagacagttggcctctgcttgtaatcttaataccccagaccatctttccatgtggccctcataggccctaraacasbtgctcaggggaatcccggagcaagasrtgagcacaggtgggagattcttcgcasactgtctgcagctcasgctaaggtgcgak

SEQ ID NO: 8407 - DNA, 68 bp, Homo sapiens
aaadcttaccacctgcacccggaragctgtgtcaccatgtgggtcccggttgtcttcctcaccctgtc

SEQ ID NO: 8408 - DNA, 398 bp, Homo sapiens
  misc_feature 37: n=a, g, c or t
agaagggagcgaaggtttttgctgcgccaacgcatrnccgaagctccgctcacgcccggcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgargtgctggtgctgggtgggggcartggcggaatcaccatggctgcccgcatgaagaggaaagtkggtgcagagaatgtggccattgttgagcccagtkagagacatttctaccagccaatctggacactggtgggtgctggtgccaaacaattgtcctcatctggtcgtcccacggcaartgtgattc

SEQ ID NO: 8409 - DNA, 229 bp, Homo sapiens
cccagcaatagacggtgcctcagcctgccgagccgcagtttccgtggtgtgagtgagtccgggcccgtrtcccctctcccgccgccgccatgggctgcacgttgagcgccgaagacaaggcggcagtggagcgaasaakatgatcgaccgcaacttacgggaggacggggaaaaarcggccamrakragtgaagctgctgstactcrgtgctggagaatctggtaaaar

SEQ ID NO: 8410 - DNA, 108 bp, Homo sapiens
tggatcaaagacctaaatgcaagatctaaaccttgcattagaaaccttcccataagaatatggargaaggmcgggcacagtggctcacacctgtaatgccagcacttt

SEQ ID NO: 8411 - DNA, 329 bp, Homo sapiens
agtgcagcgcaccgcggggagcgaggagcgcgcggaccggccatgggcaagtcagcttccaaacagtttcataatgaggtcctgaaggcccacaatgagtaccggcagaagcacggcgtccccccactgaagctctgcaagaacctcaaccgggaggctcaacagtattctraggccctggccagcacgaggatcctcaagcacagcccggagtccagccgtggccagtgtggggagaaccttgcatgggcatcctatgatcakacaggaaargaggtggctkatagatggtacartraaatcaagaactataacttccagcagcytgr

SEQ ID NO: 8412 - DNA, 271 bp, Homo sapiens
  misc_feature 208,210: n=a, g, c or t
tttgttttcgctccggattctccatgttggacccaaactgaggagcccggagctgccgctgggggatcggggccgggggsacccsggggravcagykgcccgggccgcccgccctttgtacaggccgcctcccttcccggtccggggaggaaacgagaggggggatgtgaacarctgtggaagtcggagtctcgggagccggagcgdnhncccgcccakgccccccagcccagcccarcccgcgcgcccgchcgthctcccgcccagccar

SEQ ID NO: 8413 - DNA, 492 bp, Homo sapiens
atacatgagctatttatagcatttcaagttaatccttttgcgccggggtggaaaggtgcttgcaatggatctgttaactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctastgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcataga

SEQ ID NO: 8414 - DNA, 391 bp, Homo sapiens
attattttaactcttctccttaggacacgcagcccccaatttgtccctccggcctgggcggcccctggtcccgcgcgccagcatggggagagcgaagggacctgcccgcggcccgccggcgtgtgcaaggaggtccagccgccgcgcccgctacccggagtctgaggacgggtgtccagggacggagaggcaggtgagagggaggtggctaagctggctatggtgacaggacgatgttggccagaaagagtatcatcccggaggagtatgtrctggcgcgcatcgccgcagagaacctgcgcaascgcgcatccgagaccgcctccccaaagcccgcttcatcgccaagagcggggcctkcaacctggcgcataagaacatccgtgagcaa

SEQ ID NO: 8415 - DNA, 73 bp, Homo sapiens; identical to SEQ ID NO: 7980

SEQ ID NO: 8416 - DNA, 283 bp, Homo sapiens
  misc_feature 232: n=a, g, c or t
agtctccgcgtctccctcgcgaactcggtgaaaggaattggcgccgttcgacaccaggcggatccgctctgcagcacgaacccatctccagccgcagccgsagccgccgcccgggccgaggagcakccgcagcagccgccaccartggccgagtgarcggaccgagtkkgaggcagcgcctagcggtgaatcggggccctcaccatgagttcctcccctgttaatgtaaarnagctgaaggtgtcggarctgaaagaggagctcaagaagcgacgcctttctr

SEQ ID NO: 8417 - DNA, 340 bp, Homo sapiens
agcttccgcctggacccagcctcgtgggagccccgcgggtcctgcccagatgtggaagactgaggcctgttgaaagtgsagagstcagccctggcaccctctgttcccaagagctccatgcaggtgccacaggatggagaagaccttgctggccaaccttggtaccacggcctcctgtcccccagaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccas

SEQ ID NO: 8418 - DNA, 226 bp, Homo sapiens
aaaaacccactgatcctgatgcgcgcgcctccgctgtgccaggggcgccgggaagcccgacgacgacggtgtcgtaaaagsgksgsgaaggygtscgcccttggcggcttcctgccacctgkataagtkgagcgtgctggggtgtgtaaagtagtatggaggcagcggtagcccagtgtctgartrgttvccgggtctccatggagaagcggctcgccagtgtccc

SEQ ID NO: 8419 - DNA, 53 bp, Homo sapiens
cttcgccctttgtgtcctccttctttcactaacttctggactttccagctctt

SEQ ID NO: 8420 - DNA, 67 bp, Homo sapiens
taccttgccgggcgcggtggctcacacctgtaatcccagcactttgtgaggctkaggcgggcagatc

SEQ ID NO: 8421 - DNA, 484 bp, Homo sapiens
cagttgccagagtgcatagaggagggatgaggcatgagaaggtggtagggaaggagacaacaggactgattatacagaagcaagaagacttaggaaccatctgaatgtgagattcaggacaaaggcaaagacaaggctaaccgtgaacgttatcacatgtcttcttgtgcgaaacataattcaggagttagctgatgcttggtgttgatgatgtaaaatatgaagagcttacaggacatccagatgcaagtcttcaatagacatttaggaataagatctggacttctgagctgttggtattcaaattagaaattttagagtgaaacaggaggtgacagttatagctgtggaagtagatgaaatgccctaaggttgcataaagcattttaagtatgggatctgcatctcaggaataccactgcttaagtgacaaataatgagacacatttaatgggaaagaaagagaggatcgtatgagggtatt

SEQ ID NO: 8422 - DNA, 52 bp, Homo sapiens
twtttctctagacgcgtcttgctgggagagtgtccgttgcttcccgtccgtg

SEQ ID NO: 8423 - DNA, 50 bp, Homo sapiens
argcgcgcggggattdgcgggatgcggcgcgccgcgcgtgaacctccttg

SEQ ID NO: 8424 - DNA, 490 bp, Homo sapiens
  misc_feature 188: n=a, g, c or t
aaaattcagtttctcacacatgtgaagtgtccagtagccacacgtggctagtggtgaccgtattgaagagcaccgctcatagcacacctccctcactgcggaaagttctgctgtacagcacccagcacagccctgctgcccaccctgcagcctgtggcccagtagcaccagcacccaccagggtgagnactctcaggcctgcccaacctactaatcagaaccagcatctcaaggagatctcgggtgatttttgcaaacactgaagttggggcagccctgaccggagtaaccttccctcatttcctcctgcagctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagc

SEQ ID NO: 8425 - DNA, 157 bp, Homo sapiens
  misc_feature 96: n=a, g, c or t
caaaaaattagccgggcgcggtggcgggtgcctgtagtcccagctactcgggaggctgaggcaggagaatggcgtgaacctgggaggcggagttvncagtgagccaagattgtgccactgcaatccggcctgggctaaagagcgggactccgtccam

SEQ ID NO: 8426 - DNA, 83 bp, Homo sapiens
ccggaggcggagttccagtgagccgagatctgcgctccaacctggggacagagcgagactccctctcaaaaaaaaaaaaaaaa

SEQ ID NO: 8427 - DNA, 504 bp, Homo sapiens
ttaaggccagccaaacaaaattttttccccaaaattcttaaaatgcttaaaataggcaaagtgattcagaagtttttaggagtaggaaggagaggcggtacgtacagatatgtttctgtatgaatttcaaatgaataagcaagggaaaacttaataggtaggaggcattagtcttccttaggcagggaataattattatttcagcaatgtacatgtagtaaagttctacaattttaattcattctagctctaaaaattctatgattttatccttttttctgttcttttaaacttgttcctgtacaatttatagactttttttctgagaaaaatcttcctggagaaaagattgttaggcccttcaataatagggagtttctcttaaaataagtttagccgttttgttatttaagaaatgatttggccgggcgtggtggctcacgcttgtaattgcagcactttgggaatcgaggcgggcggatcatgaggtcaggagtttgagac

SEQ ID NO: 8428 - DNA, 395 bp, Homo sapiens
caataatactttttctgggtagacattttttaatgatagtgataggctttaaattttagaactatttagaactatttaagatacyttttkkaaatctaaagatttttaaagctgtaaaaagcatgatgaaatcttagatcactgctgtatctaagtttaagtggtatagttatccttctaataagtctgcttttctgctaatttcaaaacactttttttcactgaccattaatcgacagttcttaatgatcacaagtgtcacttactcacagctgtcttagcaattctttttagtggaactacagctactaattccttgaactcagttgacacacatgagttatacttkcttgttcatttttcctttcactatgttaggcaccccctgtaatggc

SEQ ID NO: 8429 - DNA, 438 bp, Homo sapiens
aaggtcggcggcggcggcccgcagtcgtggaggagcggtgggagcgtcggcggccgcgggcgatgcaacttccggacgggactycccctctgtccgcgcctcacatctccccttcctctcgcctagtcctgtgccgttttccgtccgcgactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttact

SEQ ID NO: 8430 - DNA, 73 bp, Homo sapiens
ctatctatctatctatctatctatctatttttgtccaggtttcctggcttgtaattcccatagcccttgttac

SEQ ID NO: 8431 - DNA, 79 bp, Homo sapiens
ccggagggcggasttccagtgagccgagatctgcgctccaacctggggacagagcgagactccctckcaaaaaaaaaar

SEQ ID NO: 8432 - DNA, 232 bp, Homo sapiens
cacaacccagattaattagtttaacatgctgagtgcagtggcacacacctgtaatcccagcactttgggaggccaagatgggaggatcacttgagcccaggagttcaagatcagcctgggaaatatggtaagacctggtctctacaaaaaattttaaaaattaagcatggtgtcctgtgtgtgtagtcccagctactcaggaggctcaggtgggaggatcacttgagcyaga

SEQ ID NO: 8433 - DNA, 79 bp, Homo sapiens
ctctcgcccctactctttctggtgttagatcgagcaaccctctaaaagcagtttagagtggtaaaaaaaaaaaaaaaca

SEQ ID NO: 8434 - DNA, 427 bp, Homo sapiens
gtaagtttctgtgaaattcagtacatccttaagactatagcattttagtcagatagaagagattagattctttctctgggktgcctgakggtkgcatgggtgtrtgtggggcgagtgatgtggtattgctttctaatcaacttcttactgccttcaggcattatcagtgttctttcttcctggatgtcagagccacttctaataatgactgctttcagctaaacaacagtaggcattctcttcgaaggggtaaaaatgacttgggtcatttgtaggctgcagctcttcatagtcattcaaattcagcatattctgatggacaaggccattacacagtattaatagctttaccatctcaccatgatagtgattacagtagttctttaatatcgctgctgaaatgaaagagataaatctacacatgaga

SEQ ID NO: 8435 - DNA, 309 bp, Homo sapiens
  misc_feature 226: n=a, g, c or t
atggctgattccatggctggcacgggaaaagagcaatatcttgtacaagaacatcctgtgccagaaggtaagaaaatattaaaaggkkgatggaaacatgttaaaaagacacagaagccagcatgaaaatgcctggtgattaaggataatttgagcattgaagtaaatgatagaaatggatgccattccatagattaaataagaatctattddtccatactgatancagtaaatgaatgaatgaagaaataggaaagaaggaaaacctcttcttttaggtagaatgccagcaaataaagatagaaacar

SEQ ID NO: 8436 - DNA, 586 bp, Homo sapiens
atttttggcattcaccttgattataaaccttatctctctacactataatcatcttcccagtaacctggaaacacctacaagagaacagaaactgtttcttgctcctttttatatctctggtgcataatatgaggtctgtgtgttaggagcatgctcagtgaaagaccactgaagttgagccccacccagatgtgagcatatgaagatgaatgttggtgaaagcatgcgtcttgcatctggagaactgccttcctccgggagagccatcaacaaccacccattactgtgcagatgatgggactaacttcccttatccatgtgggcttctctgcccagctccccgccactgaggatgtgtttttgcaagacagtcaaagaagagacaagaagtaagccagcagaagccggtgagccaagtaaccctaactggtccacacaaagattgactgaatgactccaacatcatgaactgatcagttccaaagtctactcttcaagaacatgaacaatcatatcattttaaagataatttaatcctcacatggaccaaagtttttaaagaaacaactattcaatcatcggctaa

SEQ ID NO: 8437 - DNA, 423 bp, Homo sapiens
ctgggttattatgaagcatctactgtgaacactcttgtacttatcttttgggggcacctgggtacccatttctcatggtcacgtacctaggagtggcattgctgtgttaragggtacgttatagggtatgtgatttttgtaggttcttctttatcctatcacgattacatttttttacttttgttcaacctrrtgtagactcaccttggtcacaatgcactgtccttttwatatattgctagattcaatttgaagaatattttgttaggattttarsarctctggdtacaagrcgcygggctmtaaakttdawdtcywtataatgtttttgtcaggwtttcctgttaagatgatgctggacttagaaaagcagttggaaaatgcttttaaaatactctttggaagaatttatgtaatattcak

SEQ ID NO: 8438 - DNA, 465 bp, Homo sapiens
tctgatttggggacatatatatatatatwtgatgaaagggaatcacaaagggcaagatttcaaagtttccagactgagagaaaagagtgtgaaatagttcatgaagtgagaacacagacagttagaaagggactgtgggtggtcaggcctagatttagattcttcccaactccagtggctgactcgatgtttgccttagtcaagtaatgtcattattctgagccttgcttgagctcctcacccattaaaagggggtagacaatacattcaggatagttataaaggctaaataaaaaatgtaaaatatatgtaaaatgcatacccagtgtctagcatatggtgtcaataacttttggttgttcttgttgctttttaatcattataataatacctatttgatcagagtccaaggctggtcacctttgaactcctagggctcccatatcctagaagtgaaaatactag

SEQ ID NO: 8439 - DNA, 304 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggaggctgaggcaggagaatggcttgaacctgggaggcggagattgcaagatcgcaccactgcaccccagcctgggcaacaaagtgagactccgtcgcaaaaaa

SEQ ID NO: 8440 - DNA, 68 bp, Homo sapiens
ctcatgggtrcagctgccgccacccagccctggctgcagrcccaggcatccctgcactcttggaggtc

SEQ ID NO: 8441 - DNA, 125 bp, Homo sapiens
ggagtgcaaaaaattggctgggtgtggtggcgggcgtgtgtcgtcccagctgcktgtgaggctgaagcgggaaaatggcatgaacckgggaggtggagcatgcagccagccargatcgggccgck

SEQ ID NO: 8442 - DNA, 355 bp, Homo sapiens
catttaaaaataaagttcctttatatttctgtcccatcaggaaaactgaaggatatggggaatcattggttatcttccattgtgtttttctttatggacaggagctaaatggraagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagag

SEQ ID NO: 8443 - DNA, 330 bp, Homo sapiens
caattttgttcttttcaaagaaccaacttttgggttgattgattttttttttctctactgtttttctgttctctatttctgctgkgttctttattkaawtttkdcctttkgtctgctttgagtttagtttgtctttttckaatttcttagaaaattaggttatggatttaagattttttttaatgkagtcatatatagctataaatdkccctgtaagcattgcgtttacttcatcccataagttttagtatgttgkgkttttggtttcaattttcccaatatactttctgatttgcaatgcaatttctttggcttackggttacatagaw

SEQ ID NO: 8444 - DNA, 403 bp, Homo sapiens
acaaggaagtgacatgacttagttttaaaagagcactatattgtgtggagaatgtgttgggaggtggaaagaatacaagtaggraaattawtttargagtctaggcaagacatgataggggcttggattatggtggtgacaaactaaaatcctgttttgtttgcaattaatagacaatgaaaaagtatttttgaatactgatttgaaaatcttacttattttgcctccaaagcatacatttttytttyctgtctttgctaaatcatttaaatccaagggttccaaacttttttttttyckgcacacagtatgcwartggkggttgctttwaawattccagagcyctgwagtcaaratcttgagtgtaggabttggttggggtggaaggactgtaataagttgr

SEQ ID NO: 8445 - DNA, 419 bp, Homo sapiens
tatgttttaggatccatataacagatagggaatcagtcatttaatttactctagaaatgtatttgtgatcaaggagatactgttgattagtagtatttttctccatctgttgaagaaaaatagctgcagaaactggatttgaattatgaggtcttttcccaccatgataaaaagtttttagccgggtgcagtggctcactcctgtaatcctagcactttgggaggctgaggcagaggaatcacttgagctcaggagtttgattgcagcctgggcaaacatggtgagaccttgtcattacaaataattctaaaaaattagctggacatggtggtgcgtgcacgtggtcctagctactcgcgarggctgaggcaggaagattgcttgagcccagcagtttgargctgcagtgagctctgat

SEQ ID NO: 8446 - DNA, 265 bp, Homo sapiens
tccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagtaagtaccaaataagtgtcaatgctgaaagtctctttattatgctagaccatgagtgtttaaatgctttcttctatatccatatccaacacttcatattatttttaa

SEQ ID NO: 8447 - DNA, 67 bp, Homo sapiens
gagattgctccactgtactccagcctaggcaaaggagctagactctgtctcaaaaaaaaaaaaaaaa

SEQ ID NO: 8448 - DNA, 238 bp, Homo sapiens
agcgacccgcggtgctaaggaacacagtgctttcaaaagaattggcgtccgctgttcgcctctcctcccgggagtcttctgcctactcccagaagaggagggaagcacagtatgaagactttggagactcaaccgttagctccggactgctgtccttcagaccaggacccagctccagcccatccttctccccacgcttccccgatgaataaaaatgcggactctgaactgatgccay

SEQ ID NO: 8449 - DNA, 449 bp, Homo sapiens
cacagtattatttatttctcaagaagagatttgttcatcatagtagtattagtaagtattccctgaaaaaaattcaaatattcaaattaagttattgctttcgtamccataatcattaggaaaactctcaaatgtgatgctcacttttatcctgtgtttatacaaatttacttgagaggatttttatattcaacaaaaatgcaaacaagattttaactcattgttcagcaaaagggtcgaataggaaaaaatcaagattagtaaaaatgttttaatttataaaatgagaaaaagtaaatgatgagaaatagaaaggaaataaaaggaaaaaatgagacaattatagtaatatacttaagatgaaattttatatcttgagaaaaaggtaaagagttaaatgtcaaaatagaatgtgtaagatagaaaagaaaggaatgcaagactgctaa

SEQ ID NO: 8450 - DNA, 73 bp, Homo sapiens; identical to SEQ ID NO: 7980

SEQ ID NO: 8451 - DNA, 349 bp, Homo sapiens
atacttattttcttttagaaataatgtattgtgtctgtgcagaaaaaaaaaaaccaaaaaggrttgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaa

SEQ ID NO: 8452 - DNA, 547 bp, Homo sapiens
tatatctaattattatataaactggaatcatccttttattctctctgctatcccttgcaaaattgcagacatcacttaagtcccactttgtacatgaagtcctctttgagtataatgcagtttatcggggggacaccctgggttagaaagaaacaatcagctttgagattcagataacctgaagtctgcaacttgctaactaggtgctgttgaaacacccagttaacttctctgagcttaaatatctttgtctaaactatagaaaatatgataaacattaacaccacagatgtttgtgaatagcaaatgtaataatgtaagggacagaactcagtgaacggtaaagcagtatataaaatttaatcatcagttactgacttcccacttgtctaatctccagtgttttattatagaagaaacatagaagaatgtagaattattattgtaatgattatcattgtaaattcataattcaactgaaaaacrtttacttagaaacttttatatgaaccatatagtcaaaatcatttgagtgctcactaggtgc

SEQ ID NO: 8453 - DNA, 75 bp, Homo sapiens
agttctggccgctgtcccggtgcgcacggacgtggctcgagtttcctctgctctccgctctcgccttgcagcacm

SEQ ID NO: 8454 - DNA, 368 bp, Homo sapiens
acttcctccccgccccaggmaacctgccatggcctcctggtgarcygtcctcatccactgctcgctgcctctccagaaccttggtgtgaacttaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacacatacagtgaatccatttaagatactctgacccatggatcccctgggtgcagccaagccacaatggccatggcgccgctgtctggccgcactgctatttcagctgctggtggctgtgtgt

SEQ ID NO: 8455 - DNA, 349 bp, Homo sapiens
ttgctgttagtatgtggattaaggcagatcattggactgtcattatgtgcatttacaaatacaacatcctttgtgaaaggaagagtaatttttagtaatctatgtagtttatgagctctgtatcattttgtcattgactttgatgcagattagattgactttttaaaagcatgcttttgaattattgattatcatataataaagacaaggttttacataaaagataagagaaaaatgcattttattctcaagaatattttaaatgaatcatacttacaaaatagtttttatcattagttcaccaatagctgtaactcctctgatttaactttagattatatcgcatact

SEQ ID NO: 8456 - DNA, 350 bp, Homo sapiens
attgcgccgcggcacggcctagcgagtggttcttctgcgctactgctgcgcgaatcggcgaccccagtgcctcgaccackatgcccgcgbkcttkcctcgtcaggaagccctccgaccccaatcggaagcctaactacagcgagctgcaggactctaatccagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctc

SEQ ID NO: 8457 - DNA, 73 bp, Homo sapiens
atgttagctgtggccactgtggatttttcgcaagaacattaataaactaraaacttcaaaaaaaaaaaaaaaa

SEQ ID NO: 8458 - DNA, 378 bp, Homo sapiens
astttctgagggttttgtgaaagagggcacatgaggagaaaagcttgtcccaatcagactcactttacatggatgamgataakcactggtstggtgaggtggaactggaagtcattggcaaggtaccaggtccagccattgcactgawaagagagcagcawaggtcactcttccttcatttaccagttctgctccacactctccacctgcctggactaggaggaagaatttagtaggtggaaagaacatgttcatttagaaccagggcttggctccagatgatgttttgtggagaaccccagagttcccatggatgattgacatggtcaaaatgagttccacagacagtccatgcttgtgccagatgagatggttacc

SEQ ID NO: 8459 - DNA, 69 bp, Homo sapiens
atgttagctgtggccactgtggatttttcgcaagaacattaataaactaaaaacttcaaaaaaaaaaar

SEQ ID NO: 8460 - DNA, 77 bp, Homo sapiens
catactaagctggtggaggatgggctcaacctccatgagagargagcagccaggatcagggggcattaacgttaatk

SEQ ID NO: 8461 - DNA, 494 bp, Homo sapiens
  misc_feature 400: n=a, g, c or t
cagatgtaaatcttgtacaagtcaaaatcaaaatatataaatcatgcatctcccagtgcattctaatgkgcctgcagkasargctggatcataaaaatatcagtcatagacctactcagaaaaaaggtttaacattggcaaaagattatagagtaaatactgggcttcaggttctagggaatttgcgaaaagccaataagacatagggaacaccaatagcctttcttgtgctaaatctctctcacagtccccctgttttgaatcaggccatgtcttcccctgggaaraaaagaaatgcaagttcacaaaaaatgttcttgtgaaaagttgtaagctgcatttacaactggggaagatttcagtctcagttgttttcttgctggtcatagatatatttgtnctttgcttgctatggagaaagattctgaactttcagaaaaaacttccaagtctagactccaaagaatatagtttatctttactatggcatttat

SEQ ID NO: 8462 - DNA, 421 bp, Homo sapiens
atgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaatkggattccccgttccagcctatactgtactgcagtgatact

SEQ ID NO: 8463 - DNA, 73 bp, Homo sapiens; identical to SEQ ID NO: 7980

SEQ ID NO: 8464 - DNA, 369 bp, Homo sapiens
gaaccgtggacagcaacatttcccacaggacacgaagtttgtcggcccttgccttggcagagctgaggcattttggagatcaaagatggggtaggaaaagatgctgctactataaaacttcctgttgatcagtacagaaaacaaattggtaaacaggattataaaaaaactaaacctattttacgagcaaccaaattaaaagcagaagcaaagaaaacagcaataggcataaagactcaccacggatgttgaccctgatctggaccaagatgaagattagctaagcaacaatcaatgcatgaaagagaaataactttacgaaagcaccttttgggaccaaaactttcaatactgaaactgtaacatctt

SEQ ID NO: 8465 - DNA, 480 bp, Homo sapiens
tmaacatgattaaytytygasgaaccctcaaagamaaagamacatgamamamtgatgtcctgtytcgmagtgtctkatktgracyttcargamgamgcaagamaatggtgtgaccactttggamaacaatttggcagttcttcaaaatgttatacatagagttactgtatgacctagcaactctgcggctatgtgtatacacaagamgaacaaaaatatattcacccaaaaccttgcacatgaatgttcatagcagcaatgttcttattcagttgggttgaatgtccacccaaatgtccaccaatgatgaatggataaacattatgtggtatatccatacagtagaatatttaacagtaacaagtaatggaatactgatgcatgctacaacatagacgaaccttgaaaacattgtactaagtgaaagaagccagtcacagaaggccacatattgtatgactacttacatgacatgtcaga

SEQ ID NO: 8466 - DNA, 508 bp, Homo sapiens
cgtgggtttttaaaagatatttttgtgtkmdtaaaaaaggactttctcaaagctgctcatttcaattttcttttaaatttgctcaccaacaccgcttaatcacctctgtaacctactggaagtgttctctagatgggctttaaaaattaagccaagttgatttcttttttgttataaattggcttagcatcttgtttttatctggcttgaaatattgaagcagtaaaataaaaccacactctttaattgaaaggtgcttctgcagtattcaaaccacagttgtcagtcacacgtgttgttcaaattcttcagagctccgaaattacttaaaggtatcctcagtattctgagagagttatttttgccccactacaaaataaaaaagagccaatcagggctttctcaactctttggcagtatttttcctctaaagaatttcttgacactctctttagttcttgacttccagggttgttcctgacaaatctccagaaatgtatctcagtgc

SEQ ID NO: 8467 - DNA, 460 bp, Homo sapiens
  misc_feature 82..85,109: n=a, g, c or t
aaaaatgagtgatagtaacaaaagatggataggcccttttatctataaatccagggctttagagtacttttgttaacagcrnnnnarrrrraaaaaatctaacgtattntkgacacttttttcttcacaggctttgtttgagtatatctttcatcatgaaaatgatgttaagactcagcaaaatccttttcttcaagtgaaatcttatcgagaccctaatacgtaaaacagacaaaaggctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtcycattggatcaacctgtgactgctttaaatcttttcaaa

SEQ ID NO: 8468 - DNA, 466 bp, Homo sapiens
tctccctgtggtcgtcttccacgttgtggaaggtttgttgtttcgcttcttgcaataaatcttgctactgcttgccgtttgggttcaggctgcttttatgagctgtaacactcactgcaaaggtgtgcagcttcactgctgaagccgttgagaccacgaatccaccgggtggaacgaacaactccagacgtgccrscttaagagttgtaacactcacctcgaacgtctgcagcttcactcctgaagccagcaagaccacgaacccaccagaaggaagaaactccgaacatatcctaaagtcagaaggaacaaattccgtatacgctgcctttaagaactgttaacactcaccgtgagctccgcggcttcattcttgaagtcagtgggaccaagaacccgccaattccggacccaggattacagggtcttgctctgtctmcbakgctggagtacagtggtgcgtcac

SEQ ID NO: 8469 - DNA, 121 bp, Homo sapiens
  misc_feature 17,107: n=a, g, c or t
tttttctccgcgcagcncagtcgcagaggaagatggcgccgcggagggtcaggtcgtttctgcgcgggctcccggcgctgctactgctgctgctcttcctcgggccntggccgctgcgagc

SEQ ID NO: 8470 - DNA, 430 bp, Homo sapiens
aggtataagttgtggagtagcagtcaaaaataactgtgtgagttttaaattcggtggtacagattccaaatgttacatgtcaccaaaaaaaagatatcattttgatatccctttagaattgggaaggttgtaaagggaagataatgcatgaagatccagcaatagggataattattatatatgtgaaacagtgaatgtccttttttaagacagtgaatattctttctttcaacatagctgatattcttctgttaacagtagcagggaggggaatgtcttggaagaagttggagcctcacattaggtctctcactatgggttaaggcagatttcagaggaaaaaacttatttctgtttctgctcagtatctggggagtatggaagtggttagtaagtcaagcagtaattcttcgtgactccatatcttttt

SEQ ID NO: 8471 - DNA, 332 bp, Homo sapiens
gactgtgtccggcgatgggcacgggcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaasacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgat

SEQ ID NO: 8472 - DNA, 445 bp, Homo sapiens
gatgatatcatagggaatcaaagctgtcttcttgtgctgagtcacttcctgggtgggagccacaagatcagatgagccaatttatcgatctggggtgttgccagctgatccatcaagtgcagggtctgcaaaatatctcaagcagtgatattaggagcagtttagtggtggtcagaatcttgtagccttcagctgcatgactcctaaatgataatttctaatcttttggctaatttgttagtcctacaaaggcaatctagtctccaggcaagaagggggtttgtttgggaaatggcttttattgtctttgttttagactataaactataaactaagttctcccaaagttagttcagcctacacccaggaacgaacaatgacagcttaaaggttagaaccaagatggagtcggttagattagatctctttgactgtctcagtcata

SEQ ID NO: 8473 - DNA, 375 bp, Homo sapiens
catctgtgtgtttagcctttcagggtaaactctagagggttcagtttataattcccacctttcacatatagttcaacaacattaatccagagagaawtttwatgttttatgatatgggttatgttttattatatatdtdatgttttatgatatgggttagggattctccatggactccagaaaccctaaaatacaattttgaggttttccaataataccatagcagaaatgtccaaggggttgggggaagatattactttgagaaaacagaaatgtaaaggatttttgaccttatatatgtgtgtggttttgtttttgtttttgttcttgagagagtctcactctgtcacccaggctggagtgcagtggcgtgas

SEQ ID NO: 8474 - DNA, 256 bp, Homo sapiens
atttcctggtctggagccggctgagccacagcaggtgtcggggcctcaaccttgcggascgacagccatcgatcctcgggtggsctcgargtggtkgcagggccgccccctgcagtccggagacgaacgcacggaccgggcctccggargcaggttcggctggaaggaaccgctctcgcttcgtcctacacttgcgcaaatgtctccgagcttactcacatagcatattggtatatcaaaatgaaatgcaaggaac

SEQ ID NO: 8475 - DNA, 355 bp, Homo sapiens
caggtgaagaaactaaggaacagaggggttaagaagcttgcctggccacctgcagtggctcacatctgtaatcccagcaatttgggaggctgaggcgggaggatcgcttgagcccaggagcttgagaccagccagggcaacatagcaagaccctgtctctccaaaaaaaaacaaaacaaaaccccaaaaaactagctgggcatggtggcatgcatctgtagtgccagcactcggggggctgaggtgggaggatcgcttgagcccgtgaggttgaggctgcagtgagctttgattgcactactgcactctagtctggaccacagagcaagcctgtgtcccaaaaaaaaaaaaaaaa

SEQ ID NO: 8476 - DNA, 342 bp, Homo sapiens
  misc_feature 220..222,342: n=a, g, c or t
caggtgaagawactaaggaacagaggggttaagawgcttgcctggccacctgcagtggctcacatctgtwatcccagcaatttgggaggctgaggcgggargrtcggytkragcccaggagcttgagaccagccagggcaacatagcaagaccctgtctctccaaaawwwaacaaaacaaaaccccaaaaaactagctgggcatggtggcatgcatctrnnntgccagcactcggggggctgaggtgggaggatcgcttgagcccgtgaggttgaggctgcagtgagctttgattgcactactgcactctagtctggaccacagagcaagcctgtgtcccan

SEQ ID NO: 8477 - DNA, 369 bp, Homo sapiens
aagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggataaggactgtgtttctttccttttgtggaaaatkgtcattctgaatcttcaggvcaaacacatctggaaggtgatactgtacaaattatttgcaacacaggatacagacttcaaaacaatgagaacaacatttcatgtgtagaacggggctggtccactcctcccaaatgcargtccactatttctgcagaaaaatgttgg

SEQ ID NO: 8478 - DNA, 445 bp, Homo sapiens
taggtaaaatttaaaactgctctgatagtgttgtttgtgtaatgataaaccttcatttaaatattaatttaaatggtcaaatcttaatgataatgcgagttattgttgtgaagtaacagagaatatatttctgagcacttctgaccttaaaacaagtcacaagtcagtatggtgtggcgcttaagagcatgggcacaagatcccagacttatagttgtgtgtccttggagaaatgatttaatttctttgcatcaccatttttttcatatataaaataaggatataatgacagtacatcctaaatcatgacgatgttaacagagttaaatgagttvatacttgtaaagtgcttagatctacctggtgctcagtatttactcaataaatgtcagttgttgtwgttgttgttatatatttaatgcctctttagtgatagtgttctggc

SEQ ID NO: 8479 - DNA, 206 bp, Homo sapiens
caggtgaagaaactaaggaacagaggggttaagaagcttgcctggccacctgcagtggctcacatctgtaatcccagcaatttgggaggctgaggcgggaggatcgcttgagcccgtgaggttgaggctgcagtgagctttgattgcactactgcactctagtctggaccacagagcaagcctgtgtcccawaaaaaaaaaaaaaa

SEQ ID NO: 8480 - DNA, 138 bp, Homo sapiens
attacctgagaattccccagccgaaacggtrctggggcaagaaacttcttgttagaactttccacctccggcttccccctccacctcttttaccgtcccaaccttaggagacgctttttctcccccagaggagaattt

SEQ ID NO: 8481 - DNA, 67 bp, Homo sapiens; identical to SEQ ID NO: 8447

SEQ ID NO: 8482 - DNA, 269 bp, Homo sapiens
  misc_feature 95: n=a, g, c or t
agctgcgtgtccgggtgctaggctgcagacccgccgccatgacgctgcgcgcggccgtcttcgaccttgacggggtgctggcgctgccasgggtngttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagac

SEQ ID NO: 8483 - DNA, 270 bp, Homo sapiens
  misc_feature 206: n=a, g, c or t
tgttttatttttgtagagatggggtcttcctatgttgcccaggctaatctcaaactcctgggctcaagtgatcctctcacctcagcttcccaaarggatttaaagcatgggscatgatgctcagccacagttttcttttctkttcttttctttktgtttttttttgagaaggagtctcactctgtcgctcaggatggagtgcagtngcgcaatcttgtctcactgcaacctccgcctcctggattcggdsgattctcccgcctcagcttc

SEQ ID NO: 8484 - DNA, 317 bp, Homo sapiens
cacaacccagattaattagtttaacatgctgagtgcagtggcacacacctgtaatcccagcactttgggaggccaagatgggaggatcacttgagcccsargagtttcaagatcagcctgggaaatatggtaagacctggtctctacaaaaaattttaaaaattaagcatggtgtcctgtgtgtgtagtcccagctactcaggaggctcaggtgggaggatcacttgagctcagaaggcagaggctgcagtgagctgagatcatgccattgcactccagcctgggtgacagggtgagagtctgtctcaaaaaaaaaa

SEQ ID NO: 8485 - DNA, 312 bp, Homo sapiens
cacaacccagattaattagtttaacatgctgagtgcagtggcacacacctgtaatcccagcactttgggaggccaagatgggaggatcacttgagscccaggdrgtycaaagatcagcctggggaaatatggtaagacctggtctctacaaaaaattttaaaaattaagcatggtgtcctgtgtgtgtagtcccagctactcaggaggctcaggtgggaggatcacttgagctcagaaggcagaggctgcagtgagctgagatcatgccattgcactccagsctgggtgacaggggtgagagtctgtctcaa

SEQ ID NO: 8486 - DNA, 324 bp, Homo sapiens
tttatgtagtatgtgaaaatggagttgataaaccctaacctacgaggcagacttgttgtcagatatttgcgtgctgccctctaatagagtatacggtccctgtcatccagtcccctatgcagctgttttttattctgtgtagggtgtccaattgtcttctgcttgtgacagtggtatgatggtacatatttaacaaaccctttctgggaaaaataaccccaatttgtggtgtttgttgatttctgtggtataaatactcaccatgttccctggtagctacatgtgtgaccatggaattggaaagagatgcatgcagtggctctc

SEQ ID NO: 8487 - DNA, 203 bp, Homo sapiens
caacagtcttagcaaatgcagaccaggagctactatccagtgcctggctcggtggttcccacacccacagagccttgctcacagctagtgcagcagtcagagattgaactgcgaggcaacagcctggcagggggaggggcacctgccattgctgaggcttgagtaggtaaacaaagctgcctggaagctcaaactgggcggac

SEQ ID NO: 8488 - DNA, 355 bp, Homo sapiens; identical to SEQ ID NO: 8475

SEQ ID NO: 8489 - DNA, 328 bp, Homo sapiens
gcaaaacaagggcagcgggcccggcgcggtggctcacgcctgtaatctcagcactttgggaagccaaggcgggcgaatcacttgaggtcaggagttcgagaatagcctggcccacagggtgaaactctttctctactaaaaatacaaaaattagcggggcttggttgcgggcacctgtaatcccagttactcgggaggctgaggcaggagaatcgcttgaacccgggaagcggaggttgtagtgagccgagatcgcgccactgcactccagcctgggcgacagggcgagactcccgtttcgaaaaaacaaacaaaaaaaaaaaaaaaa

SEQ ID NO: 8490 - DNA, 58 bp, Homo sapiens
aactgcgrcgtcatcccggctataagcrcacggcctcggcgaccctctccgasccggs

SEQ ID NO: 8491 - DNA, 361 bp, Homo sapiens
cacttctgcttttggtgtcatatctaagaaaccattgcctaatccaaggtgacaaagatttacccctaagttctcctctaagagttttatagttttagctcyttacttttgggttctgtggtcagttttttagttaatttttgtgtatgttaatgagctgggtgttcaacatcattcttttacatgtggctttccagttatcccaccaccgtttgttgaaaagactattatttctccattgaattgtctcaacacctttgttgaaaatcagttgaccatagacacaggttatttatgaactcttaattctgtgccactgattcgtatgtctatcattttgccagtaccacactgtcttgat

SEQ ID NO: 8492 - DNA, 295 bp, Homo sapiens
ttgtggtttcctctattttgaattttttgatcaaaaaactgrttagcagaatatagtttggagtttggcttcatcttcctggggttcccctcamtsccttttttttgtcaaccccatctgtagcctcttcctctactcaggcagtcgacccgccacgatgagaagtgggaccagcagagggcgccaacttcaggagtccgctttcccamcaggcttcattcacccagtggacctgaactgtttggtagagscaaccggsccttccttcctcatcgttgtttggtatgcgcacagg

SEQ ID NO: 8493 - DNA, 333 bp, Homo sapiens
  misc_feature 112: n=a, g, c or t
gtaacggacggcggaggctacgtgaagagaggcgcggcgtgrstgagctacggttctggctgcgtcctagaggcatccggggcagtaaaaccgstgsygatsscggakgcgncggccaggccgagagsaggccgggcaggggtgtcggacgcagggcgctgggccgggtttcggcttcggccacagctttttttctcaaggtgcaatgaaagccttccacactttctgtgttgtccttctggtgtttgggagtgkckctgaagccaagtttgatgattttgaggatgaggaggacatagtagagtatgatgataatgacttcgctgaatttgr

SEQ ID NO: 8494 - DNA, 81 bp, Homo sapiens
aawactcatccacctctctgtcagagtgtctatgtggctgawtcgtttccagaaaakacctccagaaaatagcttcctgtt

SEQ ID NO: 8495 - DNA, 395 bp, Homo sapiens
ttagatttggtaatattttattttgcaattatttcatctaactacttaaaattaaaattaatccacagtgggttttctttgaatctagctctgttaggttttggtcyttggktcataaatgaattgtccaactcccttttggataatcaaaatgctcaacattttttcctttgcttgattttcagctaatagtgctggaccccccggtgagtatttgggtgccctctggcccatggctcaccccctggggtgcagctgccatggcgcagggataccagtgtcctccttggcctcttgtagagtctgtgtgcacttggacagcactgggcttccaagccccacctagcattgccagcagtcascttgtgtcctgctcaggcttaggctgtcagttc

SEQ ID NO: 8496 - DNA, 104 bp, Homo sapiens
  misc_feature 39: n=a, g, c or t
tggatgtcttgacaggggctttgcagggatttttagggntttttccacattgtccacattaatggttggcatgattgtgcttgcaggccaagaaatgatcatac

SEQ ID NO: 8497 - DNA, 403 bp, Homo sapiens
gaaaaaaaagctatatactcccctcacaaactggggacctcaagatctccaccctaaaatagttattttgaatttccccctggcaatgtaaaccgagagcttatctgsacaggtgtgggacagaaccaatccctctgcacacctgagacaaatgcctatctgattgcttcccctgccctattgtttacataaaaacgcagggtcactgaggcagtcgaaggcataagtgactattcctcctcccgctctcacatataaatbgtgtatttagtgaaaggttgatcaaagactcaaagaatgtgatcatttgttatctacctgtgacccggaagccccccaattccagttattccacctttccagactakaccaatgcatatcttacatgtattgattgatgtat

SEQ ID NO: 8498 - DNA, 91 bp, Homo sapiens
  misc_feature 38: n=a, g, c or t
ccttcccccatgaacttcagcctgtccacacaaaagcnacataaactcaagcaagaaatatgttcagccaaaacatgattatagtggcags

SEQ ID NO: 8499 - DNA, 416 bp, Homo sapiens
cagatgttaacagtctcagcccctaaatgtcaccttgtattacagcatgttatataagcacatacaggcacatacatgawatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaaaacaaaaaaattct

SEQ ID NO: 8500 - DNA, 432 bp, Homo sapiens
  misc_feature 386: n=a, g, c or t
cttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcantggtcaatgatgaattactaatgccttattttctaggcatataata

SEQ ID NO: 8501 - DNA, 462 bp, Homo sapiens
  misc_feature 119: n=a, g, c or t
aaaaagtcagcttaacagcattaaaagcaatttcaaaaaaaggaaacgaataccatatgatccagtaattccagtcctatgtatatctccaaaagaattgaaaacaggcccctggacanttatttgtacatcagtgttcatagtagtagcattgttcacagtagccaaaggtggacccaagatcccatcaacaaatgaatggatagataaaatgtggttcatccatacaacaaaatactattcagccataagawagaaagaaattctgatttatggtacaacatggatggatcttgaggacattatgctaagtgaagccagacacagaaggacaaatactggatgattccacttacatgagtacctagattaggcaacttaatattctacagaaattagaatagaggtttaccaggggctgttcagaggagggagtgggcattattgtttaatggctacagt

SEQ ID NO: 8502 - DNA, 451 bp, Homo sapiens
  misc_feature 94..95,146: n=a, g, c or t
tacacattaaaaatccaaagaaataaaagctcagtaaagggacagcatataagaagtgtttttaacaataaattgcattccttattgctaacanngggcvawttarggaaaaaatcdaattatactagaaacagaaccacataaanwtcttggaaattaccttaataaacacaaatgacctatgtgaagtahactgtaacacttgataaatttgaaaaacttacataaattttgaggataccatatttcaagccaacctaataattaagaatccaggctttgcattattgcagacctgggttcaaatcttgattctcgtaagtgttatgtgatcctggacacttaattaatctctcaagtatgtttacatctttccaatatatccaaatggatataacaatagtattggtgattgtaaggatttaagtataaaggagcttgaactaagtat

SEQ ID NO: 8503 - DNA, 365 bp, Homo sapiens
  misc_feature 123,125,127,212: n=a, g, c or t
attcccttcgtgccgctaccaagatggcggcgcccatcttgcggtccttttcctggggccggtggtctggtaccctaaatctctcagtattdargcccttgggggctgsgtaaggycbastcnandngctcaggggttactggcagcgsagaaggctcgaggtctgttcaaggavvwcttcccggagacggggacgaaaatagagctcccwnagctcttcgaccgtggcacggcgagttttccccaaaccatttactgtggcttcgaccccacggcagactcgcttcatgtgggtcatctacttgcgctgctgggcctgtttcatttgcagcgagcgggscacaacgtgatcgcgctggtgggar

SEQ ID NO: 8504 - DNA, 359 bp, Homo sapiens
aaagaataaaagaaactttggaaaatattttgacttggccaggtgtggtggcttacgcctgtaatctcagcactttgggaggccaaggtgggcagatcctgaggtcaggaattcaagaccattctggtgacatgataaagccctgcctctactacaaatgcaaaaattagctgagtgtggtggtgcccacctgtagtcccagctactctggaggctgaggcatgagaattgcttgagcctaggaggcggaggttgtggcgagctgggattgtgccattacactccaggctgggcaacagagcaagactccatctcaaaaaatttttttgtgaactacatactgtaaggctaaagataaa

SEQ ID NO: 8505 - DNA, 375 bp, Homo sapiens
  misc_feature 333,344,348: n=a, g, c or t
actgatggagatggtcaccagggagtgtccaggtcagaccgccacagaagagtgcagcctcctggccttcagacccaactgggacaaaccctgagaacagccttggcagacctccaggggcagctggactccctgaggctggatgttgcagcctctcccaggcatccactctgcagctgaggccaaagtttccaacgggaagggagggtgaggcttctatttgtttcccaagagccagctgacctttgaagctagtgataaccaccacaaacctcactggtgggagaacgaggcactgcagccagttctcatcaaccccacatccctgcaggndgccccaaggnbbrngrgtcaccatcctctgcaacgctgggc

SEQ ID NO: 8506 - DNA, 364 bp, Homo sapiens
tctaggcatatatcaataaatattttaaacagaaatggcctcattcagttctataacctaatttttaattttatttttattttatgactatttaaaacttatctgtattgatcttttgcttaacgcatgtatctatggagtcatttttgatggttgcatttttaaaagatatcatgttattaaccaacttctagttttgatcatttattttcagtttctggggtatttttcgggggtggttactgctgcaaaaaaatttcttaatgagtgactttgtcttatctgggggcagttatttccttaagattcattcctagaaatatttatttcaagtagtgtgtgcatttttaaggcctttggtagc

SEQ ID NO: 8507 - DNA, 401 bp, Homo sapiens
  misc_feature 294..296: n=a, g, c or t
cagcattcagcatgtgtcagattctgtaactatttctcctgtgatgtatcagtcagcttttgctgcaaaacagcatcagaaatctcagtggtctacaactagattcccattcttgggtagtctacaagttggcttctaggttatgctccaggctgggggtctgatcacgtctgctccacaacatgtcccgtattctgggtccctggttgamgcagcagcttaccttgggccrtgttctttctcatggcagaagcacaggaggccaagccctaccttgcaagcacaaatacaghnnntgctcactttctgttggccacaacacatggccatgcctsmsctctgtggggtgasgcagtgcatggccaaggmacaagcacagtccacacagggggctgtcactc

SEQ ID NO: 8508 - DNA, 421 bp, Homo sapiens
attcagccgccgctgtccccgctgcgcgccctcgcgcttctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaagggagacgtgttcgggcttcgagccacattcatggaggaaaatatgcaagtcttgcaaatgcagccaagaggaccactgcctaacatctgcacctagaagacgatcggaaaattggccgcttgctggatggactccaagtattccaccctcactgctcgggtgaaaggcggggacggcatccggatttacaagaggaaccggatgatcatgaccaacgcctattgctactggggaaagatcccac

SEQ ID NO: 8509 - DNA, 429 bp, Homo sapiens
caatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatgggctcarcawtcgkgcacagrggacatcaamccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatact

SEQ ID NO: 8510 - DNA, 406 bp, Homo sapiens
gaccaacagatacatgamaagtgctcaatatcactaatcagggamatgcaaattaaaaccacagtgagtggccagatgcagtggctcatgcctgtaaatcccagcactttgggakgccgaggcaggcagatcacttgaggtcaggagttcaagactggcctagccacatggcaaaacctcgtctctactaaaaaatacaaaaccacagtgaggtatcatctcacatctactagaatggatattatcaaaggcaaaaggtaacaagtgtgttgggaaaatgtgagataaagggaccctcttagactgttgatgagaatgttagtacaaccaatatggaaaatagtatgagtatggaagttctgcagaaaataaaaactgaacttccatatgatccagcaatcctact

SEQ ID NO: 8511 - DNA, 394 bp, Homo sapiens
tatataagtaaataaaagactaaggagtaattttaatgaaggatgtgaaatatttgtatactgaaaatttatagcattgttgaaagaaattgaaagtgacataagtagaaaaacatcccatatttatggatttgaaaaattaatatcgtcaaaatttcaatgctaccgaaagcaatctacggattaatgcaatcactgtcaaaatcccatgccattcttcacagaaatagaaaaattagtcctaaaatctgagtggaaccacaaaagactctgaaaaaccaaagcaatcttgagcaaaaagaacaaagccagaggcatcaggctacttgattttaaacaatattaaaaagttatagtacttaaaacagcatagcactagcataaaaacagacac

SEQ ID NO: 8512 - DNA, 427 bp, Homo sapiens
cattttatattggatgatttttttcatcttatatgcccctaccataccaaaagtacctattctagtacttaggccacaaacttggaatgtagtggagcatagtatcatggtaaaacccaggccgaatttgggccaggtgaacaagagcacaaaggattgagggtgtttatgaaaagttggatcatgaaacctagatcatgcatctaggctgatttaaggaaggaagtggcagaagagggcttttagtaagaaaatggatgagctaaaggaatggacaagattgaaatttaggataaggaagtggcagaggagggcttttagcaagaaaatggatgagctaaaggaatgaacgagattgaaatttaggatttaagaggtgataaaccacctggtttgtaacaaacttagatttagctatagaatagac

SEQ ID NO: 8513 - DNA, 73 bp, Homo sapiens; identical to SEQ ID NO: 7980

SEQ ID NO: 8514 - DNA, 465 bp, Homo sapiens
agtttgatctcagactgctgtgctagcaatcagcgagactccgtgggcgtaggaccctacgagccctgtgggatgtaatctcatgagctggtatacggtgcctctccagaatcaccttgttctttctggatctattcagaatctgaaactcctagaaaagaaaaatgcaagatgcatgagtgttgatgtctgaccaaactccagggtagtggaaagagtgtccttttgcctcatatcacctttgctgaacacaggtgctaaatggatggcaggttgagagttgagacaggatctcactatgttgccttgcatggactggaactccttggctcaagaaatcttcttgcctcagcctcccaaatagctaggactatatgcacatgctactacacctagtggaaaatgaagcacagagaagttcagtgatggacctcagatactaccagcagaaagcagaagagctag

SEQ ID NO: 8515 - DNA, 494 bp, Homo sapiens
  misc_feature 250: n=a, g, c or t
ctctttccatcacagaccttttttctagccctgacccttgtgtcaaccttgggtgagtttctagtatcagccccctcccagctgggtggctagggggtttgggctgggattcctgtctgggacccaggctctccttatgcaggtataaacaatgattactctcagctgtttcagccttgctgcactgctgtcactcatgattcttcctctaaaagtttttccactagctgcttctggcttttgattchrnrccgctcactataattcagtttctcttagctgataactctcatctcagtacatctgggtcgtcttttctgtttggctctctggttctttggaaaaactccttctttctatcttccctctccctgctccctgctccctgctcaaccccamtccagccaggaatggataaacaagtccaagtatgttaatgccagggagtaactaccaggrataaaactgagcataagcaaactcatcagtgtgac

SEQ ID NO: 8516 - DNA, 350 bp, Homo sapiens
cactgtcctggttgtgctcaatgcatactttttgctacctgtttgatattaccacattaccctcttgaggcctgacattcatttgatctatagccagatgaatcagattggtttcccaatttttatagtttttaaaacctttatgctgacaatttagagggaaagtgtctgtttcttaacatgaaagaaaaagaggatagtgtaggttcattgtttcttctccctccttcgtccaattgaaattgatgtgaaaatgaatttataaacttttaaaattagaatgtatcagaaatagacatgcatttatagtttgatgtcttacttgataggttacttacttttttcytttt

SEQ ID NO: 8517 - DNA, 388 bp, Homo sapiens
  misc_feature 329: n=a, g, c or t
caagcaaattatttttatttatttattttttgtttttcttagaatcaaggtcttgctctgtcacccaggctggagtgcagtggcatgatcatagctcactgcagccttcaactcctgggctcaaataggcgtgcaccaccatacctagctgattttatttttattttttgtggagatgaggtcttgctgagctgcccaggctggtcttagactcctggtctccagcggtcctccagccttggcctcccaaagtgctggtattacaggagtgagccaccgtgctcagcatttagcaaactattgaacctgaggagtggtcatgggaahcntgatgaatagctgggtggtgtgaagtacaggaggcccaaaacttgtggctggcatctga

SEQ ID NO: 8518 - DNA, 322 bp, Homo sapiens
cacaacccagattaattagtttaacatgctgagtgcagtggcacacacctgtaatcccagcactttgggaggccaagatgggaggatcacttgagcccaggagttcaagatcagccytgggaaatatggtaagacctggtctctacaaaaaattttaaaaattaagcatggtgtcctgtgtgtgtagtcccagctactcaggaggctcaggtgggaggatcacttgagctcagaaggcagaggctgcagtgagctgagatcatgccattgcactccagcctgggtgacagggtgagagtctgtctcaaaaaaaaaaaaaaaa

SEQ ID NO: 8519 - DNA, 286 bp, Homo sapiens
  misc_feature 193: n=a, g, c or t
ttgcccttggctgggtgtggtagctcgtggctgtaatcccagcactttaggaagccaaggcagtaggatcgtttgagcccaggagttcgaggctgcagtgagctatgagcatamccactgcactccagcctgtgtgaaagagccagaccctgtctcaaaaaaatgataaaacccaaaactttrcccttgtganccctcccttcccccctccmccccccaaaaaaaaacaacaaaacacaaaaaataaacatttgttccagggcaacctggaaaaaaaaaaaaaaaa

SEQ ID NO: 8520 - DNA, 411 bp, Homo sapiens
aaaaaaaggttacatcagcccataaagcacatagccaccgtaagtaattgcataatggaacagatataaaaggactgtatgaggcaaaagaagtcttctgggaatytccmaaaaccctgargacacagtgagttagcaccaccaccaggaattggcctttcagctctgtgcctgtctccagtcaggctggaataagtctcctcatatttgcaagctcggccctcccctggaatctaaagcctcctcagtcttctgagtcagcctgaaaggaacaggccgaactgctgtatgggctctactgccagtgtgacctcaccctctccagtcacccctcctcagttccagctatgagttcctgcaacttcamacatgccacctttgtgcttattggtatcccaggattagagaagc

SEQ ID NO: 8521 - DNA, 303 bp, Homo sapiens
ccatttttcagggtaactagattataaattgtagaataattattgctaatttgtatcagaaaattaagtctaggataacatgtggagtcttgctatgttcatttttaatcctttagctattaccccattgaattaaaaagagtaatgtgtggtagagtcatcaatgatgggcgagatttcagaatacggagagaaagaagagaggcatatattaagattggtaaaattcactcacaaatgaagtaataaagaactgcacttaaattgtgattcattagattgtttgttaaggcccaagagcac

SEQ ID NO: 8522 - DNA, 157 bp, Homo sapiens
caaaaaattagccgggcgcggtggcgggtgcctgtagtcccagctactcgggaggctgaggcaggagaatggcgtgaacctgggaggcggacttgcagtgagccaagattgtgccactgcaatccggcctgggctaaagagcgggactccgtccaaa

SEQ ID NO: 8523 - DNA, 354 bp, Homo sapiens
  misc_feature 38..39,54: n=a, g, c or t
cacacctacaaataccacaccacacctacacacaaagnnttcataaaaatatanagccgggchgggcgtggtggctcacacctgtaattccagcactttgggaggccgaggcgggcggatcacctgaggttggcagttcaagaccagcctgatcaacatggagaaaccccgtctctactaaaaatacaaaattggccaggcatggtggcgcatgctgtagtcccagctactcgggaggctgaggcaggagaatggcatggactcgggaggcggacttgcagtgagccgagattgtgccactgcactccagcctgggtgacagagcgagactccgtcccaaaaaaaaaaaaaaaa

SEQ ID NO: 8524 - DNA, 398 bp, Homo sapiens
  misc_feature 196: n=a, g, c or t
catcactctcctggtgagcttctgaagatcaccaatgtcacatatatgttacaattttttctaacaaaattgtatgatagcacagatgacatctgctatggtttgactctcccctccaaaacccatgtgaaaactcaatccccattgtggcagtactgtgagatggggcctttaggagatgattggatcatgaagnctcttcccacatgaatggattaacccactcatgcattaatggattaataggtgaatggattaatgggtatcatgvgagtggaaatagtggctttataagaaaaggaagagatacctgagctagaacatgagcacactcaattccctcaccatgtcacascctatgccgtctcgggactctctagagagtcccaccagcaaga

SEQ ID NO: 8525 - DNA, 83 bp, Homo sapiens; identical to SEQ ID NO: 7926

SEQ ID NO: 8526 - DNA, 326 bp, Homo sapiens
  misc_feature 286: n=a, g, c or t
aacctcgtgctttctgcagaggagaccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatggctcagctcbaaacacgcttctacactgataacaagaaatatgccgtagatgatgttcccttctcaatccctgctgcctctgaaattgccgacctnagtaacatcatcaataaactactaaaggacaaaaatgagt

SEQ ID NO: 8527 - DNA, 315 bp, Homo sapiens
  misc_feature 236: n=a, g, c or t
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggaggctgaggcaggagaatggcttgaacctggganrbaggagattgcaagatcgcaccactgcaccccagcctgggcaacaaagtgagactccgtcgcaaaaaaaaaaaaaaaa

SEQ ID NO: 8528 - DNA, 374 bp, Homo sapiens
cttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgcaccctctccgcttgcctggtcccctctcctctccgccctcccgctcgccagtccatttgatcagcggagactcggcggccgggccggggcttscccgcagcccctgcgcgctcctagagctcgggccgtggctcgtcggggtctgtgtcttttggctccgagggcagtcgctgggct

SEQ ID NO: 8529 - DNA, 460 bp, Homo sapiens
aagactggagttagctaccggactgtcccgcgagcggtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactggaatttcttgatggaaaagaaattaaaaatatagaaagacaattcctaatg

SEQ ID NO: 8530 - DNA, 434 bp, Homo sapiens
aaagagaaggactatgggggaactgatggcgttcctgttacctctcatcattgtgttaatggtgaagcacagcgattcccgtgagtatcccacgtcctcttctctcctaactccaaagtcgaggcagcctagaaggcacagcttttcttcctaaaacttgtggtgaaaaatatagaagccaggggcagaaacgtgtatgtattacactcaggactccaggagcaatggattgcctgaacagtttcccagttcatatttgtaggattttgatgtcaccaccttctgagggagggggagccgttctagaaagactctggaacttcctcactttccctctgagcatggcctcctttcttttctgctcatattttttcttttacttttgtttctcctcttttctaacttccagagtctcatgaggatgtagtcagagt

SEQ ID NO: 8531 - DNA, 114 bp, Homo sapiens
cgggtgttcgccgctggagcccgggtcgagaggacgaggtgccgctgcctggagaatcctccgctgscgtcggstcccggagcccagccctttcctaacccaacccaacctags

SEQ ID NO: 8532 - DNA, 508 bp, Homo sapiens
thattattcctctcagccaaggaaataaaagtagggagagatgattagaaattaacagaggtatgtctcgaaggagagtgctgtttcccattgctcaataggtagtgctcatttgccctatatgctgcaaattattgtcagcaggaaaggaagtatatatgttagctaagctaaatgtctgaataatataacaacaaaaataattataacaaatataataatahrtvccacatatcaaatgcatccggtgtgctcggtattatactgatggctttacatatattacacatttaattttcatgatgctcctggatgagaaataatgcttttgtgttttacacgaaaggaaattgaggaaaggaaagggaaattgaggcatgcagaatgttaagttaaatcattttcccaaggtcamccagcaggaccttgacaaagcaggagtttgaamccaggtctaaccmaactgaaaacccagaccttttctgatatatcacacatcttctacaca

SEQ ID NO: 8533 - DNA, 72 bp, Homo sapiens
attaattggatattgatgaaatcattggcctggcaaaataaaacatgttgaattccccaaaaaaaaaaaaam

SEQ ID NO: 8534 - DNA, 369 bp, Homo sapiens
gcaggctcctcagagaacacagraacagctgaaaccagggtccgarctcaggaaacctggactacagcgcasakggtaaacctgacaaataaacgcgacggggaactccgtcccaagctgctgatctatggaatgaagcaacacctcatcaagagaagcaacctgggcaaaccaggcctggtttaactgcactttctcacgtttgakcattttctcaakrgatacgtgcgtggtcctctgcaattcagaatgaaatctgaacttctggaaaaactctcctagagggggtttgaggacaagaggtaagacccaggtcagtcagatggcaaggtgccgctccctacagcaaagtcagcatgtaggccccck

SEQ ID NO: 8535 - DNA, 154 bp, Homo sapiens
ctawaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtc

SEQ ID NO: 8536 - DNA, 433 bp, Homo sapiens
  misc_feature 5,17..18,23..24,31: n=a, g, c or t
cagtnccacaccctgtnngcctnncccactncacccacagtgaggaccccctggtgttggggacactccgggtctgtgggatttctccagaagcagactcagacagggattggcacccacactgaaaagttaacatagtctaaatatgtgtgtccctcccaagttcacatgtgatggtggtattagggggtagggcctttgggaggtgattaggtcatgggagcacagccctcaggaatggcaatagtacctttataaaaatggcccaagagagatccctcatccctcccaccatgtgaggacacagtgagaagccccatctatggaccaggaagcbccctccccagacactgctggggscttgatcttggactccacagcctccagaacaatgrgaataaatttctgktgtttgtaagttgtgcagtctgtg

SEQ ID NO: 8537 - DNA, 391 bp, Homo sapiens
gacatttatgaattatgaatgkttctattatgaagggcaattattaccttaagtagtagctggtaatgaacactgaatgcctactatgtgctttacatacaccacctcakttcaagtccccaataaagccataaagttgatattrcaatctataaagtataaggtcagtacttcatatgtgaagaaacagaggcttakagagrttatacacaacctgctaaggccacacagctagtatgtacagctgggcatagagccaggcccttgttctttttcccaggatgcaatctgcactgcctgtgggtgtcaacacagaaagttggtggaatctggtttattcckakacaatgttagatgtggaacttaaacatatatgtggaagttatgctcy

SEQ ID NO: 8538 - DNA, 459 bp, Homo sapiens
aaactggagttagctaccggactgtcccgcgagcggtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactgggtacatatttatattaatataatttttaagagaatgacacctagttaact

SEQ ID NO: 8539 - DNA, 351 bp, Homo sapiens
taaatcagggcgattcagcaaaattccatttgaattgaatctgggccaggggcaggagtgccatggagcgtctgtgtagaagctgacattttaatgatttgattagtttaggaagaatatttttatggattgtgtcctcgattatattaagtactgagtgaacttgttacattatgatgaacttccattacctacactggttgtgtacaagtgcaatgatttcagcccaagaccctaagggtaatctcgtgcaatcctcttaaagaaatgctgtttaatgactaaagctgttaatcatattaaatacatacagccactctgggaaaatatgccaaacaagcataaatctaa

SEQ ID NO: 8540 - DNA, 423 bp, Homo sapiens
catgctcctgtatctagattaaaatcctatgacagatgggcctgcttatatctaracttattcagagagtcttatgataggcaacaggttaccctttaccggggtaaaacatggtttattctacagtttggtcccgttgtaaggccaggagatagagtctcactagtttgccccggctgaactcgaactgctggactcaagggatccttccgactcagcctcccaattagctgggactgttggtgtcaggcacacaccaccttgcctagcttgaagatctttcttctaaatgagcgggctttaaagtgatcagtgggacctgggcaggttggctcttgcctataatccaagtgctttgagagaccgagacaggracatcacttgagsccaggagttcgaggctaaagtgagctgtgagcacac

SEQ ID NO: 8541 - DNA, 394 bp, Homo sapiens
ttcccgggttcaagcgatcctcctgcctcagcacccctagtagttgcgattacaggcacatgccaccatgcccagctaattttgcatttttagtagagatggggtttcaccatgttggccaggctggtcttgaactcctgacctcaggagatccaccacctgggcctcccaaagtgctgggattacaggcatgagccactgtgcccagccttcctcagctaacttttatcatcatccccttcccccattttatagtaaatattgttaagtgcacagttaagacacaaatctttttttatttttatktatttatttatttactkatttatttgagctggagtctcgctctgtcatcaggctagaggtgcagtggtgcgatctcggctcactgcaa

SEQ ID NO: 8542 - DNA, 434 bp, Homo sapiens
ctgagttctgtatttttgaaagtctttttttatgtttgaatatattctaatttactgtaatttgccatcgttttatttgatccaaatcatatatattttagattataagaacatctgtattgtataatatttgcaagtaattaaaaaatattttttaaatcctaggtttaggcttcgtagatctgaatgcggttttttcattaatcttaaataaaatttaagactgaatttacagttgttaaacattcataacatgatcaatttttagtgggttttttggtggggtgtactattttccaccctttttgtatctagttgcaaggagccaagaacaggcaaattattaactcctttattatttcctcctgtctgaaatgttttcaagcagcgtatttgtctgttaaatcatgaaaaactgaaaaaaaaagtctatg

SEQ ID NO: 8543 - DNA, 480 bp, Homo sapiens
aaaatctagatattcttctaaatctgtactttcttggtctatatcaaccaaccctatacctatgccagtgacttctgaatcttatttctcaagctgtggcttttctcaagctccttagctatagttccagctgcctgctaggtcttccccaaaagatttttttctctgtttcctgtctgttgaaacatcagaatcatcttttattcatcccctgctgttatccctttcccaacacatgtaaaccaaagtggtaaccaagttatgtgagttttgtctctgaaatttcctttaaatcaattccctcttttttatctcatcactactgcccatttaggctcttgctatcgcttgcctgacaataactatcttgtggattctttttttctcctcattttttttattttaattttttgtagagaaacgttcttgctatgttacccaggcttgtctcaaactcctgggctcaagcaatcctcatgc

SEQ ID NO: 8544 - DNA, 408 bp, Homo sapiens
cgaaatagttcttcaggatttgttaaggcaaatagcagtccttccttctctccttcctattttatctttcttagaagcagtgtctttcaattcttttagctgtttattttgttttttactgctacatctgtaataatatgtttgtatttgatacctcttgatttttgcttttaggtattttttattgagttcccagtatgaaagatgagaaattagttctctgtcttttttctccctgtcctaaacacatccatacatgtccttcctatcctctcattctcctagtatggttataatttagattagatcaatatatagttgttatgattatgtaagcactactgagaactcaaccatgcagtatatgattattttttacttccttgtaaaacttgttttttttttttk

SEQ ID NO: 8545 - DNA, 302 bp, Homo sapiens
taccttgccgggcgcggtggctcacacctgtaatcccagcactttgtgaggctgaggcgggcagatcacgaggtcaggagatcgagactatcctggccaacacggtgaagccccctctctactaaaaatataaaaaattagccgtgcatggttgcgggcgcctgtggtcccagctactcaggaggctgaggcgggagaatgatgtgaacccgggaggcggaccttgccgtgagccaggatcacgtcactgcactccagcctgggtgacagagcaagactctgtctcaaaaaaaaaaaaaaaa

SEQ ID NO: 8546 - DNA, 348 bp, Homo sapiens
caggtgaagaaactaaggaacagaggggttaagaagcttgcctggccacctgcagtggctcacatctgtaatcccagcaatttgggaggctgaggcgggaggatcgcttgagcccaggagcttgagaccagccagggcaacatagcaagaccctgtctctccaaaaaaaaacaaracaaaacccchaaaaactargytgggswwgggkggcatgcatctgtagtgccagcactcggggggctgaggtgggaggatcgcttgagcccgtgaggttgaggctgcagtgagctttgattgcactactgcactctagtctggaccacagagcaagcctgtgtcccaaaaaaw

SEQ ID NO: 8547 - DNA, 84 bp, Homo sapiens
ccggagggcggacttccagtgagccgagatctgcgctccaacctggggacagagcgagactccctctcaaaaaaaaaaaaaaaa

SEQ ID NO: 8548 - DNA, 88 bp, Homo sapiens
  misc_feature 35: n=a, g, c or t
atatcctagmtgcmttgtbaacatcttcgagcatnggmagctccggaggchggggtaactgscaggtaagtasgctttggagtggtat

SEQ ID NO: 8549 - DNA, 183 bp, Homo sapiens
atttctaaagtcacagcctggaaggattcctggtctctcccaccttctaccattctgctgccagtgacggcaaggattggtgtagcttctgcgcagtgctttgtgcctggaataccgagaaggaagammmagaagacaagcacccwggtccttttctaagaaattacaggcgcccttgaagaa

SEQ ID NO: 8550 - DNA, 146 bp, Homo sapiens
ccaaaatggaaaggaaatgttctatgttgttcaggctaggagtatattggttcgaaatcccaaaaaaaaaaaaaaaaaaaaaaaaaaaaaaaaaaaaaaaaaaaaaaaaaaaaaaaaaaaaaaaaaaaaaaaaaaaaaaaaaaaaw

SEQ ID NO: 8551 - DNA, 147 bp, Homo sapiens
ccaaaatggaaaggaaatgttctatgttgttcaggctaggagtatattggttcgaaatcccaaaaaaaaaaaaaaaaaaaaaaaaaaaaaaaaaaaaaaaaaaaaaaaaaaaaaaaaaaaaaaaaaaaaaaaaaaaaaaaaaaaaah

SEQ ID NO: 8552 - DNA, 149 bp, Homo sapiens
caaaamattagccgggcgcrgtggcgggtgcctgtagtcccagctactcgggaggctgargcaggagaatggcgtgaacctgggaggcggacttgcagtgagccaagattgtgccactgcaatccggcctgggctaaagagcgggactc

SEQ ID NO: 8553 - DNA, 167 bp, Homo sapiens
agatgttctcagtgtgaggtggttatgctggcttcctccaattcctcctcttcgtcggctgtgactgaccgagacagcggcttgggcttcggcagagacttgagactgcgggcacccgctgccattaggattgttgaatgakctgtgagaagggagtgggggatatr

SEQ ID NO: 8554 - DNA, 474 bp, Homo sapiens
  misc_feature 214: n=a, g, c or t
tccatcggctactcgtgtacattttggttcattgattcaactggcctttgttaagtaatagataaaaataaaggtttttctagtgaatgcttgtttgttagtatgataataaattgtgaaatagcttagttctaatacatatctttttaaactactcacaactccagctctaacttgagctttgcattcytttgkgaraaagkttggaaaaccnttttttccagagagcttatatycttgacctttctatggaaaactcattttagatcatccatataccttcagttttaaattgtatgactgttggctcagttgcctgattatatgatactaaaacttagaatwtttcccccagagagggggtctaggttctgcacaatcttatttcccacaaaaaagaagttaattgccgtagagtttctttatgtacctaaataattgtcaagatgtctgctaacttgtcagtaatcacaa

SEQ ID NO: 8555 - DNA, 426 bp, Homo sapiens
atgggccagctcgcgcaggtggccccggtgccgctgttcatcgggccgcgcggggaaggcggcggccaagatgcgctccgtcacgtaggatgagcaatacccacagcactccgttcaaggtcatctcctgggggccctctctggagccaccagacctctggacaccatggccaggttccttgccctbcccaacccattsccarrggggaattmacmaattccacgggaggcaaggcctgacaggctgaagtcacctggaaggggaccgatgcctggtactggataggaacttcatggaatggagctaatgggccgtaggcaggtttgagtcgtgccaccctggagcagaaggtggagggtagggataagggggtggagcacctgattccaatcttgccacagggaagaagagtctgtgaagaacat

SEQ ID NO: 8556 - DNA, 404 bp, Homo sapiens
cttaggcatttcgccttagaaaaagcgctccctacgaaagccactataatawaaacacgccatcctccccttgtcttgtaagttctctctcttcaaatccttctcttgccagttcgtgaattccactcttcccacactggaagcttctctaggacaagcagttcgtctttaatagctaatatagaaacytggaawggtaaargggkcccytggagaatacatattgaaaggataaattttcctatgtgatggctgcagctatggaggtaggctactacctttaaaatacacatataaggatatatcttgatgaggaaacaaaagttaccatccacataccaccaagctcttccaaaagcaaggagaagaacgacatgctttctaaccttggaaaagcacaaaaa

SEQ ID NO: 8557 - DNA, 318 bp, Homo sapiens
tttacaaaaagtttctgccgaagatggcagggtgtgatggctcacgcctgtaatcccagcactttgggaggccgaggcaggtggatcatgtgaggtccacgagtttgagaccagcctgaccaacatggcaaaaccccatccctactaaaaatacaaaagttagccaggtgtgtggcgcacgctgtatctcaagtactcgggggactaagcaggrgatcgcttgaagctgggaggcagaggttgcaktgggccaagatgccccgcagcactacagcctgggcaacagagcgagactccatctcaaaaaaaaaaaaaaaa

SEQ ID NO: 8558 - DNA, 171 bp, Homo sapiens
tcgctgtgacggcctgggctccgggaggaggcgcagggatcctcggaaaggcctgtggtgcggtttggtggatttggggcgcaccacctscgccctaaccccaaccccaacgtgtccccaggccggatcacctcaacagtcacgtcagacaagtgcactcaacagaacggc

SEQ ID NO: 8559 - DNA, 312 bp, Homo sapiens
  misc_feature 281: n=a, g, c or t
gacagcgcastcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgktcatcggagctactggcmacgadttttscggtgaagattatggaagtgacagctgagcggctragtcctgagcagctggaggaggtgcgggngdmcacacggcgagagacacacatccttcgc

SEQ ID NO: 8560 - DNA, 442 bp, Homo sapiens
cagttgcccgcctgccccggagagccaggcgctaaccagccgctctggccccgcgcctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaagaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaa

SEQ ID NO: 8561 - DNA, 318 bp, Homo sapiens
  misc_feature 107: n=a, g, c or t
gcaaaacaagggcagcgggcccggcgcggtggctcacgcctgtaatctcagcactttgggaagccaaggcgggcgaatcacttgaggtcaggagttcgagaacagcntggcccacagggtgaaactctttctctactaaaaatacaaaaattagcggggcttggttgcgggcacctgtaatscccarttamtccggaaagsctdarggcaggaraatcgcttgaacccgggaagcgraggttgtagtgagccgagatcgcgccactgcactccagcctgggcgacagggcgagactcccgtttcgaaaaaacaaacaa

SEQ ID NO: 8562 - DNA, 317 bp, Homo sapiens
caggtgaagaaactaaggaacagaggggttaagaagcttgcctggccacctgcagtggctcacatctgtaatcccagcaatttgggaggctgaggcgggaggatcgcttgagcccaggagcttgagaccagccagggcaacatagcaagaccctgtctctccaaaaaaaaacaaaacmaaascccmaaaaactarcygggcatggktgcwkgattctgtagtscsavcactcgggggsctraggtgggraggatcgcttgagcccgtraggttraggctgcagtgagctttgattgcactactgcactctagtctgg

SEQ ID NO: 8563 - DNA, 184 bp, Homo sapiens
taaatagtttaatatgaaatggcaaatacattccattaggataagaaaggtattgttgccagggagttgtttcactggaaatgtttaaatccagcagctgggaaaagggaagggtgactcgggtacaaaggacaccgattaaatgcagtaacttattaattttctttgccaatagtgtgagtgk

SEQ ID NO: 8564 - DNA, 136 bp, Homo sapiens
caaaaaattagccgggckcggtggcgggtgcctgtagtcccagctactcgggakgctgaggcaggakaatggcgtgaacctgggakgcggacttdcwmtgagccaagattggtgccactgcaatccggcctgggck

SEQ ID NO: 8565 - DNA, 422 bp, Homo sapiens
  misc_feature 22..24,31..33: n=a, g, c or t
agatttgtcggcttgcrgsacnnnttcagvnnncgctgtctctgaacttccagcctcagagaccgccgcccttgtccccgagggccatgggcgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcagtgagctcttgggacggggtggccagaacgaagaggtggtgggagtggaggggtcttagaataagtccaaaggcctgggccagtccacttcctctctgcaggctggtggccgcgctctctgtcaccctgggcctctttgcagtggagctggccggtttcctctcaggagtctccatgttcaa

SEQ ID NO: 8566 - DNA, 207 bp, Homo sapiens
  misc_feature 189: n=a, g, c or t
actaaatcctacagttgctaggtacccttttcaagcgaacacttttgcacccactcccactcvaagcacaactcgcttaacaatgaccaccaaggcbgtcggtatcgatctcggcacgacgtactcgtgcgtcggtgtctggcagaacgaccgtgtcgagattatcgccaacgaccaaggcaaccgcancacgccctcctacgtcgc

SEQ ID NO: 8567 - DNA, 136 bp, Homo sapiens
  misc_feature 29: n=a, g, c or t
aagaccatgtcgaagggccccgggccggncggctccgcagcttcctcggcgcccccggccgctaccgctcaggtgctgcaggcacagcccgagaaaccgcagcactacacggcagaggagagagaccagtgaaggt

SEQ ID NO: 8568 - DNA, 395 bp, Homo sapiens
  misc_feature 87: n=a, g, c or t
tcccagacaaacaaaagctgaaggattttgtcaataccagagcagttctacaagaaatgctaaaggaagttcttcaatctgaaacanaagagaacattaatgaacaacaggaaatcatctgaaggtgaaaaactcactggtaatagtaatgacacagaaaaacaaagaatattataatattgttattgtggtgtgtaaactcctcatatcttgagtagaaagactaaatgattaacctatcaaaaataataactacaacaacttttcaaggtaaagacagtataataaaatgtaaatagaagcaatagaaagttaaaaagcagggggatgaagttaatgtatagagtttttattagttttctctttgctggtttgttcgttgtttatacaatcaa

SEQ ID NO: 8569 - DNA, 152 bp, Homo sapiens
tcccttcttctcaggtcaccagcaccctcggaacccagaggcccgcgctctgaaggtgacccccctgggaggaaggcgatggcccctgcgaggacgatggcccgcgcccgcctcgccccggccggcatccctgccgtcgccttgcagcacaw

SEQ ID NO: 8570 - DNA, 184 bp, Homo sapiens
  misc_feature 57: n=a, g, c or t
acagccggatccacggtgactaatctccgggaaggcgtccagcgtgascgtgaggcntgcacctgcgccggacttcaccactcaccaggagtctctgcccgccgcccccagcgcggttctcttccctgctagacgtaaagtcctggggacaagcacagcccagggcactttctggagagaagat

SEQ ID NO: 8571 - DNA, 67 bp, Homo sapiens; identical to SEQ ID NO: 8447

SEQ ID NO: 8572 - DNA, 387 bp, Homo sapiens
ccttccgtcctccgagccttccgtcggtcggtccttgcttcctgcttcgcctccgcgcctcgcgctatgggacagagcccccgatccgccagcaccacctgaggatccagaaaccgccccagcgatgtaagaggatcaggagctggagaggaaagcaatagaagaactgcttaaggaggcaaaacgtgggaaaactagagctgraaccaatggggacccatgggttggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacaga

SEQ ID NO: 8573 - DNA, 191 bp, Homo sapiens
  misc_feature 2: n=a, g, c or t
tnctcctcccgcctgaggcgagtctgggctcagcctagagctctccggcggcggcgcasttcagggcagcgcgggctgcagcggcggcggcggttagggctgtgtagggcgaggcctcccccttcctcctcgccatcctactcctccctcctcrtcatcctcccccttcgtcctcctcgccttcctcctcm

SEQ ID NO: 8574 - DNA, 416 bp, Homo sapiens
ctttcccccccaacccccatcttccactaattccccaaaatcaccaacacaaacccaaacaccacacccaccccatatatcttctctaccccttttacaaaacatccacttcttcctttccccacatatatcccaatctataacaaacctcatattctacacatcaacccaatccctactcttcaaaaaccaatcccccacaastcgtagcatcccaaaactccagcactctacaatcttagccaccatcctswtcscattcttctaaacaaacaacttaacccgaacattcttcccaacacaattaatctccctattcaccacattaagcactctaacaccccacataccttcctcaaacctctcaaccaaaatcatcacaaaaacaaacaagccaaacacaaacctagctccct

SEQ ID NO: 8575 - DNA, 331 bp, Homo sapiens
  misc_feature 102: n=a, g, c or t
gcaaaacaagggcagcgggcccggcgcggtggctcacgcctgtaatctcagcactttgggaagccaaggcgggcgaatcacttgaggtcaggagttcgagancagcctggcccacagggtgaaactctttctctactaaaaatacaaaaattagcggggcttggttgcgggcasctgtaatcccagttactcsggaagctkaagsaagarrawtcgcttgaaccsggraagcggargkttgtagtgagccgagatcgcgccactgcactccagcctgggcgacaggggcgagactcccgtttcgaaaaaacaaacaaraaaaaaaaaaaaa

SEQ ID NO: 8576 - DNA, 68 bp, Homo sapiens
tcaagatcgcaccactgcactccaacctgtgcaacagaatgaaaccctgcctcaaaaaaaaaaaaaar

SEQ ID NO: 8577 - DNA, 483 bp, Homo sapiens
  misc_feature 150,152: n=a, g, c or t
taaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtktnbnytaaagacttattgaaatggttactggcgtaaatacttggscaackcaacytttawtgscccyggaacttttccmatttkggtttsccacctwamcctatagcagctcctccaaatgaggaatgctgtaagtaagactcatcaaacagattttaaccattttattatcckgtgtgtccttacattgcttctgtgagaygtttttktctkatctgagatgaactttcaggagcctatttgaactccagactggtgttctggggcaaagagctattagccaaactgattctatgcaggtgaaggatgcactaaagttctcactttagtgagaa

SEQ ID NO: 8578 - DNA, 386 bp, Homo sapiens
tgaaataacagaaatttcttttctcacaattttggaggctagaagtctgagatcaaggtgttgacaggttttgtttcttctaaggcctctctccctggcttacagatggccatcttctccccatgtcttcacatggtcttccttttatgtatctgtgtcctcatcacagatgagtaattttttacagtaaaaaawtayggaawtttttaaaattamcwttaccmcwtacatttacccckcaacaattttcaggtatacattacctgaaacaacatgcattgtttaactaaatgcatgttatacagcaaatctctagaagttttttgtcttgcgtgactgaaactatacctatggaacagcaactctgcttctccctctcttccgcc

SEQ ID NO: 8579 - DNA, 363 bp, Homo sapiens
  misc_feature 199: n=a, g, c or t
cacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaacngtgaactcvagcaggcattttttttttcttaccgaaaggctgctattgtgcaagggcacataatgggtctgttgcycttattggcttccaaatgtgcatggcaaagagagagatgtgggcctagagcagatatattcagcaaggtgacagcttcccataacaat

SEQ ID NO: 8580 - DNA, 385 bp, Homo sapiens
cattgggctttggaactagaaggtactgggtactagcttttaaaatgttttataaccttggccgtatacttaacctcattacacttctatggtatgtgactttaggcagatttcttaactgttctgaatctcagtttcctaatcctaaaaattatgataaatatacatattaaggatgaaataggaattcagacattttatttaaataatatctgtaaatgacttgctgtgtccaacacacaagtttggaacaatgaaggattcatccaccccatttattcagcagttatttatttagttcttctactactactactgacaacaacaacagtaacctctctcctatttctagcacctaaagtaggatttcacacactttactgtc

SEQ ID NO: 8581 - DNA, 202 bp, Homo sapiens
tggatcaaagacctaaatgcaagatctaaaccttgcattagaaaccttcccataagaatatggaggaaggccgggcacagtggctcacacctgtaatgccagcactttgggaggccgaggcgggcggatcacctgaggttaggaattcaagaccagccctgaccaatatggtgaaaccccgtctctactacaaaaaaaaaaw

SEQ ID NO: 8582 - DNA, 134 bp, Homo sapiens
agagagtctcagattgtcttgataatttattctttcgttctctttcttttgcttctctatttttgtttttcagtgttttgcttgttttgttctgttttaggattttattctctctctctctctctctctctctc

SEQ ID NO: 8583 - DNA, 130 bp, Homo sapiens
attgccgggcctgcctggccaccctgcgcagggccttgcgtcctctccgggggcggasgggtcggcgggcctgacagggaacctccctgaccgagcccacgtctccccacggccagagaaatctccggcc

SEQ ID NO: 8584 - DNA, 144 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataw

SEQ ID NO: 8585 - DNA, 361 bp, Homo sapiens
  misc_feature 286,288: n=a, g, c or t
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatawtawtcmatcataaaadggawttavgtggcsgggcacagtggctcatgcctgtaatcccagctacgtgggaggctgaggcaggagaatcacttgaacctgggaggtggarnvngcagtgaactgagattgcgccactccactccagcctgggcaacagagactcggtgtcaaaaaaaaaaaaaaaa

SEQ ID NO: 8586 - DNA, 439 bp, Homo sapiens
  misc_feature 321,376: n=a, g, c or t
gaagtgacctctagagcggtggtgaaactggcagttgacggctcctgggactagatcccgcgagtagcccccgaactatttctctacgttttctcttgatcctcccgaaatcttccagatccgcgtagtgaggaatcgtctccaccgtcatggggggcggagactgaatctgaagaagagctggcacccgcagaccctcaggaatgtggagaaagtgtggaaggccgagcagaagcatgaggctgagcggaagaagattgaggagcttcagcgtgagctkcgagaagagagagcccgggaagagatgcagcgctatgcggnaggatgttggggccgtcaagawaaaagaagawaagttggactggatgtaccaggntcctggtgggatggtraaccgtvacgagtacctgctggggcgccccattgacaaatatgtttt

SEQ ID NO: 8587 - DNA, 166 bp, Homo sapiens
caaacagaattaccagataagccawaaatactgcttctaggtatacgccctaaagaactaaaaacaggtgttcaaataaaaactcgtatacaaatgtttatagcaacatkattkataatagctaaaaagtgggamaaaaacaattgaccatcartggatagatggr

SEQ ID NO: 8588 - DNA, 103 bp, Homo sapiens; identical to SEQ ID NO: 8028

SEQ ID NO: 8589 - DNA, 151 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaa

SEQ ID NO: 8590 - DNA, 96 bp, Homo sapiens; identical to SEQ ID NO: 8079

SEQ ID NO: 8591 - DNA, 362 bp, Homo sapiens
  misc_feature 286: n=a, g, c or t
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattaktcaatcmkraaamdggattwaagtggccggscacagtggctcakgcctgtaatcccagctacgtgggaggctgaggcaggagaatcacttgaacctgggaggtggvnsttgcagtgaactgagattgcgccactccactccagcctgggcaacagagactcggtgtcaaaaaaaaaaaaaaaa

SEQ ID NO: 8592 - DNA, 85 bp, Homo sapiens
acagttaactttaggaccatagccaaaagatasaaacagcataaacgccaaaataaaaagaagccaataaagataaacacaaaaa

SEQ ID NO: 8593 - DNA, 80 bp, Homo sapiens
gaggttgagacaagagaatcacttgaacctgagaggcagaggttgcagtgcagcctgggkgacagagggagactccggcm

SEQ ID NO: 8594 - DNA, 84 bp, Homo sapiens
aataatagctactaaaaagtaacaaggttgagaccagcctgggcaacataaggagaccccttcttcacaaaaaaaaaaaaaaaa

SEQ ID NO: 8595 - DNA, 96 bp, Homo sapiens; identical to SEQ ID NO: 8079

SEQ ID NO: 8596 - DNA, 96 bp, Homo sapiens; identical to SEQ ID NO: 8079

SEQ ID NO: 8597 - DNA, 144 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataatar

SEQ ID NO: 8598 - DNA, 348 bp, Homo sapiens
  misc_feature 208,210..213,215: n=a, g, c or t
caaacagaattaccagataagccaaaaatactgcttctaggtatacgccctaaagaactaaaaacaggtgttcaaataaaaactcgtatacaaatgtttatagcaacattatttataatagctamaaagtgggaaaaaaacaattgaccatcaatggatagatggvtmaatgrtattmytcmatcattaammagrattavgtggccgngnnnngntggctcatgcctgtaatcccagctacgtgggardctgaggcaggagaatcacttgaacctgggaggtggaggttgcagtgaactgagattgcgccactccactccagcctgggcaacagagactcggtgtcaa

SEQ ID NO: 8599 - DNA, 363 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcatwaaaaaagratttaagtgsccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8600 - DNA, 126 bp, Homo sapiens
tttctttttacattgtgcctttatcagtttatggtatcagggtgatactagcttcatagtatgagttaggcaggagcccatcctcctccattttttgaaatagtttcaatagawaaaaaaaaaaaw

SEQ ID NO: 8601 - DNA, 96 bp, Homo sapiens; identical to SEQ ID NO: 8079

SEQ ID NO: 8602 - DNA, 85 bp, Homo sapiens
  misc_feature 85: n=a, g, c or t
acagttaactttaggaccatagccaaaagatagaaacagcataaacgccaaaataaaaagaagccaataaagataaacacaaaan

SEQ ID NO: 8603 - DNA, 132 bp, Homo sapiens
cattggtagcttgatggggatggcattgaatctgtaaattaccttgggcagtatggccattttcacgatattgattcttcctacccgccgcaaaaaaaaamwraaaaaaaaaaaaaaaaaaaaaaaaaaaam

SEQ ID NO: 8604 - DNA, 96 bp, Homo sapiens; identical to SEQ ID NO: 8079

SEQ ID NO: 8605 - DNA, 114 bp, Homo sapiens
tttctttttacattgtgcctttatcagtttatggtatcagggtgatactagcttcatagtatgagttaggcaggagcccatcctcctccattttttgaaatagtttcaatagaw

SEQ ID NO: 8606 - DNA, 84 bp, Homo sapiens; identical to SEQ ID NO: 8594

SEQ ID NO: 8607 - DNA, 96 bp, Homo sapiens
acagttaactttaggaccatagccaaaagatagaaacagcataaacgccamaataaaaagaagccaataaagataaacacaaaaaaaaaaaaaaaa

SEQ ID NO: 8608 - DNA, 85 bp, Homo sapiens
acagttaactttaggaccatagccaaaagatagaaacagcataaacgccaaaataaaaagaagccaataaagataaacacaaaaa

SEQ ID NO: 8609 - DNA, 73 bp, Homo sapiens
aataatagctactaaaaagtaacaaggttgagaccagcctgggcaacataaggagaccccttcttcacaaaaa

SEQ ID NO: 8610 - DNA, 85 bp, Homo sapiens; identical to SEQ ID NO: 8608

SEQ ID NO: 8611 - DNA, 103 bp, Homo sapiens; identical to SEQ ID NO: 8028

SEQ ID NO: 8612 - DNA, 85 bp, Homo sapiens; identical to SEQ ID NO: 8608

SEQ ID NO: 8613 - DNA, 89 bp, Homo sapiens
gaggttgagacaagagaatcacttgaacctgagaggcagaggttgcagtgcagcctgggtgacagagggagactccggccccctcccaw

SEQ ID NO: 8614 - DNA, 361 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8615 - DNA, 96 bp, Homo sapiens; identical to SEQ ID NO: 8079

SEQ ID NO: 8616 - DNA, 361 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccarmtacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8617 - DNA, 164 bp, Homo sapiens; identical to SEQ ID NO: 8086

SEQ ID NO: 8618 - DNA, 96 bp, Homo sapiens; identical to SEQ ID NO: 8079

SEQ ID NO: 8619 - DNA, 96 bp, Homo sapiens; identical to SEQ ID NO: 8079

SEQ ID NO: 8620 - DNA, 345 bp, Homo sapiens
caaacagaattaccagataagccaaaaatactgcttctaggtatacgccctaaagaactawaaacaggtgttcaaataaaaactcgtatacaaatgtttatagcaacattatttataatagctaaaaagtgggaaaaaaacaattgaccatcaatggatagatggataaatgatattattcaatcataaaaaagawttaagtggccgggcacagtggctcatgcctgtaatcccagctacgtgggaggctgakkyaggagaatcacttgaacctgggaggtggaggttgcagtgaactgagattgcgccactccactccagcctgggcaacagagactcggtgtc

SEQ ID NO: 8621 - DNA, 361 bp, Homo sapiens
  misc_feature 199: n=a, g, c or t
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcatadaaaagaatmnagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8622 - DNA, 58 bp, Homo sapiens; identical to SEQ ID NO: 8023

SEQ ID NO: 8623 - DNA, 159 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaaaaaaaaaaaaaa

SEQ ID NO: 8624 - DNA, 96 bp, Homo sapiens; identical to SEQ ID NO: 8079

SEQ ID NO: 8625 - DNA, 97 bp, Homo sapiens
cagatcggakcraccgcctgcacaaacatcgtcaccaccakcacaggcgttcccgggacttactaaaagctaaacakaccgaaaaaaaaaaaaaaaa

SEQ ID NO: 8626 - DNA, 103 bp, Homo sapiens; identical to SEQ ID NO: 8028

SEQ ID NO: 8627 - DNA, 506 bp, Homo sapiens
  misc_feature 502: n=a, g, c or t
caaactccctgactctttgaagtttttactcaccccatttcaattatcctgatcccttctcatcccctgcttggcttctctgcatgtggtcatctgstgtggcttggtgtttaatggrttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgmcttctctgccaaacgactgggaaaccanaatg

SEQ ID NO: 8628 - DNA, 58 bp, Homo sapiens; identical to SEQ ID NO: 8023

SEQ ID NO: 8629 - DNA, 96 bp, Homo sapiens; identical to SEQ ID NO: 8079

SEQ ID NO: 8630 - DNA, 164 bp, Homo sapiens; identical to SEQ ID NO: 8086

SEQ ID NO: 8631 - DNA, 96 bp, Homo sapiens; identical to SEQ ID NO: 8079

SEQ ID NO: 8632 - DNA, 139 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaaaaaaaaaaaaaaaaaaaaaaaaa

SEQ ID NO: 8633 - DNA, 103 bp, Homo sapiens; identical to SEQ ID NO: 8028

SEQ ID NO: 8634 - DNA, 96 bp, Homo sapiens; identical to SEQ ID NO: 8079

SEQ ID NO: 8635 - DNA, 103 bp, Homo sapiens; identical to SEQ ID NO: 8028

SEQ ID NO: 8636 - DNA, 164 bp, Homo sapiens; identical to SEQ ID NO: 8086

SEQ ID NO: 8637 - DNA, 103 bp, Homo sapiens; identical to SEQ ID NO: 8028

SEQ ID NO: 8638 - DNA, 361 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgthatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8639 - DNA, 75 bp, Homo sapiens
aataatagctactaaaaagtaacaaggttgasaccagcctgggcaacataaggagaccccttcttcacaaaaaam

SEQ ID NO: 8640 - DNA, 91 bp, Homo sapiens
acagtyaactytaggaccatagccaaaagatagaaacagcataaacgccaaaataaaaagaagccaataaagataaacacaaaaaaaaaaa

SEQ ID NO: 8641 - DNA, 58 bp, Homo sapiens
gakgyygagacaagagaatcacttgaacctgagaggcagaggttgcagtgcagcctgg

SEQ ID NO: 8642 - DNA, 96 bp, Homo sapiens; identical to SEQ ID NO: 8079

SEQ ID NO: 8643 - DNA, 361 bp, Homo sapiens
  misc_feature 233..234,237: n=a, g, c or t
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcnndcnaacgtgggaggctgagdcaggagaatcacttgaacctgggaggtggaggttgcagtgaactgagattgcgccactccactccagcctgggcaacagagactcggtgtcaaaaaaaaaaaaaaaa

SEQ ID NO: 8644 - DNA, 148 bp, Homo sapiens
tttctttttacattgtgcctttatcagtttatggtatcagggtgatactagcttcatagtatgagttaggcaggagcccatcctcctccattttttgaaatagtttcaatagwwaaaaaaaaaaaaaaaaaaaaaaaaaaaaaaaaaa

SEQ ID NO: 8645 - DNA, 58 bp, Homo sapiens; identical to SEQ ID NO: 8023

SEQ ID NO: 8646 - DNA, 58 bp, Homo sapiens; identical to SEQ ID NO: 8023

SEQ ID NO: 8647 - DNA, 361 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccagctacgtvkgaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8648 - DNA, 96 bp, Homo sapiens; identical to SEQ ID NO: 8079

SEQ ID NO: 8649 - DNA, 103 bp, Homo sapiens; identical to SEQ ID NO: 8028

SEQ ID NO: 8650 - DNA, 85 bp, Homo sapiens; identical to SEQ ID NO: 8608

SEQ ID NO: 8651 - DNA, 166 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaaaaaaaaaaaaaaaaaaaaw

SEQ ID NO: 8652 - DNA, 77 bp, Homo sapiens
ccataaaadgctaaatktakasttcacttataaagtraacakktakatctaatcaktctagtaagtccaaaaaaaaa

SEQ ID NO: 8653 - DNA, 51 bp, Homo sapiens
tttctttttacattstscctttatcaktttatggtatcaggstgatactag

SEQ ID NO: 8654 - DNA, 363 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagrattaagtggsccgggvmamagtggcycakgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8655 - DNA, 159 bp, Homo sapiens
tttctttttacattgtgcctttatcagtttatggtatcakggtgatactagcttcatagtatgagttaggcaggagcccatcctcctccattttttgaaatagtttcaatagaaaaaaaaaaaaaaaaaaaaaaaaaaaaaaaaaaaaaaaaaaaaaaa

SEQ ID NO: 8656 - DNA, 150 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaaaaaaaaaaaaaaaaaaaaaaaaaaaaaaaaaaaa

SEQ ID NO: 8657 - DNA, 359 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagrattaagtggscsggcacagtgctcatgctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8658 - DNA, 167 bp, Homo sapiens
aagatggattttggagayagttgcctgggctggtcttgaactcctgggctcaagtgatccacccacctcagtctcccaaagcgctggaattataggcatgagccactgcgcccggcctaatttgactatttttgcgtgatgagtatgcagtggaatgtggcaaattt

SEQ ID NO: 8659 - DNA, 103 bp, Homo sapiens; identical to SEQ ID NO: 8028

SEQ ID NO: 8660 - DNA, 96 bp, Homo sapiens
acakttaactttagraccatagccaaaagatagaaacagcataaacgccaaaataaaaagaagccaataaagataaacacaaaaaaaaaaaaaaaa

SEQ ID NO: 8661 - DNA, 103 bp, Homo sapiens
gaggttgagacaagasaatcacttgaacctgagargcagasgttgcagtgcagcctgggtgacagagggagactccggccccctcccaaaaaaaaaaaaaaaa

SEQ ID NO: 8662 - DNA, 96 bp, Homo sapiens; identical to SEQ ID NO: 8079

SEQ ID NO: 8663 - DNA, 84 bp, Homo sapiens
  misc_feature 32: n=a, g, c or t
aataatagctactaaaaagtaacaaggttganaccagcctgggcaacataaggagaccccttcttcacaaaaaaaaaaaaaaaa

SEQ ID NO: 8664 - DNA, 96 bp, Homo sapiens
acasttaactttaggaccatagccaaaagatagaaacagcataaacgccaaaataaaaagaagccaataaagataaacacaaaaaaaaaaaaaaaa

SEQ ID NO: 8665 - DNA, 152 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaaa

SEQ ID NO: 8666 - DNA, 84 bp, Homo sapiens
aataatagctactaaaaagtaacaaggttgabaccagcctgggcaacataaggagaccccttcttcacaaaaaaaaaaaaaaaa

SEQ ID NO: 8667 - DNA, 468 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagagaggggaccgtccccgagcctcgccgagcctgcgttgtagacacctctggkbtagtggttgaggatctgttgaccgggcatggtgggtagaaggaacgctccgagcagaagaaaagtggctgtcgtgaagacatctgcgtgtgcggggtgcgtgggtgcctggagatgaagctggaaagagctgctgcccaaaggagcaaggaggaacagcgggattacgtcttctacctggccgtggggaa

SEQ ID NO: 8668 - DNA, 58 bp, Homo sapiens; identical to SEQ ID NO: 8023

SEQ ID NO: 8669 - DNA, 96 bp, Homo sapiens; identical to SEQ ID NO: 8079

SEQ ID NO: 8670 - DNA, 87 bp, Homo sapiens
acagttaactttaggaccatagccaaaagatagaaacagcataaacgccaaaataaaaagaagccaataaagataaacacaaaaaam

SEQ ID NO: 8671 - DNA, 116 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaa

SEQ ID NO: 8672 - DNA, 97 bp, Homo sapiens
cagatcggagcgaccgcctgcacaaacatcgtcaccaccagcacaggcgttcccgggacttactaaaagctaaacagaccgaaaaaaaaaaaaaaaa

SEQ ID NO: 8673 - DNA, 82 bp, Homo sapiens
cagatcggagcgaccgcctgcacaaacatcgtcaccaccagcacaggcgttcccgggacttactaraagctaaacagaccgr

SEQ ID NO: 8674 - DNA, 96 bp, Homo sapiens
acavttaactttaggaccatagccaaaagatagaaacagcataaacgccaaaataaaaagaagccaataaagataaacacaaaaaaaaaaaaaaaa

SEQ ID NO: 8675 - DNA, 222 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcak

SEQ ID NO: 8676 - DNA, 85 bp, Homo sapiens; identical to SEQ ID NO: 8608

SEQ ID NO: 8677 - DNA, 164 bp, Homo sapiens; identical to SEQ ID NO: 8086

SEQ ID NO: 8678 - DNA, 449 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggggtgsgtgggtgcctggagatgaagctggaaagagctgctgcccaaagggagcaaggaggaacagcgggattac

SEQ ID NO: 8679 - DNA, 56 bp, Homo sapiens
  misc_feature 45: n=a, g, c or t
ctttttcgcaacggrtttgccgccagvacacaggtgtcgtgaaanctacccctaam

SEQ ID NO: 8680 - DNA, 73 bp, Homo sapiens
aataatagctactaaaaagtaacaaggttgagaccagcctgggcaacataaggagaccccttcttcacaaaam

SEQ ID NO: 8681 - DNA, 73 bp, Homo sapiens; identical to SEQ ID NO: 8609

SEQ ID NO: 8682 - DNA, 186 bp, Homo sapiens
tgattatgtgtcktggggttgctctkcttgaggggtatcttagtggtgttccctgtactttctgaatttgaacttgggcctgtcttgctaggttggggaagttcttctggatgatatcctaaagtgtgttktccaatttggtccattctccctgtcactttcaggtatgccagtcattcatgggtt

SEQ ID NO: 8683 - DNA, 96 bp, Homo sapiens; identical to SEQ ID NO: 8079

SEQ ID NO: 8684 - DNA, 164 bp, Homo sapiens; identical to SEQ ID NO: 8086

SEQ ID NO: 8685 - DNA, 103 bp, Homo sapiens; identical to SEQ ID NO: 8028

SEQ ID NO: 8686 - DNA, 96 bp, Homo sapiens; identical to SEQ ID NO: 8079

SEQ ID NO: 8687 - DNA, 83 bp, Homo sapiens
aataatagctactaaaaagtaacaaggttgagaccagctgggcaacataaggagaccccttcttcacaaaaaaaaaaaaaaaa

SEQ ID NO: 8688 - DNA, 96 bp, Homo sapiens; identical to SEQ ID NO: 8079

SEQ ID NO: 8689 - DNA, 366 bp, Homo sapiens
atctgcggagggttaggaggggaaaggttttttctacccgccggctcggsaccaggctgaaactcatgtttgaatttagtgagccgtttgttcgttagtccggaacactagcgcggtaggccaagctgcgaggaggcggcgaaatcagcgaatagcaaattataaaagaaacaaggctttatctcctaggccctctaaagcatccccaggagatccgtatccccgttttggagagaacgctgaagctcagaaaaactcagtggaaagcggcagacccaagcctcctcgccaagtctgagtgaccgtgaagccctggtttttccttctttttctttctttttgtacttttttttttttttttgggaa

SEQ ID NO: 8690 - DNA, 116 bp, Homo sapiens
acccggaagcctagtcgcccggagttctgagcgttctgttcggacctcctaccgttactctttcattcactcaagaaatgatttcttgagttcssggsctttgtcagagagatgaa

SEQ ID NO: 8691 - DNA, 79 bp, Homo sapiens
cattggtagcttgatggggatgrcmytgartctgtaaattaccttgggcagtatggccatgtttcacgatattgattct

SEQ ID NO: 8692 - DNA, 82 bp, Homo sapiens
aataatagctactaaaaagtaacaaggttgagaccagcctgggcaacataaggagaccccttcttcacaaaaaaaaaaaaam

SEQ ID NO: 8693 - DNA, 84 bp, Homo sapiens; identical to SEQ ID NO: 8594

SEQ ID NO: 8694 - DNA, 90 bp, Homo sapiens
gwggttgagacargagaatcacttgaacctgagaggcagaggttgcagtgcagcctgggtgacakagggagactccggccccctcccaar

SEQ ID NO: 8695 - DNA, 96 bp, Homo sapiens; identical to SEQ ID NO: 8079

SEQ ID NO: 8696 - DNA, 513 bp, Homo sapiens
caaagactcatgagaataaatttaggaaaaacataattgaggtgtagtcaaacttagtccttgtcgattttattgttactacttactatcttttaggagaagtgggtaaattctcagtatggcaggttatgtcctgttggtatggttttctgaatgacacatgtcagagccataagaagaggtgttagtcaacacatatttattgatctcttaccatgttctgggccttggatatagagtgtgcttttccattttctgacaaaggccacatggcacatgatatgaaatgtaagrargagwttggmcataggagaggmcataaatgtcatcagatctaggaaaggaaaagatgagcgttgatcacatagcctgtgtcagggttgcagggaacttctagactaggatttatagaacccatggggcagacacaaaagtagtagtggcagacagaatcatttattctgtatctttattgagtgccagctatgtgctctgtactgttgtatgcactgr

SEQ ID NO: 8697 - DNA, 500 bp, Homo sapiens
catggaatcggattgacagcaaaatcccagaggaaactggaacccaagataacagaggtaagctcaggttttcccagggaaaccttggaatggctccaaacttggagtcaacaaacaccaatcagtagtagtgggcagttgggtaatacttaagaattttcttaagacttcttttccacagtgctaggtcagttgggcttccctcctaccctttctccagcctaaacaactatgatgcccactcttaggcctgaagtttcagaatcawtcycytwaagaaadtwggtcagccagtttagtatgggcatctacttaggtgttagaacctgagagagaagtggaggcactgtgctaccccaggagaaaaacagttttgtctgttcccagccaacttgacttcctatccaggtacctttttggggtactgcgtatacgcgtgccctacctgcttaaattgtactgttcttccatttaaaggagaagccacttaggaaaacaaa

SEQ ID NO: 8698 - DNA, 455 bp, Homo sapiens
aaactgctctgcactggccccacattagggggttcctatctacggtttctaaatgtgagccccttgacacctgctgtggcagacacaaccatccccatggaggcgctgagaacaatgaagcacagacaggccagggtcacccaaagccgtgatgacagcccgcttttctctggtggttctactcaaccgctccactgaggtgatgggagaggtgaggggcccaggaggaaggtggagctcaaaggcactgtcttcatagtccacaggtctcmaaattccrgvwttycmagattgaaaggwttcacaagtgctcacaagaggcttggctgccaggggaagctccgacctgaagatttgaactaatgagggactataaaggccaagaccttgttcttgccattttagagattcagaatataatctacaaagttagagacaaaaaaaaaaaaaaaaav

SEQ ID NO: 8699 - DNA, 238 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgt

SEQ ID NO: 8700 - DNA, 565 bp, Homo sapiens
cagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagsccaattccaaaattycgctaaargctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcaca

SEQ ID NO: 8701 - DNA, 530 bp, Homo sapiens
ttaattcttagtaggtaaaacactgatgcactctgcttaccatgtaagcctcttaacgtaagatgtacagttttacatcacataacctggttgttcctgtcttgaagagtaagccacaccagaatattcagaaagaccaagatgaaaaactacaggctgtgagaaagggaccttaagatgcaatacggaacttgcttctggctattaccttcaattaacacaagaaaatggcccagtacataactagcggcacatatctttggtgtaaamcaccatwcacccmaggsttycrgctttaaaaatagggacatttgcagaagttcaagaccagcctggtcaacatggtgaaacctcatctctgctgaatatacaaaaattggctgggcgtggtggcaggcgcctgtagtcccagctgctcgggaggcggaggcggaagaatcgcttgaacctgggaggcggargttgcagtgagccgagatcgcgccattgcactccagcctggacaacaagggtgaaactgtctcaaaaaa

SEQ ID NO: 8702 - DNA, 451 bp, Homo sapiens
  misc_feature 212: n=a, g, c or t
gctgcgctgtgctttgtgascgtcaatgtgatctggatatagtatagtttgaggtcaggcatcatgctacctgacctcaaactatactataatgctactgtaaccaaaacagcatggtactggtaccaaaaaagatatatagaccaatggaatagaacaggggcctcagaaataacaccacacatctagaactacctgatctttgacaaacnkgacaaaaaccagcaatggggaaaggattccctatttaataaatggtgttkggraaaactgggdtagscawwtgssrgaaacctgaaacttgacccctcccttacagcttatacaaaaattaactcaagatagattaaagatttaaacaaagacctaaaaccataaaaaccctagaagaaaacctaggcattaccattcaggacataggcatgggcaaagacttcatgacttaaaacac

SEQ ID NO: 8703 - DNA, 271 bp, Homo sapiens
ctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatc

SEQ ID NO: 8704 - DNA, 447 bp, Homo sapiens
agcgccccttggaagccaagaatatgaggaagtcttcttccttcgcgccttcttcttccttacgctccagggcagcctgacagagccgctcgaaggctctgctggccgcggctagccggtttacccattccactggacccagccaccacccactcctgctgtctgggtgcagcagaagtctcaggtagctgagaagttcatggaatctbcdkatttgctacacctttcactactgcttgtgatatagtgcagggttgggatgtgcagacatttctcaagtgcactgtgtacctacacagcatgctgcaatttggctactgaagtcaagagaaactggtttgaacaactactgagtgtaacataggaagcgcatttcatttgataacaggaacacagcttttgtgctaataaaatgctttgaaaattaacaaaaaaaaaaaaaaaaar

SEQ ID NO: 8705 - DNA, 141 bp, Homo sapiens
ttcaatagtgtgctgtcaaagtgtgcttagctcacctggatatacctacattgttaaatgtctaaacagtaatcattaaaacatttttgattaaaaaaaaaaaaaaaaaaaaaaaaaaaaaaaaaaaaaaaaaaaaaaaaa

SEQ ID NO: 8706 - DNA, 500 bp, Homo sapiens
catatgtacagtttatttcaagtctaataaaatccaaacacagtatttgcaaatgctgcggctgtcaccacacatgatactaagattatggaggaagacgaaagggcaccaagagaaactgatatgtctgtcagtgacctgcgtgtgaggtcttatttgtgtcctcttatttaaagcaaacacacccattttcgctcgtcccaagaccccgtgatcagagttgtagaaactcactggaccaagcgtttgcattcgtaatcaaaacagtatttagcccacctggtggttaagatttctccctgagttaaaatctctaaacaaactatatcatgtgttagttacatccaggacccgtatgacacaggctagcatgtcacggtgccttcactacctttgcacgtaggcatcttcacattacatgttgtcccatggaatccatggtttgaaaagtgtcctatttgaaatgtaaccaattcaattcaaagggctgacagtgcctt

SEQ ID NO: 8707 - DNA, 485 bp, Homo sapiens
tcattctacaagataactgagaagtactcttcaagtatgtcaatatcatgaaagacaaaaatttaggaattactcagattaaagatgccacaaataagtgcgttcagtgttcgtggcttttcttttcctgtgaaggacattattgggacaattggtaaaatctcaataaggcctgtatattaaatggtagtattgttttggtgttaagttttaagtttcctgattttgaaaattsyatyttcgattttaagaaaatattctttttaggaaacacactgaaatatatagagtaataaagtatcatgtctgaaacttcctctcagatggttcagaaaacatatgcaggtagacaggaaaacagagaggaaaaaatggttatagcaaatgtgattctttgaaaaagaacaggataaagtaattgtggtaaaatgttaccacatgtgggatttaggtgaagactctatggggattctttgtgctagtct

SEQ ID NO: 8708 - DNA, 483 bp, Homo sapiens
  misc_feature 275: n=a, g, c or t
tgtcaaagtggccaggattggcggagcccatgctaatggctctgccagcccttctccccaccagagagggcagggggattcaggccctctagaggtagcattgtgaccgtgtctgcagtagtcaatccttgtgtgccacagtccctgackktgttgataagggcatcagcctacatccctctggtactcagtgataagcatctaaaatcttcttaaagaaaaaatttaaaaagckktcaaaatatacgacttaacatatgaggctgsataaakanctttttagcagtkgtccaactggkgcttckggttctgcctccccagaaagtggatgaccgggccaccctccaccactgccctgtaagaccatgggacacacaggccaccagttcttttcatgtggtcatcccctgttagatgggagaaaatacacctgcctcatttttgtaccttctgtgtgaacattccacggcagagcttcactaa

SEQ ID NO: 8709 - DNA, 433 bp, Homo sapiens
  misc_feature 289: n=a, g, c or t
accttggcgcgcggagtggcaccttggcgctgttggtggcggcggagacagctgtgaagtgtgaggttctttgtctgctggcagctaggggcgacgaggcgggacgtcatggaagtgaaggatgccaattctgcgcttctcagtaactacgagacgttaaaatacatatcaaaaacaccatgcaggcaccagagtcctgaaattgtcagagaatttctcacagcattgaaaagccacaagttgaccaaagctgagaagctccagctgctgaamcamcsgscttktaatnsctgtggaratccasctgatggtggaagagaktgaagagcggctcacggaggagcagattgaagctcttctccacaccgtcaccagcattctgcctgcagagccagaggctgagcagaagaagaatacaaacagcaatgtggca

SEQ ID NO: 8710 - DNA, 260 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgtccccgagcctcgccgagcctgc

SEQ ID NO: 8711 - DNA, 251 bp, Homo sapiens
aaatacaataactgaaaaaaagaacctcactgaatgatctcagtaatagaatggagatgacagggaaacagccagtgaacttcaggatagacaaaaagaaattatacaatcagaacaacagagagaaaaataaactgaagaaaaaaaaacagtgtcagggatatgttcaaagctgaaaagtctagtatttgtgttacctaaattacacaacgagaagagaaagcatgtagtgcaaaaaaaaaaaaaaaaar

SEQ ID NO: 8712 - DNA, 115 bp, Homo sapiens
cattcargaaaaacagrtatacacagacatgggccgraagctycaatgtgttttyctactgcaggaaggttaaagtggaacttcatgtcatagatttaaaaaaaaaaaaaaaaaa

SEQ ID NO: 8713 - DNA, 447 bp, Homo sapiens
cacccaaacaaatattttaatacatagcaggtattatcaaacccactttacagataaggaaactgagggccactaaagtcaaatgatttttaagagtttacatatttactttgaggcagattgcagaatttgaacccatactctgagtggttaaatctgaagctcttcactcttcttgcctctttcacttttctttcacaaattacaacaaattctgaatggtggggagcagggaagagattcagatgaatgatgatgtcttgtaagtttttgggagaatctatccatactaaataaccatctttggcaatgagaataatttaccatacatgtgtataaattgctgtaagaagcctgatgttcttagggaaaatgcttcctaggcatctttcccatcccagcacaattcttaaaaaactttcacaaatatgtcagaggcaaataatt

SEQ ID NO: 8714 - DNA, 431 bp, Homo sapiens
gaaatcataacagtctctcagaccacagtgcaaacaaattagaactcaggattaagaaactcgctcrraaccacacaactacatggaaaccgarcaacttgctcctgaatgactactgggtaaataatgaaattaaggcagaagtaaataagtwctttgaaaccaatgagaacaaagacacaatgtatcagaatctctgggacacagctaaagcagtgtttagaaggmaatttatagcactaaatgcccacaggagaaagcaggraagatctaaatcgrsacctkaacakcacaattaaaagaactagagaagcaagacgaracaagttcaaaagctagcagaagacaagaaataactaagatcagagcagaactgaaggagatacagacacggaaaacccctcaaaaaatcagtgaacccaggagctggt

SEQ ID NO: 8715 - DNA, 454 bp, Homo sapiens
aaggaaggagtgcaggacacaaacagcacgcgaggtgaagaagcgggtgctcgtacagcaagtgccaacatgcattaggcagccggagggcacacaggaccactgtggggaggaatttcacctcgatttttaaaaagggtcaacgtcatgaaagacaaaggaagactgaggaactgtcacaaactggaggagactaaggagacatcgcaaatgatgcagtgtgggatcctggaacagaaaaggggtgtaatgggacactggagaatgtgatwaaggtttccagttctactgcaaatcaccactgtgcccaggctgagctcagtcagagagaaggggaatgaagccaagagcccacaggatgattatttgccattcatgtggcatgctcccagataggcactcttggattatactcaacctcctcaccaacctcataaagtattccagacagagc

SEQ ID NO: 8716 - DNA, 222 bp, Homo sapiens
agcccctctamctccggaagagacgagtgcggtaacaccgttcacagakctagccggacgtcctccgactcaagatatttgtcaaatattttcagaagatggctgatccttggcaggaatgcatggattatgcagtaactctagcaagacaagctggagagtktgtgaagctataaaaratgaaatgaatgtkatgctgaaaagttctccagttgatttggt

SEQ ID NO: 8717 - DNA, 309 bp, Homo sapiens
agctccgggtgccggtkgaggttgckggtggacctgctctggtggtcttggatgadgccccatgagcgcggcgcccctggtgggctacagcagcagcgrctccgaggatgagtccgaggacgggatgcggaccaggccgggggatgggagcbaccgtcgtggccagagcccccttcccaggcagagatttccagtacctgacagtgtgctgaacatgttcccgggcaccgaggaggggcctgaagabgacagcacaaaacacgggggacgggtgcgcaccttcccccacgagcgaggcaactgggccac

SEQ ID NO: 8718 - DNA, 384 bp, Homo sapiens
attattgttctttttttgcgatgggtctctgttacctaagctggtctgagctcctgagctcaagcgatcctcctgcctcggccacccaaagtgttgggattacaggagtgagccaccacgtctggcctctcgtcgtttttattttttaatttttgagtgggggctcgctccgtcgcccaggctgtgatgcagccgcgcgatcacgacctactgcatcctggacctcctgggctcaagcgaatctccggcttcagctcccaagtagctggaactacactcccgcgccaccacgtcccgctaaattaaaaaaaaaattgttgtagagatgggggtctcgttgtgttgccctgacaggtctcgaactcttgggctcaagcgatcctc

SEQ ID NO: 8719 - DNA, 375 bp, Homo sapiens
  misc_feature 307,314,318: n=a, g, c or t
aaatgaccgcggcctccaggagtctcatggaagggacggtacccgcttctgccacctcctggaccttcctgacaaggactattgcttccctaatgtcctgaggaacgactatctcaaccgccacctgggcatggtggcccaagatcctcagggctgcctgcagctctgcctgagcgaggtggccaacgggctgaggaaccccgtctccatggtccatgctggggacggcacccatcgcttctttgttgccgagcaggtaggagtggtgtgggtctacctccctgatgggagtcgcctggagcaamcnttcctgnwvvntcaagaacatcgtgttgaccaccccatggatcggggatgagagaggcttcttggggt

SEQ ID NO: 8720 - DNA, 315 bp, Homo sapiens
ttttgaaagactagaagctcaactgaaggcatgtcattgcaggatcatattttctaaagcaaagccttctgtgttgggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaatttcagaagttgaaatggattgtttctgggcgtactgcacggcaattgaagcatagctactacaga

SEQ ID NO: 8721 - DNA, 236 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagagaggggaccg

SEQ ID NO: 8722 - DNA, 329 bp, Homo sapiens
tataaaaacatttaattttttataaaatcctattcctacaggataaaagggaaattgaagcatcgctgactcttgggatttgaccatgaggggaatacagatttttcaggttggtaaatgagaattgtgtcaaatgctgtcagccatgtcttctgtttacagcatgcctctgtggtcctgccacaggttcagtagttcatttttggccactggctggtcatcatttcccatttgtctagcacagatgtggatgatgtaggatggatgaagtgactcagcctgattgttgacagtaataagarataacagaaaacaataagtaataagam

SEQ ID NO: 8723 - DNA, 159 bp, Homo sapiens
  misc_feature 94: n=a, g, c or t
caaaaaattagccgggcgcggtggcgggtgcctgtagtcccagctactcgggaggctgaggcaggagaatggcgtgaacctgggaggcggastngcagtgagccaagattgtgccactgcaatccggcctgggctaaagagcgggactccgtcccaaaa

SEQ ID NO: 8724 - DNA, 342 bp, Homo sapiens
  misc_feature 284: n=a, g, c or t
aagaaaaggactctctggaacatggcaacattaatctgaccacaagctgactggcaggtgctttaaccacaagctctgactccaggccctgtcccctgagctctgccctcggatgtccgaccgcccagagcctgcatgcgccgtggggcgcccaggaccaggagctggtgggtccggggccccctgggcgggggtcccggggmrcccctcctcccttgggacccgttgtcccggtcctggtctttcccccggatctagtattcagggcggaccagcggasgganccccgacagctgctgaccctctataaccccacaggaactgcgcttcgcttccgagtcc

SEQ ID NO: 8725 - DNA, 192 bp, Homo sapiens
agtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatg

SEQ ID NO: 8726 - DNA, 199 bp, Homo sapiens
aaaaagaaagtgctggaggaaatgaaagaacaaagcgggctgtctgtgtgcccacgccggggccggtcactamcttttctgsctgacaagtgtacataaaacaattcccgaacagcacggagcatcagacacaactagaggggctggtctcaccctccgccagccacgggsccaggcggtgccagggtactgtgccatg

SEQ ID NO: 8727 - DNA, 390 bp, Homo sapiens
actgtaatgaaactacattgtatttctaagtgtgaaaacgacaggctgccccgtttttactaattgcatttgcattttwaaggtactactgaaggtcagatcaaagttgaaatgcaaaaatactaattagagaataatgtgaataaaatgggaatcttcttggtattttatgtgtattgtaagtagcagttaaattatttttttaaaagcaatttcagttttaatcactgaacaaaagaaacaggcaacattcacttctgtagtatggtttccacctatctctaacaccactattaaggtacaccagtgttaaggtacattaataactacacaaaattttatttaaagagaacacttagcagcctatgatagttttcaataaaatgttgc

SEQ ID NO: 8728 - DNA, 322 bp, Homo sapiens
gcggctgttgctgcggascaggaggggaagcgatggctgggcccgcgtggatctccaaggtctctcggctgctggggggcatttccacaacccaraacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaa

SEQ ID NO: 8729 - DNA, 73 bp, Homo sapiens; identical to SEQ ID NO: 7980

SEQ ID NO: 8730 - DNA, 280 bp, Homo sapiens
atgggcccccttcgtctcagctgtgcgggaacggccgagggtaacatcccgggctcgcgggaggctgtcggggtaatggscacacgctgacagaaccagccgagtggaaaaggggagcgaascgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggt

SEQ ID NO: 8731 - DNA, 178 bp, Homo sapiens
ggagtgcaaaaaattggctgggtgtrgtggcgggcgtgtgtcgtcccagctgcttgtgaggctgaagcgggaaaatggcatgaaacctggraggtgsagcatgcagccagccaagatcgggccgctgcactccagcctgggggacagagcgagactctgcctcaaaaaaaaaaaaaaa

SEQ ID NO: 8732 - DNA, 465 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagagaggggaccgtccccgagcctcgccgagcctgcggtgtagacacctctggkkctaagttggttgaggatctgttgaccgggcatggtgggtagaaggaacgctccgagcagaagaaaagtggctgtcgtgaagacatctgcgtgtgcggggtgcgtgggtgcctggagatgaagctggaaagagctgctgcccaaaggagcaaggaggaacagcgggattacgtcttctacctggccgt

SEQ ID NO: 8733 - DNA, 172 bp, Homo sapiens
  misc_feature 160: n=a, g, c or t
caaaaaattagccgggcgcggtggcgggtgcctgtagtcccagctactcgggaggctgaggcaggagaatggcgtgaacctkggraggcggacttgmagtgagccaagattgtgccactgcaatccggcctgggctaaagagcgggactccgtcccaaanaaaaaaaaaaaa

SEQ ID NO: 8734 - DNA, 384 bp, Homo sapiens
  misc_feature 61: n=a, g, c or t
gacttgtccacagggcagcaagaagatgcgccccttggtgtgtcccgagtgtctcctgtangcagctgagctttcgcagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatc

SEQ ID NO: 8735 - DNA, 78 bp, Homo sapiens
taataacagtgtgaccttaaacaagtcgcttaactactctaagtttcagtttctttcacggtctaaatggagattmav

SEQ ID NO: 8736 - DNA, 52 bp, Homo sapiens
ttaagacattcatcctcccggaggcccgcgccgccctcgccttgcagcacah

SEQ ID NO: 8737 - DNA, 72 bp, Homo sapiens; identical to SEQ ID NO: 7981

SEQ ID NO: 8738 - DNA, 294 bp, Homo sapiens
cctgcgcgcggcaacatggcggggtccaggtggaggtcttgaggctatcagatcggtatggcattggcgtccgggcccgcaaagcggggsctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggac

SEQ ID NO: 8739 - DNA, 398 bp, Homo sapiens
  misc_feature 226: n=a, g, c or t
aaaaagtcagcttaacagcattaaaagcaatttcaaaaaaaggaaacgaataccatatgatccagtaattccagkcctatggtataatctccaaaagawttgaaaacaggcccctggacagttatttgtacatcagtgttcatagtagtagcattgttcacagtagccaaaggtggacccaagatcccatcaacaaatgaatggatagataaaatgtggttcatmnatacaacaaaatactattcagccataagaaagaaagaaattctgatttatggtacaacatggatggatcttgaggacattatgctaagtgaagccagacacagaaggacaaatactggatgattccacttacatgagtacctagattaggcaacttaatattctacagaaat

SEQ ID NO: 8740 - DNA, 337 bp, Homo sapiens
  misc_feature 251: n=a, g, c or t
cctgatgaaatattcaaacacataaagggatggccctggaggtctatcctgcatacctggagagcttctctggtcctggccsacytggaaagttgcagactttgttgtaacatctatgtgatgagcttccctgtgaagccccatttgacagttgggccagcagtgttttatcagcactctgatggcccacatttcccaggaaaacttcttgaaacttaccgttgtgggcagtggtcagagcgtgtagttcntatgactgtcttgkttcatctgtggagcacgtgtggagcacgttggtrcagmagtttctgtggggtttggcatgggtgattttggk

SEQ ID NO: 8741 - DNA, 239 bp, Homo sapiens
ctttaccgctttctcattccgactgccactctttgttctttcvtctccgcgtccccccgaccctgtgtgtcgtggktcgtkgcsggtccmagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaattw

SEQ ID NO: 8742 - DNA, 455 bp, Homo sapiens
  misc_feature 225: n=a, g, c or t
actagtcgcccggaggttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggagggnaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggggtgcgtgggtgcctggagatgaagctggaaagagctgctgcccaaagggagcaaggaggaacagcgggattacgtcttctacctggc

SEQ ID NO: 8743 - DNA, 377 bp, Homo sapiens
atcagaaagagacttagaactagacaatcctgattgaaaatgacactttaggactgatttgaccatggtgatargtgagctaaaaagcaacttataaaaaaaaatgccagaagcctttttttattaggataataagagcacactaatatttttwttgtattgagttcaaaggatgcatgaatattctgttgttcatgagtgacttctagactatttaaaattattcatgaccattgataataaaaatagtaccacggccaacctctcccctcagcaaacaacatgaggtttgtaaccctttgtttaaattttggcagtgtactaatgttgttaagatgacaatctatttcttctcaaagctgtattaaagtggcaca

SEQ ID NO: 8744 - DNA, 287 bp, Homo sapiens
  misc_feature 92: n=a, g, c or t
taccttgycgggcgcggtggstcacacctgtaatcccagcactttgtkaggctgaskcgggcagatcackaggtcaggagatcgagactatnctggccawcacggtgaakccccctmtytactwmaratataaaaaattagccgtgcatggttgcgggcgcctgtggtcccagctactcaggaggctgaggcgggagaatgatgtgaacccgggaggcggaccttgccgtgagccaggatcacgtcacgacactccagcctgggtgacagagcaagactctgtctcm

SEQ ID NO: 8745 - DNA, 284 bp, Homo sapiens
  misc_feature 192: n=a, g, c or t
ttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactthrcccttgtganccctcccttcccccctccmcccccaaaaaaaaacaacaaaacacaaaaaataaacatttgttccagggcaacctggaaaaaaaaaaaaaaaa

SEQ ID NO: 8746 - DNA, 319 bp, Homo sapiens
attcctgtgtgaagagtgccagtgtgaagacagttttgtaagaactgcaagtgctcaggctgtatgggaaacagaaacttcagcagatgawctgaccttatgccatttcctgatgtttggcagtgacactgaaagaggaccgcatgtcccctctttatgtggatttatcttttatgaaaagtttgcttttgtccgggacagtttgttgtcgtgagatacatcagacartataatcatgggacaagctgatgtctccagaccggtaaatccagatgcagttgaggaagcagaccagcccactacagagccaggcatggts

SEQ ID NO: 8747 - DNA, 327 bp, Homo sapiens
agtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaagttaaccagaatcaggccaagagatgcacagtgatcgggggctctggattcctggggcagcacatggtggagcagttgctggcaagaggatatgctgtcaatgtat

SEQ ID NO: 8748 - DNA, 322 bp, Homo sapiens
gcaggctctccggcccatctccacacgggcaccttctggctgactcggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagcthcatgcccaccatcctctggctgatggactggtcagacatgaactccaacctggacttgctggctcttctcggactgggcatctcatctttcgtactgatcacgggct

SEQ ID NO: 8749 - DNA, 81 bp, Homo sapiens
taagcatatttcagtcctcactgaaaagtttggctttacatttcaattagaacaatcatgagattgtttttctgacaataa

SEQ ID NO: 8750 - DNA, 409 bp, Homo sapiens
cacttaatttytatatttatacatgtacatttgtatatacatagagaaagtgcaggcaaaaccattatacagttastctartagccatttgctactgccagcagtctcaggactgatccctgtctaagctggcaagtttacattctccttgtatcactacaggatttgctctggacaggagctgtaactcctcaacaaatcctgctttcagtctactactgcacagcttgaattgttcagtaggcccagctttttgtgaaagaaaaggccttgccatggtataaagagtttttttccctctataaaagatgtaaaatttttggctgggtgcagtggctcacgcctgtaatcccagcactttgggargccgakgcgggcagcatcatgakgtcaggagatcaagaccatc

SEQ ID NO: 8751 - DNA, 476 bp, Homo sapiens
  misc_feature 403: n=a, g, c or t
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggggtgcgtgggtgcctggagatgaagctngaaagagctgctgcccaaagggagcaaggaggaacagcgggattacgtcttctacctggccgtggggaactac

SEQ ID NO: 8752 - DNA, 354 bp, Homo sapiens
atagcagagagctgaacactgactgagggagaagctaaactacagattgccaatgctaaatctgagaaccaaagataggtttctgttgctgttgaacacattctagtgcttacatagcatttgcgttgtattagatgttaaaagtaatctaaagatgatttcaagtgtatgcttaggttatatgcaaatactatgcaattttatataaaagagtacctgcagcttttggtatccactggggtctagaaccaatctcctgtggatactgagggaagactgtaatgtcaggtgttgctttttcytttttcagatcawttatcattttgataagagggtcacacaatttagttggct

SEQ ID NO: 8753 - DNA, 327 bp, Homo sapiens
  misc_feature 287: n=a, g, c or t
catgactagggggatgattattagtcacatagagcttgggagtaccactcgaaacgtatgggtaggagtttargtggcttctgtttttcaaaagatgatcttatcctagtatctgtaatgctcacttggcacacctgamttgtgggctgwgtgtaargtggctagctaagtgaaaaaagcctgctaggtgtgagtcaacttaagaatatgtaaataggtttgagaaaaagtagggcttgggtgcaagtaaagattgagcaggaaataaaggaaaatcaagtataatncvtgagabkygtagactaaaggcaatgatgtgggactact

SEQ ID NO: 8754 - DNA, 422 bp, Homo sapiens
  misc_feature 229..230: n=a, g, c or t
gsctaaaatkkgtttctctcttgaagaggattctttgaaaaggtctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctrnnwrggtccaccaagggctcctgcttttcagacaccccatcatcctcgcgtcctcamcctgtctctaccagggaggtgcctagcttggtgaggttactcctgctcctccaacctttttttgccaaggtttgtacacgactcccatctaggctgaaaacctagaagtggaccttgtgtgtgtgcatggtgtcagc

SEQ ID NO: 8755 - DNA, 150 bp, Homo sapiens
ttstttgagacagggtctcactctgtccccaggctggagtgcggcgttgcgatcttggtctgggctcactgcaagctctgcctcccaggttcacgccattctcctgcctgggcgacagagcaagacactgtctcaaaaaaaaaaaaaaaa

SEQ ID NO: 8756 - DNA, 94 bp, Homo sapiens
gymwaacaagggcagcgggcccggcgcggtggctcacgcctgtaatctcagcactttgggaagccaargcgggcgaatcacttgaggtcaggag

SEQ ID NO: 8757 - DNA, 148 bp, Homo sapiens
cacttagaattagggtctctttttaccctaattccatctcagcttgcaggcaatagagtaaaaaatttgaggccargcgcagtggactcacgcctgtaatcccagcactttkgggaggccaaggcaggcagatcacttgacgtcagag

SEQ ID NO: 8758 - DNA, 402 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgtccccgagcctcgccgagcctgcgtgtagacacctctggtgtctagtggttgaggatctgttgaccgggcatggtgggtagaaggaacgctccgagcagaaggaaagtggctgtcgtgaagacatctgcgtgtgcggggtgcgtgggtgcctggaagatgaagct

SEQ ID NO: 8759 - DNA, 289 bp, Homo sapiens
ctatattactggcccacagagaagagcagagagctaatctggggattgttttcagttgcctgttttatattatgcattcaggaactggggaagtaactattacacaataaggatttacagacccatagaactctctgagacagctttgggctgaaactttattaatcgcttgaccatcctacgtgccctctttcttggaccacagtgatgttttaggtcagttcagtgccatgtttttgtaatgcctgaaagatcttttcccccatgcacagtcactgtagtgaatgcc

SEQ ID NO: 8760 - DNA, 314 bp, Homo sapiens; identical to SEQ ID NO: 7928

SEQ ID NO: 8761 - DNA, 154 bp, Homo sapiens
catttgatcaaatgctgtaagcacagccaaggcccaaattcatctagataccaaaaatgtgatttcagtgaaatctcttttcattgccgctttcttttgttgttgtttgttttttgagccagagtcttgctgctctgtcacccaggctggagts

SEQ ID NO: 8762 - DNA, 203 bp, Homo sapiens
aaattgatggtgttttacaatctctcttggtcattgtcattgttaaacagtttttttaaatcattctgagtttggaatgtgtgctgtatatctttttttttttggaratggagtctcactctgtcgcccaggctggaatgcagtggcatgatcttgggtcactgmaacctccgcctcctgggttcaagcgattctccagcctc

SEQ ID NO: 8763 - DNA, 374 bp, Homo sapiens
gaaaatccgcaatctaagacctgaaactactgccacagccatgcataaaatgaaatgctgctgctttcctctctgttaaagagaatgttcaaggccgaggacacataaaaaagagcagcattgctggctctgttatttagctgtgtgttcttgaaaaagtcacttctccagacatatctcagcatttatdacctaagactgaatcactgcattttacccttaatgaggtacgcttacactaatctttttgaaacagtacttaaattgtagcaggacaagccgcagacaaaacccctcagccagcgagtttaagaaagaagggctttattcggccgggatcttcggcaagactcacgtctccaacaaccaagctc

SEQ ID NO: 8764 - DNA, 360 bp, Homo sapiens
  misc_feature 304: n=a, g, c or t
cttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaarrkttttwtggaagaaaattggtgttgctgatagagaagangtggaacaacaagcrgrtaawtwttwbhagggatgctgatatcagtgatgttgcat

SEQ ID NO: 8765 - DNA, 384 bp, Homo sapiens
  misc_feature 129,211: n=a, g, c or t
agtcggggttgcgagcggcccggggccggggctgccagggccgctgcaggacgagaccctgggtgtggcgtccgtgccctcggcaktgdagggccgtccagggcatccgcggggagacgaaaagttgcnagacggcmagcattgccactgccagtgcatccgcccaggccaggaatcatgtggacgcccaggtgcagacggaggcccccangcctgtcagcgtgcagcccccgtcccagtacgacatacccaggctcgcagcctttcttcggagagtggaggccatggtcatccgagagctgaacaagaattggcagagcacgcgtttgatggcttcgaggtgaactggaccgagcagcagcagatggtgtcttgtctgtatas

SEQ ID NO: 8766 - DNA, 73 bp, Homo sapiens; identical to SEQ ID NO: 8430

SEQ ID NO: 8767 - DNA, 375 bp, Homo sapiens
attattgttctttttttgcgatgggtctctgttacctaagctggtctgagctcctgagctcaagcgatcctcctgcctcggccacccaaagtgttgggattacaggagtgagccaccacgtctggcctctcgtcgtttttattttttaatttttgagtgggggctcgctccgtcgcccaggctgtgatgcagccgcgcgatcacgacctactgcatcctggacctcctgggctcaagcgaatctccggcttcagcctcccaagtagctggaactacactcccgcgccaccacgtcccgctaaattaaaaaaaaaattgttgtagagatgggggkctcgttgtgttgccctgamaggtctcgaactcttgggctca

SEQ ID NO: 8768 - DNA, 448 bp, Homo sapiens
actagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgtccccgagcctcgccgagcctgcggtgtagacacctctggkctaagtggttgaggatctgttgaccgggcatggtgggtagaaggaacgctccgagcagaagaaaagtggctgtcgtgaagacatctgcgtgtgcggggtgcgtgggtgcctggagatgaagctggaaagagctgctgcccaaaggagcaaggaggaacagcgggattacgtcttctacc

SEQ ID NO: 8769 - DNA, 341 bp, Homo sapiens
tatgttagtaaatagaaatttaaaagttttcactataccaatttgaatatctttctaaattttatctgctacaaagtgctakttttatattaggcccattgrtttgcagaattataaagctaatactgaatatggtaaattactgcacttggcctttaatgagatttttgaaacgaatacctrdaccataactaatgtaatccaaaatgccatctcattttattcagcttgctcctgttggctcctggtaaaactgagttgattctaaattctcaaartatattcaaaactaagggwmwwtttgtagaaggggctaaagaagcagtatctgttggacttca

SEQ ID NO: 8770 - DNA, 414 bp, Homo sapiens
aaatggggaaaatgtcaccagggcatgtaggaggtcttcgaggcagcccctttcatcacaggcccagaggcataggaggaaaaaatggtttcacgggctaggcccatggtccctgtattgtgtgcagtctagggacttggtgccctgtgttccaaccactttagccatggctaacaggggccaaggtaaagcttgggatgtggcttcagagggtgcaagcccccaagccttggcagcttctacatgatgttgagcctgcgagtgcacagaagtcaagaattggggtttgggaacctctgcctagatttcagaggatggatggaaatgcctggatgtccaagcagaagtttgctgcaggggtggggctctcatggagaatctctgctagggcagtgcagaagggaaatgaggggt

SEQ ID NO: 8771 - DNA, 236 bp, Homo sapiens
tcaataataggaattttaagagctcaaaagctgcttcttagtcaggtgcggtggctcatgtctataatcccagcactttgggaggcccgaggtgggtggatcacttgagtgcaggagtttgagaccagcctggacaacgtggtgaaaccccatctctacaaaaaaatcgttaaaaattagctgggcatggtggtgtgcgcctgtagtcccagctacttgggaggctgagatgggar

SEQ ID NO: 8772 - DNA, 386 bp, Homo sapiens
tctgcgcaggcgccgagcggccgaggcgccgcggtcggctctgggactcgtctggcgtccctcagaggcagaagaggsctkggaccttggcgcacacagacccaggaacagatgagcggggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcag

SEQ ID NO: 8773 - DNA, 383 bp, Homo sapiens
tgagaaatcactcactttgattatgtatagattacataggaagaacaatcacatcagtaagttatagtttatattaaaggtaattttctgttggctcataacaaatataccagcattcatgatagcatttcagcattttccaaggtaccaagtgtacttattttgttgttgttgttgttgttgtattttagaaggaattcagctctgatgtttttaaagaaaaccagcatctctgatgttgcaacatacgtgtaaaatgggtgttacatctatcctgccatttaaccccacagttaataaagtggctgaaaataatagtagctctggcttggtgcttgacctggttaaatactgtcttaaagctcatacaaaacaaataggct

SEQ ID NO: 8774 - DNA, 191 bp, Homo sapiens
accttgtctcgctcgggagcggaaacagcggcascagagaactgttttaatcatggacaaacaaaactcacagrwkgaatgcttctcacccggaaacaaacttgccagttgggtatcctcctcagtatccaccgacagcattccaaggacctccaggatatagtggctaccctgggccccaggtcagctam

SEQ ID NO: 8775 - DNA, 336 bp, Homo sapiens
ttgtgactctgatgatggtttcatgggattataagaaaattcaagccaggagcagtggctcacgcctgcagkcccmaacactttgagaggccaaggcgggcagatcacgaggtcaggagattgagaacttcctggctagcagggtgaaaccccatctctactaaaaatacaaaaaaggtaggagtggtggtggttgcctgtagtcccagctattagggaggctgaggcaggagaatggcatgaacccgggaggcagggcttgcagtgagccgagattgtgccactgtactccagcctgggtgacagagcgaggstgtcccaaaaaaaaaaaaaaaa

SEQ ID NO: 8776 - DNA, 273 bp, Homo sapiens
aaagttagttattattaataaatatgtaactagatatttgtgcttttagctgagacttttatgattttatgkatgygggktttccacgtacttkatgtttacatatcaaatgatttttggcatcaggattcagagtatgctttgaaaaatttctccatgaatcttgatagatgcttaaatataagggaatagagtgtgttttattttataaaatgtattttataatgtttgtaaagaagttgttccattttcccacttaactcttatacgcas

SEQ ID NO: 8777 - DNA, 226 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtaga

SEQ ID NO: 8778 - DNA, 226 bp, Homo sapiens
  misc_feature 68,76..78: n=a, g, c or t
tttttgggcttcgcttccaccgcaccagccggcctacccagtccttccggtatcgcgttgctcagggncttttcannnckctgtcagtcggaaaaccatcgccgaggccgtggggggactcvwatccatggtgttgaagcgtcgagccgactagggaacctccttccccgccaggatggaagtcgcatcagtcgccgcctattgcgcgggctgttcttccctgtgk

SEQ ID NO: 8779 - DNA, 380 bp, Homo sapiens
tgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagacggagggagaagagccaaggacaaggtcaggttgaatkagtwagrggkgtgtacacahatcctcttgtgtgctaggtagtgggcgtgcatctggatctgagaggcagtaaagcagtgatgaagacagtgcagcagaacattgaagtcctgattgcagcagtgactctgcaaccttggataaattatttcaatctttat

SEQ ID NO: 8780 - DNA, 215 bp, Homo sapiens
tbatacgtatatatcatcgcacggtgtgtcccggaaggcttgatatgctagtcccgcgggacaaggcgagccgaggagtttgtgtggaagtttgcatctgagagtgcgagastggacggagtgttacagagccgcgatgccttctcgttttgttttgttttgtttttgatacagtgtctcgctcttccgcccagtctcgagtgcagtggtgagaa

SEQ ID NO: 8781 - DNA, 410 bp, Homo sapiens
tccagaaakkgatgtccccagatctttagatgaacatttaagcgaagagtattaaatacttctcactgtaaattttcatctattatgaaagatactaaaaataatctcgttttttaagtttggaattgggagaatgtcattgaagtttttcagtgcttgttttttgagatacacatactttgccttaaatctggggtttttttcccttaagccatgtgaccctttctacaaactcagtgtatgtttttaatatttcctgggtactctgctatcgtcctaatacataatattagggtaaggctgccctaatacgagaacattttgagtatactattgagtatacatttgagtatacatattgagtatactatttatgccaacgtgaaggatgtgattagttttagccttca

SEQ ID NO: 8782 - DNA, 136 bp, Homo sapiens
ttaaaatgttcatackacccaaagctagctctagacacaatgcaatccctatcaaaataccaatgacattcttcaaagaaatagaaraaacaatactaaaatttgtatggaaccacaaaagaccccaaataaccar

SEQ ID NO: 8783 - DNA, 73 bp, Homo sapiens; identical to SEQ ID NO: 8430

SEQ ID NO: 8784 - DNA, 139 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaag

SEQ ID NO: 8785 - DNA, 396 bp, Homo sapiens
  misc_feature 195: n=a, g, c or t
tacccattaacaatcactcctcactctccatttcccttagcccctggcaaccaccagtctatttttttgtatctattgatttgcctattctggacatttcatataaatagaataatatctgtaatcctagcactttgggaggccaaggtggccggatcgctttgagcccaggagttccagaccagcctgggcaangtggcaaaactctgtctctacagaaaatacaaaaattaaccaggtgtggtggtgtgcatttgtagtcccagctacttgggaggctgaggtgggaggatcacttgagtccgggagggcggaggttgcagtgagctgagatcacaccagtgcacttcagcctgggtgtcagagctaggccctgtcccaaaaaaaaaaaaaaaa

SEQ ID NO: 8786 - DNA, 251 bp, Homo sapiens
actagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgtccccgagcctcgccgagcctgc

SEQ ID NO: 8787 - DNA, 399 bp, Homo sapiens
  misc_feature 360: n=a, g, c or t
attattgttctttttttgcgatgggtctctgttacctaagctggtctgagctcctgagctcaagcgatcctcctgcctcggccacccaaagtgttgggattacaggagtgagccaccacgtctggcctctcgtcgtttttattttttaatttttgagtggggggctcgctccgtcgcccaggctgtgatgcagchgcgcgatcacgacctactgcatcctggacctcctgggctcaagcgaatctccggcttcagcctcccaagtagctggaactacactcccgcgccaccacgtcccgctaaattaaaaaaaaaattgttgtagagatgggggtctcgttgtgttgccctgacaggttncgaactcttgggctcaagcgatcctcccgtctcggtgtc

SEQ ID NO: 8788 - DNA, 509 bp, Homo sapiens
atgtaacacatgaggtaaaagtaatctcaaagttgacatgctgatggggactcctggcaaggggagttccctgccctcaacaaaaggtcatccacagctactggaacatttttgttgtctgagaagtataaagtgccttagaaatacctgaatccattaatgcctccagttggtgaaatcagaatttgcaggtgactgavattgacagtagtgccttgttcttactcactgttcaaatgacaacccacatgttttatgadttssgtatacagatgtatgctctaacagcagtatctccctccagagccactgtgtaccaagcaccaggtcctccagggatagttggctctattcagtctttgattcattcaacddgagcttactaagctcctttttggtaccagatactgtttgttgctgaaaataaataaaaggscagcaagattaagtagactgtgagatctggaccagtaatttgacaacacaaagtactgtcgtaaagatacagt

SEQ ID NO: 8789 - DNA, 446 bp, Homo sapiens
  misc_feature 259: n=a, g, c or t
ctattgctatgttttcaagttcagttatcttttcttctgtaatgtctcatcttccattaatcctatataataggtttttcaacttagacattgtagttttcatttctagaagttcagtttgggtctttttatattttccacatctgttacctttttgagccctatagaatacagttataactgttttaatgtcctaatctgctaatgtctttgtcatttttggatcagcttggatcaatggatttttttccctcatbrntcatgttttcctgtctgtttgcatgcttcatatctttgattggatgtcagacctaattttaccttattaggtactgggtatttttatttttattatttatttatttattttgagacggagytcactcttttgcccaggccggagcgcagtggcgtgatcttggctcactgcaacctctgcctcccag

SEQ ID NO: 8790 - DNA, 464 bp, Homo sapiens
aatgagtcttcttaatttaaactgactactggatggcttcctgttatgttaagaggtagcaacttaaacatagagcattttaaaattgagctttaacgtacatcagagcctaagatttgactctgattttgataccctgagtaaacttaagcaccttttctccttcattcactttggtaaatgagctgtgcagccatgctcttctcgtaaacttttacctgctgtgctaggctgtgagccacgaakkcctgcactgccctgtgccagtgtctggaacattctccaagtaattggccagtgcctgcgcagatagaatgcaggtagaatgccagttctccccaacccttgccattgatctgcatcttgggaggctgtgcaaggagttggaggatctggggttttcccagtgtctggtcactgaaagaaattttttctttttagtgactccaggttagtgtctgaga

SEQ ID NO: 8791 - DNA, 461 bp, Homo sapiens
taaaaaatgttctcagaggctttctggagagatcttatttgtcaattaacatggcaaccaaatggagctgttgatccaaggtaatacactgaagacattcattcatttagttgtagatcataattctattagggaacatgtggtaacctaagatctgttagactctaccttcattacaggagctataatgaaaaagtactgattgaagagggaacttgcaaagaaatatgagatgctgttaaatgtggtccctcctgcttcagataattaccactttaactttaatctctgatgctcgttgtcttcattcaggccacgtatatatagtgaaggatttcatacctggcaggtaataatagagcaaaaattctaggcccaaacaaaacttcacttaaaccacttttcctgaacatctgctctgaagtcagactcgaccacttactgtgtgactttgtagggca

SEQ ID NO: 8792 - DNA, 235 bp, Homo sapiens
tttttggtcagcactgatgtccttggatgagacacaatgtttctctactgtgataggccggagaaagacctagttcctaggggtctgttttatgttttaaagtctatgatcacccaacctattttcacactggtgagctgcccacaatggaagaatgmaaaatttatagmattgggcatttctaccctggcatctgtcagtggacaacataactctcatcaatccaattcatgat

SEQ ID NO: 8793 - DNA, 408 bp, Homo sapiens
ttatttatagctgagtatgagtttactatgcagagaacctgagtcatgggctgactagtgaatgtatcaaaaagcggaatgtgggaatgtaaaagggtgcaacaactttggaaaacagtttggcaatttcttaaaaagttaagcatcaacttaccatatgacctagcaatcccacttgtaggtatctacccattagaaatgaaaacatatctacaaaaatacttgtatatgaatgttcataggattaatcataatagcacaaaactggaagcaatctaaatgtccattaactggtgagtgggtaaaccaaatgtggtatatacatacaactgaatactattcattaataaaaaggracaaaatgcatgctgtaacacagatgaacctcgaaaacattatgctgagtgr

SEQ ID NO: 8794 - DNA, 421 bp, Homo sapiens
tacatttacaactaacagaatgtactcatatatatagtcactatatttaatattgcctaggtatttcttttttattcctgtgtatgtgctgaatcataataactgatttatttgttgatattaattttagctcacagtagcattatttacattgtaagcattttttttctaggtacatgtcatgaatataacgtgctttttaaaactcagattccaaacttggcatacgtctaaactccttagaatggagttgaattttgcaagagttgattaaatcagtatgatgatttgagggtcactggctcactttggtctgtttcttggtcaaagaccattttcctcatcttttggctaggctttcttcaagtacatgttgttggcaatgagaagggtactgtgtgaatgagaataaaatcaagac

SEQ ID NO: 8795 - DNA, 390 bp, Homo sapiens
agatgtcccttcctgctcccaaatgcctcactgccccaggggtagtcactctcctgacttctttggccatcaccataacaaagaaaagctttgcctcactggatagttaccacccttgcacgtatccttgaacactgcagtttcgttttacctgtttttggactttctgtgaatggaactgtacagcgtgtactctcttgtctcacttggcaccccattgtgctgactgtggccaagtgctgggatccctctcctcaggcctatttcactctcccccgaaatcagcccatccagccaattgaccctgctgcctgggtgtcccattccgcggctctgactggcaccttcccagcctatccaggttcctcctccatgagcaccattacatck

SEQ ID NO: 8796 - DNA, 159 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtcccaaak

SEQ ID NO: 8797 - DNA, 71 bp, Homo sapiens
acctctcccgacgatccgggtcctcccgcccttcgcggggrttctgtcgcsaaccctctcacggcagctat

SEQ ID NO: 8798 - DNA, 354 bp, Homo sapiens
cacacctacaaataccacaccacacctacacacaaagccttcataaaaataagagccgggccgggcgtggtggctcacacctgtaattccagcactttgggaggccgaggcgggcggatcacctgaggttggcagttcaagaccagcctgatcaacatggagaaaccccgtctctactaaaaatacaaaattggccaggcatggtggcgcatgcctgtagtcccagctactcgggaggctgaggcaggagaatggcatggactcgggaggcggasttgcagtgagccgagattgkgcmaykgmaytcaascctgggtvacagagcgagactccgtcccaaaaaaaaaaaaaaaa

SEQ ID NO: 8799 - DNA, 408 bp, Homo sapiens
agaatcatttcctttaggaatggctaaataagatgtattggactggtttaatgagatattgtgatgagttagtgattttgacaaaaatggctgagtagttcagcatttagatggttggatattaaagatgatataacaacttacaaagaatgggatataactaacccttaccaagtgcttctatttaggaactgagaaggattatattaatcccagctgataggggaaagagtcaaacttcccataaatgcagtctgatacaaagccaggaagaatgttgagatctaatgaattaagatacagtagtgctttctgccatcaaggaaaaaaagcaaccatgattctttctgttaaaagtgacaggaaggccggatgtagtggcctataatcccagcaatttgggaggtg

SEQ ID NO: 8800 - DNA, 295 bp, Homo sapiens
tttttttttctcttaggacagactaattctgaaaataccgaagaaaagtagctctatgttctcaccccggttttcctgcgtgtgtgcccttgggtgcgatgcctcccccagcgctctgtggtcgccggtgccagggccccctctggtttggsaggggcctggctgcctttgctccctgcagtgagtcttttggtgttttcatgcacggcttgtgcttctggatctgaggcctctcgtgttcacgcggacacttccttccttaagaagacgcctaaaagaggaagttggaattttt

SEQ ID NO: 8801 - DNA, 457 bp, Homo sapiens
cagactagcagatatatttcctgggatgtgaagataaattaatgaagaatttgttaattagttcttaatcatttatgcttctaatttataaaggtatttgtggaaactggatgaacagatgcagctcatagagctatgtatttgtggaaactggatgaatagatgcagctcatagagcttgtgactgtaaatggtattgttgatatttcaaaatattgtgaatatataatttttgatgatgtctactttgaaaacttttaaaaccatgttttacattctgttcagatacaccaatagrrttaattagacttttttcgtttcttacagtgtttaacacaaactttgagcacatttcatgtactaattttcagaatagtgtgtcaaggtttctatttaaactatatagataaggaacaggaaacctttggctttggtgtatagtgaattttagaactgr

SEQ ID NO: 8802 - DNA, 83 bp, Homo sapiens
ccggaggcggmsttccagtgagccgagatctgcgctccaacctggggacagagcgagactccctctcaaaaaaaaaaaaaaaa

SEQ ID NO: 8803 - DNA, 158 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtccaaat

SEQ ID NO: 8804 - DNA, 530 bp, Homo sapiens
aaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatgaatgctgaagatgtgttcccatgagttcctgcctccttgtaccccactgagtggaatgttaaaaatacggagaaagaatttaagacctgccagattggatcatgccagtgtttcctatagcctaagattctaccttcaactgtggcagtaagataaattttgtgcaatttctacagatgcagtcccacctctggccatggcaaaattagctggataattctttgaatctggctaatgtggaatcttgcaaggacaaagaggatttgctcacgaactggagctaacttcctcttatagtctatcctctgtggatttgtgagtcacacatttttac

SEQ ID NO: 8805 - DNA, 361 bp, Homo sapiens
atattttctaggagcctacctttacttagcctcacaacatgggccttagctttasacttaatctgcacaaatacctggcttaagtgttatgactgactggctattcaaccaaaccatacaaatgaccaattcggtaagaaagcatgaacttcagtgttgaaccaaatcaaccaacctcctcaatccaaatggagaggataacaaaggaagctgggaagtctgttctggaggcaccatgacaaagcaccagacagaaagcagtcacgtgtggggagatgagcagagacaccacttctcaagcacctgattattctttctcagtatttagaagcaaaaattatccttaagaaaaacaaccgca

SEQ ID NO: 8806 - DNA, 158 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtccaaas

SEQ ID NO: 8807 - DNA, 314 bp, Homo sapiens; identical to SEQ ID NO: 7928

SEQ ID NO: 8808 - DNA, 448 bp, Homo sapiens
agcatttgccatttcactgcaggcatttgagaacataatagaatttctccatatgaatgtgaaacacttcagacaaaagatgaggaaaccgatgtgtccggaattrctgggttcttggtctcactgacttcaagaatgaagccgccgaccctctcggtgacagacatccgcctgcgacaggacatccgcctgcgactcaaaacattcgagagtttttcctggtgaattcagtctcacttcctgccaaagtaaacgagttcctgtgctggccgtcccgcccctccgaatcctcgggagaagcgggactaaaggatcaagctgaagtgaatgtgtagccctgtgacctcagcgcgcgggggcggggcgatcgcggacacccccgccctccccgcctccagcgcgagtgacaacccggtctctggctctggagctgcggcgcggaacaagc

SEQ ID NO: 8809 - DNA, 251 bp, Homo sapiens
  misc_feature 209: n=a, g, c or t
tgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggnttgtattaatttgtattgccccatggctgacaaaagccttty

SEQ ID NO: 8810 - DNA, 181 bp, Homo sapiens
ctggttgggggaattggaggcttctaggaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgt

SEQ ID NO: 8811 - DNA, 207 bp, Homo sapiens
tggatcaaagacctaaatgcaagatctaaaccttgcattagaaaccttcccataagaatatggaggaaggccgggcacagtggctcacacctgtaatgccagcactttgggaggccgaggcgggcggatcacctgaggttaggaattcaagaccagccctgaccaatatggtgaaaccccgtctctactacaaaaaaaaaaaaaaaa

SEQ ID NO: 8812 - DNA, 408 bp, Homo sapiens
tttatgagaaaattttgagcattcagaagaaatctgctagagaagagattgaagatactgaataaaaagagggaatgatttatagaacaatagctaaagatataggaacaaaggagttctagggtaaaaggcagaggcatbaaacaggargraactctgccactgacactagagtgcttgcaaggcttggggtttggggcggggggaaacactagatatattaagattagtttgaatttaatatatgaacttgaattttagtattacaagggattagttttaatttgggaaattgtatccaattttcagaaattctacatttgcattaaagcagcaccaaatttgttttttaaattaaaagcaggctataatgttcatagaaatgtgctatggccgggcacagtggct

SEQ ID NO: 8813 - DNA, 372 bp, Homo sapiens
atattttctaggagcctacctttacttagcctcacaacatgggccttagctttasacttaatctgcacaaatacctggcttaagtgttatgactgactggctattcaaccaaaccatacaaatgaccaattcggtaagaaagcatgaacttcagtgttgaaccaaatcaaccaacctcctcaatccaaatgaacaagtcttctgggcatcagagaaactcaaaaccactgtgtgagcaggtgattgctaagctcaagtgactcttctttttatcagttgctaagtgaaaagtccttaaagagaaatcgatgattctgaacaagcctacggggtacattcactctctttcctgctgatgctatggtctgatga

SEQ ID NO: 8814 - DNA, 495 bp, Homo sapiens
  misc_feature 270..271: n=a, g, c or t
taattagaatgtaatatgataaatgttccaatagaagggtgtcatggtggcatggaaatgcagaagacttaactatttcagaaggttggggaaaagttcacaaaaaagatgacgtttgagctgggcattaaagcaactacaagaagtataaaaaagcctggtaaatccactgtctgaaacattcagtattacaggaatgtaggtgacaggaggtagagcaggaaatgaagctagcagagggcagagccctaagaagtattaaataattwnnaatgtaaagtgctgtgaagggaattacctggatccctgagaagacaaaatgaaagtctaacctcatttgaagctctttggggaagctcctgagcatttcagctaacactgaataggaattaaaaatcactctggaatgagtgagttgagagataggaaataaagttgacaggacatggtgtgatcagaagtgagggattagaagaaaatatcagggatgacttc

SEQ ID NO: 8815 - DNA, 433 bp, Homo sapiens
tttttgttttaaaaaaawwmcctcgtaacggtaaatcagggaatgtttgcgtgcttcagtgactcaaagtatatttcactgaaaatcacgtttttgcctgactgatcacaacatgcgtccatgctttccttatatgttgacaagcactcgtgtaatttctaaatgttctctggtgtcatttcctaagttttaggtaaaagtattacaaaatatgtttgtagttctaaggtcctatggttggagattataaaattctaaatgtagaatctgtagagtagaagttagtggtaattgctccctctggaggctaaaactaaatgggatgtttgactacagtctcttaagtgatttatattcgctgatttgggactattttgaacatatcttggtctaatcattacagaagagaatttgagtttaaaatagcatgata

SEQ ID NO: 8816 - DNA, 471 bp, Homo sapiens
tttttcatatttcactgttgctgaacattgatttagtcttccaaaatggacatcactagtaagtgcactgaatactgaaatacgctgattggcaagcatatatctgtagctagaatttttttaaccgtaattccagaatttaaaaaggtaagagatctgctttttgatagaggccttttaaaaagactatataacatttctatttggctgtttatgtgaatgctcagggaatttggacatgtgttttatacagaagtggctttttatatttcttcaagtgataaattagcattaggacatatcagatagaacaggccagtttcctgatgagattggtagagatgttacggtaggttcatccttcctttttccatgttatatgtggagaagtgttaaacttgctcaagcaaatgggagtaggagataggctgaaaatagagattgctacaccattctattttgttttcatgc

SEQ ID NO: 8817 - DNA, 84 bp, Homo sapiens; identical to SEQ ID NO: 8547

SEQ ID NO: 8818 - DNA, 444 bp, Homo sapiens
  misc_feature 49: n=a, g, c or t
cctgggaaggctgcagagctagagcagcgccgcccgaggggsmaagggnctgaccatagagagcgcgggggcctccagccgagaggaagggagggcagctcgggccgtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccaggaactattaaccacaagaaatacatcaagttttctaaaacaatagagaaggaaatttcac

SEQ ID NO: 8819 - DNA, 472 bp, Homo sapiens
  misc_feature 147,149,313,329,333,359,407..410: n=a, g, c or t
cacaaaagaaagcagtaaaggaggaacaactacaaaaaaaagtgacatagaaaaataccaaaatggccttttaaaatcccaactgtatcaattatgtatatatataatgtgtgtgtatatatatatacacatatatatataaatatnyntbtgagacagagtctcaaaaaaatttattttattttatttattattattattatttcttgagacggagtcttgctctgtcaccagactggagtgcagtggcgcgatcttggctctttgcaacctctgacttcctggttcaagcgattctcctgcctcagcctcncbaagtagctgagatnacankcacgtaccaccacactggctaatknhtgtattttagtagagatggggtttcaccatattggccaggatggkcnnnnattttgtgacctcgtgatccgccctcctcggcctcccaaagtgctgggattacaggcgtgac

SEQ ID NO: 8820 - DNA, 384 bp, Homo sapiens
  misc_feature 169,307: n=a, g, c or t
tttctgtgtcccagtctatttctccatgaaatgggaattaaaatattatttaattcactgagttgctatgaggattgcatgaacaaatctatgtaaagcacttagaaaaacgcttggctcatactaaatgcttaataaatgttaacaaacaagattttattttcaagtncttgttctgttactcaggctggagtgtagtggtgcgatcatagcttacagcagcctcaaactcctgggctcaagtgatcctcccgcctcagcttcccatgtaggcgggactacaggcatgtaccaccaagcccagctnatttttataatcctattgtagagatggggggggggggtctccctakgttgcccaggctggtcttgaactcttgggcy

SEQ ID NO: 8821 - DNA, 410 bp, Homo sapiens
cacatgaaaacgggtggtgaaatgaactatggttttcacttagcccaccacatggcccttggacttctatttttgggaggaggaaggtactctttgagcacatcaaattcttccattgccgctcttctctgtgccctttatccgcacttcccagctcacagcactgacaaccggtatcatctccaggctctccggcacctctatgtgctggccgcggasccaggcttctagtgcctgtggatgkggacamaaacacgccctgctatgcctcttagaagttacctacaagggcactcagtggtatgaacaaaccaaagaagaattgatggctcctacccttcttccagaactccatcttttaaagcagattaaagtaaaaggcccaagatactgggaactgctcatagatt

SEQ ID NO: 8822 - DNA, 419 bp, Homo sapiens
cgcacgagaccatcctttattctgtactttcggacatccaagttgttttcagatttttacttttttaatatgatgcttcagagaacattcctggaagtaatgttgccagtgcagaggtgcaagcatgtttgagacagctgatagttacctctgtccagaactggctcactcccaacagcagcaggaggcacccagggtctctcactttcctttcaattttcctttctccacatcctacccccagatttgtctgacttttccagaggctattgagagaagctttttgagtgaggcaccacacagatgtttaagactaagtttgtggtctttgagaaccgaggtagcctgacccattggaagcctgcagataattgaaaaaatcttattttagatcctgtgtcattcttctgctatcaaac

SEQ ID NO: 8823 - DNA, 477 bp, Homo sapiens
ccaaaatctgtgttctttctgctgcctattttcctctctgaagtggaattttcccctacttaacctcaatgtgaaagcactgggtatccacctccaataccatactctaacttggagtaaattatttgtttatatctctactaaccctccatscctgtgaactcttccagatatatgttggtcatccttgcctcctcaagatccagcaaggaccctggtactttttagatattagtaattataaatataaggttgaagccagtccccaggataaaaaggcagatgctccttaacttggactgatgaagtgggctcctccgtaaccctaaagacctgaccaaaactccttcctcacatctagcgtaagaccacacaaaacaaatttctttcctaggccacagcatcctctaaagctgtgattgatcaagctaactaaatggrhgtggttggccaagataacaaagcataaatcagggt

SEQ ID NO: 8824 - DNA, 95 bp, Homo sapiens
atgggtttgtagtatagattgaagtcaggtaatgtaatgcctccagatttgttctttctgcttagtcttgctttggctatgtgggctcgtttttw

SEQ ID NO: 8825 - DNA, 54 bp, Homo sapiens
carmwwattagccgggcgcggtggcgggtgcctgtagtcccakctactcgggck

SEQ ID NO: 8826 - DNA, 485 bp, Homo sapiens
taaggacatttcataatgctaaaggctaaaattatccagaaaaaaaaatgtagctaaaagccacaataaagataagagtttgaaatatcaaacttttgtatcagctaacccaaaatatctgtgtaccaagtaacacagcaaccaccatcatwaaaaaagaaactatgggattacatttccaagtaataatttcttatctttggccaactctgtgagtagctaagggaattttaaaaagtgttactcagggatgatccaaagaagatacatttggaagcaagataggtggattaagtctgtgctgaataataatttgtcatacctcattataagagatgtggccatggccaggcgtggtggctcacacctttaatcccaacactttgggaggccgaggagggcagatctcttgaagtcaggagtttgaaaccagcctggccaacatggtgaaaacccaattctaataaaaatacaaaaaaattagc

SEQ ID NO: 8827 - DNA, 434 bp, Homo sapiens
  misc_feature 70,227..228: n=a, g, c or t
ctgtacctgagggaggagccaagatggccgaataggaacagctccggtctacagctcccagcgtgasgancgcagaagacgggtgatttctgcatttcaatctgaggtaccgggttcatctcactaggaagtgccagacagtgggcgcaggtcagtggggtgcgcgcaccgtgcgcgagccgaagcagggcgaggcattgcctcacttgggaagcgcaaggggtcanngagttccctttcctagtcaaagaaaggggtgacggacgcacctggaaaatcgggtcactcccacgcgaatactgcgcttttccaaccagcttaaaaaacggcgcaccacgagattatatcgcacctggcttggagggtcctacgcccacggagtctcgctgattgctagcacagcagtctgagatcaaactgcaaggcggcacgar

SEQ ID NO: 8828 - DNA, 487 bp, Homo sapiens
  misc_feature 360: n=a, g, c or t
cagaaaaaaattatatgtatattgcaataactaggattatccagagaaaaagagccaacaagctatatatagagaaaaatttattttaaggaattggctcacacgatggaggcttggagagttgaaagtctgatggggtaggscccatgttkggagactgcactttgagtcttcatcttgagggaagagctgcagtttgagtcttgaggcagtcttgtggtagaatttcttcttactcaagggaggtcagtctttttttctattaagaccttcagctgattggatgagttccacctacattatgaagagtaatctgctttactaaaagtccaccaatctaaatgttgatttcatctaatnracaccttcacaaaaagatccagaatatttgagaaaatatctgggcatcgtggsccagccaagctgacacataaaatttactaccatatatgcatatgtatatacagtatacatgtatatatacatg

SEQ ID NO: 8829 - DNA, 342 bp, Homo sapiens
acaacaatgcacgctgccggcgctacagcccctaagcaaccggccggaagtcggccccacctcctcctgatgtcacggaaatgaagggcttcgcagaggatgtcccgcccgctcccttcagacgggcgtastggcaccttcctgagatatgcctgcttgcccccgatttttttctccttgcagtgagaacctcctcmtgtggcatctttacttattctcttcttggaaaatccatgtgacctccccgcgcttaaagtgtttccacgttacaggcgacttaaaggcagccctggagcctgacgtataattcgagcgccgatgcagaaaggagtcaggtgttty

SEQ ID NO: 8830 - DNA, 544 bp, Homo sapiens
actgggtttcggcgtctggcaagcggttcagctgtctgctccctagcagccggccttcgggtcgggcgtctccgccggctactgccgcttcagttctcccggtgtggccacgagtcggcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatct

SEQ ID NO: 8831 - DNA, 74 bp, Homo sapiens
aaaaaaaactttaaacarattraaataaaacagaaaaktaaatktttttaaaaacttccttaaataacttatts

SEQ ID NO: 8832 - DNA, 96 bp, Homo sapiens
  misc_feature 62: n=a, g, c or t
acagttaactttaggaccatagccaaaagatagaaacagcataaacgccaaaataaaaagdngccaataaagataaacacaaaaaaaaaaaaaaaa

SEQ ID NO: 8833 - DNA, 103 bp, Homo sapiens; identical to SEQ ID NO: 8028

SEQ ID NO: 8834 - DNA, 103 bp, Homo sapiens; identical to SEQ ID NO: 8028

SEQ ID NO: 8835 - DNA, 57 bp, Homo sapiens
acagttaactttaggaccatagccaaaagatagaaacagcataaacgccaaaataaa

SEQ ID NO: 8836 - DNA, 103 bp, Homo sapiens; identical to SEQ ID NO: 8028

SEQ ID NO: 8837 - DNA, 58 bp, Homo sapiens; identical to SEQ ID NO: 8023

SEQ ID NO: 8838 - DNA, 361 bp, Homo sapiens
  misc_feature 106: n=a, g, c or t
caaacagaattaccagataagccaaaaatactgcttctaggtatacgccctaaagaactaaaaacaggtgttcaaataaaaactcgtatacaaatgtttatagcancattatttataatagctaaaaagtgggaaaaaaacaattgaccatcaatggatagatggataatgatattattcaatcataaaaaagaatttaagtggccgggcacagtggctcatgcctgtaatcccagctacgtgggaggctgaggcaggagaatcacttgaacctgggaggtggaggttgcagtgaactgagattgcgccactccactccagcctgggsaacagagactcggtgtcaaaaaaaaaaaaaaaa

SEQ ID NO: 8839 - DNA, 76 bp, Homo sapiens; identical to SEQ ID NO: 8121

SEQ ID NO: 8840 - DNA, 71 bp, Homo sapiens
aataatagctactaaaaagtaacaaggttgagaccagcctgggcaacataaaggagacccttcttcacaaa

SEQ ID NO: 8841 - DNA, 475 bp, Homo sapiens
gagcacggtggagcggtggagggcgtcactgggtttcggcgtctggcaagcggttcagctgtctgctccctagcagccggccttcgggtcgggcgtctccgcggctactgccgcttcagttctcccggtgtggccacgagtcgggttcttgctctgtcacctaagctggagtgcagtagggtgatcgtaactcacggaagcctcaaactcaagtgatcctcccacctcagcctcctgagtagctaggacgacagtacatagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggag

SEQ ID NO: 8842 - DNA, 76 bp, Homo sapiens; identical to SEQ ID NO: 8121

SEQ ID NO: 8843 - DNA, 130 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaaaaaaaaaaaaaaar

SEQ ID NO: 8844 - DNA, 103 bp, Homo sapiens; identical to SEQ ID NO: 8028

SEQ ID NO: 8845 - DNA, 133 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaaaaaaaaaaaaaaaaaar

SEQ ID NO: 8846 - DNA, 103 bp, Homo sapiens; identical to SEQ ID NO: 8028

SEQ ID NO: 8847 - DNA, 362 bp, Homo sapiens
  misc_feature 106: n=a, g, c or t
caaacagaattaccagataagccaaaaatactgcttctaggtatacgccctaaagaactaaaaacaggtgttcaaataaaaactcgtatacaaatgtttatagcancattatttataatagctaaaaagtgggaaaaaaacaattgaccatcaawtggatagatggataaatgatattattcaatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8848 - DNA, 103 bp, Homo sapiens; identical to SEQ ID NO: 8028

SEQ ID NO: 8849 - DNA, 73 bp, Homo sapiens
aaaaaaaactttaaacagattgaaataaaacagaaaagtaaatgtttttaaaaacttccttaaataacttatt

SEQ ID NO: 8850 - DNA, 103 bp, Homo sapiens; identical to SEQ ID NO: 8028

SEQ ID NO: 8851 - DNA, 83 bp, Homo sapiens
  misc_feature 61..62: n=a, g, c or t
acagttaactttaggaccatagccaaaagatagaaacagcataaacgccaaaataaaaagnngccaataaagataaacacaar

SEQ ID NO: 8852 - DNA, 103 bp, Homo sapiens; identical to SEQ ID NO: 8028

SEQ ID NO: 8853 - DNA, 96 bp, Homo sapiens
acagttaactttaggaccatagccaaaagatagaaacagcataaacgccaaaataaaaagwhgccaataaagataaacacaaaaaaaaaaaaaaaa

SEQ ID NO: 8854 - DNA, 85 bp, Homo sapiens
  misc_feature 62: n=a, g, c or t
acagttaactttaggaccatagccaaaagatagaaacagcataaacgccaaaataaaaagdngccaataaagataaacacaaaaa

SEQ ID NO: 8855 - DNA, 103 bp, Homo sapiens; identical to SEQ ID NO: 8028

SEQ ID NO: 8856 - DNA, 103 bp, Homo sapiens; identical to SEQ ID NO: 8028

SEQ ID NO: 8857 - DNA, 103 bp, Homo sapiens; identical to SEQ ID NO: 8028

SEQ ID NO: 8858 - DNA, 84 bp, Homo sapiens; identical to SEQ ID NO: 8594

SEQ ID NO: 8859 - DNA, 95 bp, Homo sapiens
gaggttgasacaagagaatcacttgaacctgagaggcagaggttgcagtgcagcctgggtgacagagggagactccggccccctcccaaaaaaam

SEQ ID NO: 8860 - DNA, 58 bp, Homo sapiens; identical to SEQ ID NO: 8023

SEQ ID NO: 8861 - DNA, 96 bp, Homo sapiens
acagttaactttaggaccatagccaaaagatagaaacagcataaacgccaaaataaaaagargccaataaagataaacacaaaaaaaaaaaaaaaa

SEQ ID NO: 8862 - DNA, 379 bp, Homo sapiens
actgggtttcggcgtctggcaagcggttcagctgtctgctccctagcagccggccttcgggtcgggcgtctccgccggctactgcgcttcagttctcccggtgtggccacgagtcggcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatccttttgaatg

SEQ ID NO: 8863 - DNA, 149 bp, Homo sapiens
tttctttttacattgtgcctttatcastttatggtatcagggtgatactagcttcatagtatgagttaggcaggagcccatcctcctccattttttgaaatagtttcaatagaaaaaaaaaaaaaaaaaaaaaaaaaaaaaaaaaaaaa

SEQ ID NO: 8864 - DNA, 103 bp, Homo sapiens; identical to SEQ ID NO: 8028

SEQ ID NO: 8865 - DNA, 103 bp, Homo sapiens; identical to SEQ ID NO: 8028

SEQ ID NO: 8866 - DNA, 58 bp, Homo sapiens; identical to SEQ ID NO: 8023

SEQ ID NO: 8867 - DNA, 71 bp, Homo sapiens
aataatagctactaaaaagtaacaaggttgagaccagcctgggcaacataaggagaccccttcttcacaaa

SEQ ID NO: 8868 - DNA, 103 bp, Homo sapiens; identical to SEQ ID NO: 8028

SEQ ID NO: 8869 - DNA, 164 bp, Homo sapiens; identical to SEQ ID NO: 8086

SEQ ID NO: 8870 - DNA, 103 bp, Homo sapiens; identical to SEQ ID NO: 8028

SEQ ID NO: 8871 - DNA, 89 bp, Homo sapiens
gaggttgagacaagagaatcacttgaacctgagaggcagaggttgcagtgcagcctgggtgacagagggagactccggccccctcccar

SEQ ID NO: 8872 - DNA, 381 bp, Homo sapiens
tgtctgatttctttcactggtattttgtagttctcctcatagagatagttcacaaccttggttagacatactcctagtcattttttggggggtgtggctatttttaataggattgcattcttgatgatgtgtttctcagcttgaacattattggcgtttaagagtactgctgactgggccgggcacggtggctcacgcctgtaatcccagcgctttgggaggccaaggcgggcggatcacctgaggtcgggagttcgggagcagcctgaccaacatggagaaacccagtctctattaaaaatgcaaaattagccgggcgtggtggtgcgtgcctgtagtcccggctacttaggagggctggggcgggagaattgcttgagc

SEQ ID NO: 8873 - DNA, 482 bp, Homo sapiens
actgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttagcacactgaagaatgcaacgtcttgattaacttgcttaaggaatgtcacaaaaatgttcttgctctgtcacctaagctggagtgcagtagggtgatcgtaactcacggaagcctcaaactcaagtgatcctcccacctcagcctcctgagtagctgggacgacagtacatagaaaacaggaccaagagcagggagcatggcattgcaatgcgaaagaaactttttaatcctccagaggaatccgaaaaataaattgtattttcactcgatgccttggctgagagaagacctaaagactctgg

SEQ ID NO: 8874 - DNA, 103 bp, Homo sapiens; identical to SEQ ID NO: 8028

SEQ ID NO: 8875 - DNA, 103 bp, Homo sapiens; identical to SEQ ID NO: 8028

SEQ ID NO: 8876 - DNA, 95 bp, Homo sapiens
gaggttgagacaagagaatcacttgaacctgagargcagaggttgcagtgcagcctgggtgacaragggagactccggccccctcccaaaaaaaa

SEQ ID NO: 8877 - DNA, 95 bp, Homo sapiens
gaggttgagacaagagaatcacttgaacctgagaggcagaggttgcagtgcagcctgggtgacagagggagactccggccccctcccaaaaaaaa

SEQ ID NO: 8878 - DNA, 103 bp, Homo sapiens; identical to SEQ ID NO: 8028

SEQ ID NO: 8879 - DNA, 94 bp, Homo sapiens
gaggttgagacaagagaatcacttgaacctgagaggcagaggttgcagtgcagcctgggtgacagagggagactccggccccctcccaaaaaar

SEQ ID NO: 8880 - DNA, 96 bp, Homo sapiens
  misc_feature 62: n=a, g, c or t
acagttaactttaggaccatagccaaaagatagaaacagcataaacgccaaaataaaaagmngccaataaagataaacacaaaaaaaaaaaaaaaa

SEQ ID NO: 8881 - DNA, 149 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaac

SEQ ID NO: 8882 - DNA, 96 bp, Homo sapiens; identical to SEQ ID NO: 8880
  misc_feature 62: n=a, g, c or t

SEQ ID NO: 8883 - DNA, 95 bp, Homo sapiens; identical to SEQ ID NO: 8877

SEQ ID NO: 8884 - DNA, 208 bp, Homo sapiens
cctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgaaaaaaaaaaaaaaaaaag

SEQ ID NO: 8885 - DNA, 442 bp, Homo sapiens
ctcccgagtagctggaactacaggcgcccgccatgatgcccggctgattttctgtgttttcagtagagacggggtttcactgtgttagccaggaaagtcttgatctcctgacctcgtgatcctgacctcggcctcccaaagtgctgggattacaggcgcgasaccgcgcccgacagcagttatgaagttctaaaagcaagtcttaatcaggaagtgtccttgatcaccaacggctcgcccaggcatgctggctctcttccacttccaccttccaccatgggatgacgcataagaaggccatcagtagatgccagtccctcaaccttgaactttccagacgcagaactggtttcatcccaggagcacttcttttcagcacactaagatttggaatccagcagaagattgtcctacattgattatcttctctacatccttgagg

SEQ ID NO: 8886 - DNA, 148 bp, Homo sapiens
cctgtaatcccagctacccaggaggctgaggcaggagaatcgctggaacccgggaggtagaggctgcagtgagccgagatcgcgccactgcactccagcctgggcgacagagcgagagtttgtctgaaaaaaaaaaaaaaaaaaaaav

SEQ ID NO: 8887 - DNA, 103 bp, Homo sapiens; identical to SEQ ID NO: 8028

SEQ ID NO: 8888 - DNA, 58 bp, Homo sapiens; identical to SEQ ID NO: 8023

SEQ ID NO: 8889 - DNA, 103 bp, Homo sapiens; identical to SEQ ID NO: 8028

SEQ ID NO: 8890 - DNA, 361 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcvatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8891 - DNA, 77 bp, Homo sapiens
mtttttycscaacgggtttgccgccagaacacaggtgtcgtgaaaactacccctaaaagccaaaaaaaaaaaaaaaa

SEQ ID NO: 8892 - DNA, 103 bp, Homo sapiens; identical to SEQ ID NO: 8028

SEQ ID NO: 8893 - DNA, 188 bp, Homo sapiens
ttaagcatgttaacaaaaatagcaaaatatgaaaataagctgggcatggtggcacacgcctgtaatcccaactactcgggaggctgaggcatgagaatcacttgaacccaggaagcagaggttgcagtgagccgagatcatgccgccgcactccagcctgggcaacagggcgagactctgtctcaaaa

SEQ ID NO: 8894 - DNA, 103 bp, Homo sapiens; identical to SEQ ID NO: 8028

SEQ ID NO: 8895 - DNA, 96 bp, Homo sapiens
  misc_feature 62: n=a, g, c or t
acagttaactttaggaccatagccaaaagatagaaacagcataaacgccaaaataaaaagwngccaataaagataaacacaaaaaaaaaaaaaaaa

SEQ ID NO: 8896 - DNA, 58 bp, Homo sapiens; identical to SEQ ID NO: 8023

SEQ ID NO: 8897 - DNA, 58 bp, Homo sapiens; identical to SEQ ID NO: 8023

SEQ ID NO: 8898 - DNA, 103 bp, Homo sapiens; identical to SEQ ID NO: 8028

SEQ ID NO: 8899 - DNA, 150 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaaca

SEQ ID NO: 8900 - DNA, 128 bp, Homo sapiens
cttctccccggcrgttartsctgagartscgrartgtrtrctccgsrctcgraacacacatttattattaaaaaatccaaaaaaaatctaaaaaaatcttttaaaaaaccccaaaaaaaaaaaaaaaa

SEQ ID NO: 8901 - DNA, 103 bp, Homo sapiens
gaggttgagacaagagaatcacttgaacctgagaggcagaggttgcagtgcagcctgggymmcagagggagactccggccccctcccaaaaaaaaaaaaaaaa

SEQ ID NO: 8902 - DNA, 84 bp, Homo sapiens; identical to SEQ ID NO: 8594

SEQ ID NO: 8903 - DNA, 89 bp, Homo sapiens
gaggttgagacaagagaatcacttgaacctgagaggcagaggttgcagtgcagcctgggtgacagagggagactccggccccctcccaa

SEQ ID NO: 8904 - DNA, 89 bp, Homo sapiens; identical to SEQ ID NO: 8903

SEQ ID NO: 8905 - DNA, 212 bp, Homo sapiens
aaatgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgctcaaaaaaaaaaaaaaaaa

SEQ ID NO: 8906 - DNA, 96 bp, Homo sapiens; identical to SEQ ID NO: 8880
  misc_feature 62: n=a, g, c or t

SEQ ID NO: 8907 - DNA, 95 bp, Homo sapiens; identical to SEQ ID NO: 8877

SEQ ID NO: 8908 - DNA, 413 bp, Homo sapiens
  misc_feature 262..263: n=a, g, c or t
aacctaatcaagcctgggcaatggcgggcgcccctcccgcagcctcgctgccgccttgcaggttgatctcagactgctgtgctagcaatcagtgagactccgtgggcgtaggactctccaagccagtgagatgaactcggtasctcagatggaaatgcagaaatcaccgtcttctccatcgctcacgctgggagctgtagaccggagctgttcctattcggccatctttgctcctccctgcaactaactccattcttavwsnnwtctcactctgtcacctaggctggagtgcagtggcgtgatggcgtgatctcggctcattgcaacctctgcctcccaggctcaagcagtcctcccacctcagcctcccaggtagctgggactacacgtgcgtgccacacgtggtgtctcac

SEQ ID NO: 8909 - DNA, 58 bp, Homo sapiens; identical to SEQ ID NO: 8023

SEQ ID NO: 8910 - DNA, 58 bp, Homo sapiens; identical to SEQ ID NO: 8023

SEQ ID NO: 8911 - DNA, 103 bp, Homo sapiens; identical to SEQ ID NO: 8028

SEQ ID NO: 8912 - DNA, 103 bp, Homo sapiens; identical to SEQ ID NO: 8028

SEQ ID NO: 8913 - DNA, 103 bp, Homo sapiens; identical to SEQ ID NO: 8028

SEQ ID NO: 8914 - DNA, 104 bp, Homo sapiens
cattggtagcttgatggggatggcattgaatctgtaaattaccttgggcagtatggccattttcacgatattgattcttcctacccgccgcaaaaaaaaaaaaa

SEQ ID NO: 8915 - DNA, 58 bp, Homo sapiens; identical to SEQ ID NO: 8023

SEQ ID NO: 8916 - DNA, 103 bp, Homo sapiens; identical to SEQ ID NO: 8028

SEQ ID NO: 8917 - DNA, 103 bp, Homo sapiens; identical to SEQ ID NO: 8028

SEQ ID NO: 8918 - DNA, 103 bp, Homo sapiens
gaggttgagacaagakaatcacttgaacctgakakgcagaggttgmagtgyagcctgggtgacaragggagactccggccccctcccaaaaaaaaaaaaaaaa

SEQ ID NO: 8919 - DNA, 95 bp, Homo sapiens; identical to SEQ ID NO: 8877

SEQ ID NO: 8920 - DNA, 96 bp, Homo sapiens
acagttaactttaggaccatagccaaaagatagaaacagcataaacgccaaaataaaaakwhgccaataaagataaacacaaaaaaaaaaaaaaaa

SEQ ID NO: 8921 - DNA, 58 bp, Homo sapiens; identical to SEQ ID NO: 8023

SEQ ID NO: 8922 - DNA, 73 bp, Homo sapiens; identical to SEQ ID NO: 8609

SEQ ID NO: 8923 - DNA, 96 bp, Homo sapiens
acagttaactttaggaccatagccaaaagatagaaacagcataaacgccaaaataaaaagwmgccaataaagataaacacaaaaaaaaaaaaaaaa

SEQ ID NO: 8924 - DNA, 96 bp, Homo sapiens; identical to SEQ ID NO: 8923

SEQ ID NO: 8925 - DNA, 84 bp, Homo sapiens; identical to SEQ ID NO: 8594

SEQ ID NO: 8926 - DNA, 103 bp, Homo sapiens; identical to SEQ ID NO: 8028

SEQ ID NO: 8927 - DNA, 353 bp, Homo sapiens
cacacctacaaataccacaccacacctacacacaaagccttcataaaaataagagccgggccgggcgtggtggctcacacctgtaattccagcactttgggaggccgaggcgggcggatcacctgaggttggcagttcaagaccagcctgatcaacatggagaaaccccgtctctactaaaaatacaaaattggccaggcatggtggcgcatgctgtagtcccagctactcgggaggctgaggcaggagaatggcatggactcgggaggcggacttgcagtgagccgagattgtgccactgcactccagcctgggtgacagagcgagactccgtcccaaaaaaaaaaaaaaaa

SEQ ID NO: 8928 - DNA, 164 bp, Homo sapiens
ctggacaaatgacttgaatagacagttctccagagaagatatgcaaatggctcaacattattaatcattagggaacattgttaataattagtggtatctccacagtgagatatcacttcttacccattaggatggmtrtaataaaaaacaaaaaaaaaaaaaaa

SEQ ID NO: 8929 - DNA, 76 bp, Homo sapiens
cttytycgcaacgggtwtgccgccagaacacaggtgtcgtgammactacccctaaaagccaaaaaaaaaaaaaaaa

SEQ ID NO: 8930 - DNA, 361 bp, Homo sapiens
  misc_feature 106,230: n=a, g, c or t
caaacagaattaccagataagccaaaaatactgcttctaggtatacgccctaaagaactaaaaacaggtgttcaaataaaaactcgtatacaaatgtttatagcancattatttataatagctaaaaagtgggaaaaaaacaattgaccatcaatggatagatggataaatgatattattcaatcataaaaaagaattaagtggccgggmacagtggctcatgcctgtantvccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8931 - DNA, 103 bp, Homo sapiens; identical to SEQ ID NO: 8028

SEQ ID NO: 8932 - DNA, 104 bp, Homo sapiens
agaggttgagacaagagaatcacttgaacctgagaggcagaggttgcagtgcagcctgggtgacagagggagactccggccccctcccaaaaaaaaaaaaaaaa

SEQ ID NO: 8933 - DNA, 83 bp, Homo sapiens
  misc_feature 62: n=a, g, c or t
acagttaactttaggaccatagccaaaagatagaracagcataaacgccaaaataaaaagdngccaataaagataaacacaar

SEQ ID NO: 8934 - DNA, 239 bp, Homo sapiens
attgaaaaaaatcaaagatcatctaaataagttgaaagacaatgttcatggatcagaatacttaatattgttaagatggcaatactctcaaactgctctacagattcaatatgatttccatcaaaatctcagctagctttttagtagaaattgacagcagatcttacaatgtatatagaaatgcaagggatagccaaaaacctaaaatagccaaaaacaatctcaaaaaaaaaaaaaaa

SEQ ID NO: 8935 - DNA, 132 bp, Homo sapiens
maaggccaggmtggtctcgaactccttacctcaggtgatcsrcccatatwggcctcccaaagtgctgarattacaggtgtgagccaccatgcctggcctcaatcwtttcttttaaacaattattcctatatt

SEQ ID NO: 8936 - DNA, 103 bp, Homo sapiens; identical to SEQ ID NO: 8028

SEQ ID NO: 8937 - DNA, 362 bp, Homo sapiens
  misc_feature 106,233: n=a, g, c or t
caaacagaattaccagataagccaaaaatactgcttctaggtatacgccctaaagaactaaaaacaggtgttcaaataaaaactcgtatacaaatgtttatagcancattatttataatagctaaaaagtgggaaaaaaacaattgacccatcaatggatagatggataaatgatattattcaatcataaaaaagaattaagtggccgggcacagtggctcatgcctgtaatnmcagctacgtgggaggctgaggcaggagaatcacttgaacctgggaggtggaggttgcagtgaactgagattgcgccactscactccagcctgggcaacagagactcggtgtcaaaaaaaaaaaaaaaa

SEQ ID NO: 8938 - DNA, 103 bp, Homo sapiens; identical to SEQ ID NO: 8028

SEQ ID NO: 8939 - DNA, 103 bp, Homo sapiens; identical to SEQ ID NO: 8028

SEQ ID NO: 8940 - DNA, 96 bp, Homo sapiens
acagttaactttaggaccatagcmaaaagatagaaacagcataaacgccaaaataaaaagawgccaataaagataaacacaaaaaaaaaaaaaaaa

SEQ ID NO: 8941 - DNA, 76 bp, Homo sapiens
cytwttcgcaacgggtttgccgccagaacacaggwgtcgtgaaaactacccctaaaagccaaaaaaaaaaaaaaaa

SEQ ID NO: 8942 - DNA, 149 bp, Homo sapiens
tttctttttacattgtscctttatcagtttatggtatcarggtgatactagcttcatagtatgagttaggcaggagcccatcctcctccattttttgaaatagtttcaatagaaaaaaaaaaaaaaaaaaaaaaaaaaaaaaaaaaaay

SEQ ID NO: 8943 - DNA, 76 bp, Homo sapiens
ctttttcgcaacgggtttgccgcmagaacacaggtgtcgtgaaaactacccctaaaagccaaaaaaaaaaaaaaaa

SEQ ID NO: 8944 - DNA, 103 bp, Homo sapiens
gaggttgagacaagagaatcactwraacctgagaggcagaggttgcagtgcagcctgggwgacagagggagactccggccccctcccaaaaaaaaaaaaaaaa

SEQ ID NO: 8945 - DNA, 76 bp, Homo sapiens
cttttwcgcaacgggkttgccgccagaacacaggwgtcgtgaaaactacccctaaaagccaaaaaaaaaaaaaaaa

SEQ ID NO: 8946 - DNA, 392 bp, Homo sapiens
tawcaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgchatggcttcatggcattcactgattagtggtaatggtaaamactggtgtgttttgaagttgaatgtgcgataaaattattagccttaagattggtaagctagcaatgaatgctagggtgggaar

SEQ ID NO: 8947 - DNA, 138 bp, Homo sapiens
ctggacaaatgacttgaatagacagttctccawagaagatatgcaaatggctcaacattattaatcattagggaacattgttaataattagtggtatctccacagtgagatatcacttcttacccattaggatggctv

SEQ ID NO: 8948 - DNA, 65 bp, Homo sapiens
gaggttgagacaagagaatcacttgaacctgagaggcagaggttgcagtgcagcctgggtgacar

SEQ ID NO: 8949 - DNA, 96 bp, Homo sapiens; identical to SEQ ID NO: 8861

SEQ ID NO: 8950 - DNA, 95 bp, Homo sapiens
gaggttgagacaagagaatcacttgaacctgagaggcagaggttgcagtgcagcctgggwgacagagggagactccggccccctcccaaaaaaar

SEQ ID NO: 8951 - DNA, 88 bp, Homo sapiens
gaggttgagacaagagaatcacktgaacctgagaggcagaggwtgcagtgcagcctggghgacagagggagactccggccccctcccw

SEQ ID NO: 8952 - DNA, 152 bp, Homo sapiens
ctggacaaatgacttgaatagacagttctccawagaagatatgcaaatggctcaacattattaatcattagggaacattgttaataattagtggtatctccacagtgagatatcacttcttacccattaggatggctataataaaaaacaaa

SEQ ID NO: 8953 - DNA, 85 bp, Homo sapiens
  misc_feature 62: n=a, g, c or t
acagttaactttaggaccatagccaaaagatagaaacagcataaacgccaaaataaaaagmngccaataaagataaacacaaaaw

SEQ ID NO: 8954 - DNA, 96 bp, Homo sapiens; identical to SEQ ID NO: 8880
  misc_feature 62: n=a, g, c or t

SEQ ID NO: 8955 - DNA, 445 bp, Homo sapiens
attgaagtttttaggcagtggaaagtttggggctcttatgaataaggctgtcatgaacatttttgtataaatcttcatgtagacaaacgtttacatttttcttggaaacaagatcgcactatgttccccaggatggtctcaaactggactcaagcaaccctgmctcagccttccaaagtgctgtgattacagagagcttgcctcaggatgctgaagtgtggtttacctacacaggagatgcaaaattacttggaaatttgcacttcattggaggcaacccagaaggaatgactgattagtgtgaaggcgtaaatactctagtcccactaccactgacaaggacaactgcggcatttcccctggctttttgccatgggtggaagctccctgaggtcctcacgagaagtagatgctggcaccatgcgtcttgaacagcctgcagaaa

SEQ ID NO: 8956 - DNA, 96 bp, Homo sapiens; identical to SEQ ID NO: 8880
  misc_feature 62: n=a, g, c or t

SEQ ID NO: 8957 - DNA, 95 bp, Homo sapiens
gaggttgagacaagagaatcacttgaacctgagaggcagaggttgcagtgcagcctgggtgacagagggagactccggccccctcccaaaaaaar

SEQ ID NO: 8958 - DNA, 103 bp, Homo sapiens; identical to SEQ ID NO: 8028

SEQ ID NO: 8959 - DNA, 95 bp, Homo sapiens; identical to SEQ ID NO: 8877

SEQ ID NO: 8960 - DNA, 104 bp, Homo sapiens
aaaggttrarmcaagagaatcacttgaacctgagaggcagaggttgcagtgcagcctgggtgacagagggagactccggccccctcccaaaaaaaaaaaaaaaa

SEQ ID NO: 8961 - DNA, 89 bp, Homo sapiens
gaggttgagacaagagaatcacttgaacctgagaggcagaggttgcagtgcagcctgggtgacagagggagactccggccccctcccam

SEQ ID NO: 8962 - DNA, 90 bp, Homo sapiens
gagggttgagacaagagaatcacttgaacctgagaggcagaggttgcagtgcagcctgggtgacagagggagactccggccccctcccaa

SEQ ID NO: 8963 - DNA, 103 bp, Homo sapiens
gaggttgagacaagagaatcacttgaacctgagaggcagaggttgcagtgcagcctgggtgacagagggagactccggccccctcccaraaaaaaaaaaaaaa

SEQ ID NO: 8964 - DNA, 103 bp, Homo sapiens; identical to SEQ ID NO: 8028

SEQ ID NO: 8965 - DNA, 114 bp, Homo sapiens
tttctttttacattgtgcctttatcagtttatggtatcagggtgatactagcttcatagtatgagttaggcaggagcccatcctcctccattttttgaaatagtttcaatagar

SEQ ID NO: 8966 - DNA, 256 bp, Homo sapiens
gctgggactgcaggcatccgccatcacgcctggctaattttkttgtactttattggagatcctggccaacatggagaaaccccgtctctacaaaaatacaaagattagccagccgtgatggcgggcrccggtagtcctagctactggggagactgaggcgggaaaatcggttgaamccagtggtggagattgtagtgagccaagatcgtgccactgcaatccavvytggcgacaatgctagactccgtctcaaaar

SEQ ID NO: 8967 - DNA, 103 bp, Homo sapiens; identical to SEQ ID NO: 8028

SEQ ID NO: 8968 - DNA, 103 bp, Homo sapiens; identical to SEQ ID NO: 8028

SEQ ID NO: 8969 - DNA, 89 bp, Homo sapiens
gaggttgagacaagagaatcacttgaacctgagaggcagaggttgcagtgcagcctgggkgacagagggagactccggccccctcccam

SEQ ID NO: 8970 - DNA, 103 bp, Homo sapiens; identical to SEQ ID NO: 8028

SEQ ID NO: 8971 - DNA, 152 bp, Homo sapiens; identical to SEQ ID NO: 8665

SEQ ID NO: 8972 - DNA, 164 bp, Homo sapiens; identical to SEQ ID NO: 8086

SEQ ID NO: 8973 - DNA, 94 bp, Homo sapiens
gaggttgagacaagagaatcacttgaacctgagaggcagaggttgcagtgcagcctgggtgacagagggagactccggccccctcccaaaaaaa

SEQ ID NO: 8974 - DNA, 103 bp, Homo sapiens; identical to SEQ ID NO: 8028

SEQ ID NO: 8975 - DNA, 103 bp, Homo sapiens; identical to SEQ ID NO: 8028

SEQ ID NO: 8976 - DNA, 399 bp, Homo sapiens
rmraymcwakgakwaramtraywgmytrgskkswrakmswmkkrrrrrrawmwwksmcwmkkskswwrswgmmtkrmkgrgaaswagymswmtymtrrwryyryrkkactkwraagmwgkagwawmayakmwymawrrtamkywammkskrsmrrrrawyawmyymmarrtmwgmrascyrgaymasagmyywmmyymmrrkwmysagwsmmrkwtrrcasyscwssycmwgakmmmywktsrwsywyssyrctkyrrscccwsmscywktyyrswycascyysyktkrasccmmcccmkwrkmmammymmkmtyckktsamryyrscysakwrrwrmwccaywmktcswwmmcwttggctgattgatgctccatacgtccaaaccttccagtcctcaa

SEQ ID NO: 8977 - DNA, 96 bp, Homo sapiens
gaggttgagacaagagaatcacttgaacctgagaggcagaggttgcagtgcagcctgggtgacagagggagactccggccccctcccaaaaaaaar

SEQ ID NO: 8978 - DNA, 103 bp, Homo sapiens; identical to SEQ ID NO: 8028

SEQ ID NO: 8979 - DNA, 96 bp, Homo sapiens
  misc_feature 61..62: n=a, g, c or t
acagttaactttaggaccatagccaaaagatagaaacagcataaacgccaaaataaaaagnngccaataaagataaacacaaaaaaaaaaaaaaaa

SEQ ID NO: 8980 - DNA, 103 bp, Homo sapiens
gaggttgagacaagakaatcacttgaacctgagaggcagaggttgcagtgcagcctgggtkacagagggagactccggccccctcccaaaaaaaaaaaaaaaa

SEQ ID NO: 8981 - DNA, 92 bp, Homo sapiens
gaggttgagacaagagartcacttgaacctgagaggcagaggttgcagtgcagcctgggtgacagagggagactccggccccctcccaaaaa

SEQ ID NO: 8982 - DNA, 372 bp, Homo sapiens
attaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcagggcccaaaagaaagaggtcatcgaggatcagaacatctgaacagttacgaagcagaatgggacatggttaatacagtttcatttaaaaggaaaccacataccaatggagatctcc

SEQ ID NO: 8983 - DNA, 430 bp, Homo sapiens
cattaattgagtaaaagttataaatagtattatgataacaagagagttaaagaggattgttttcattggagtccagttgcattcaagagagtcattttctctttataggagatgcaggttgattgaagtctaggtctatggagaagggggratgtggaaaagcaaaaaatatgcaaacattttgattggctttacattttattttatgtcagaatcataagtatatatattctctgtactacttgcctttgtggggtaggggctggagatggggtgagcattgctcaatcaaacccawgccctcatcaccatgtgctactgcacccatgaaagtacacagagattttaaaggggaagcaaacattgattgggaggagaaaatatcacagcagaaaaaagttctagaatacattatcatttttcctggggc

SEQ ID NO: 8984 - DNA, 418 bp, Homo sapiens
ttgtaggatagtttttggtttttgtttaagggatagattatatacacaagattgcacatacataagagtgttgagatagaacttgtattttagagatggggtctcactgtgttgcccaggctgttcttaaacttctgggcttggccaggcgcagtggcccacgcctgtaatcccagcactttgggagaccgaggcgggtggatcacctgagctcaggagttcgagaccagcctggccaacgtggtgaaaccccatctctactaaaaatacaaaaattagctggagggggtggtggtgggcacctgtaatcccagctacttgggaggctgaggcgggagaatcgcctgaacctgggaggcagaggttgcagtgaaccgagccattggactccagcctaggcaacaagattgaaactgtc

SEQ ID NO: 8985 - DNA, 482 bp, Homo sapiens
  misc_feature 221..222: n=a, g, c or t
mcagtttcgcgagtactatcagacttgtcttcctgggtattactcgggtcaatgcctgasaccccagcmcccctcatgccccacaccacacccccagggcatcaagaaccaggctgagccccagggatacaacagccagctcagttcctgccctcagactatagaggctggtgggmctatgggcattaaaaagtaattgcgaccgggtgcagtggctcacnnctgtaatcccagcactttgggaggctgaggtagctgaattacctgaattacttgagcccaggggttgaagaccagcctgggcaacacggtaaaaccccgtctctacaaaagatacaaaagttagctgggcatggtggcgttcgctgtagtcccagctgctcaggaggctgcggtgggtggatcacctgagcccaggagatcaaggctgcagtgagccaagatcacgccactgcacttcagcctgggtgacagagtgggac

SEQ ID NO: 8986 - DNA, 323 bp, Homo sapiens
  misc_feature 108,114,323: n=a, g, c or t
acaacacaatgattagactgacagcttggcttgagatcctaggagaaaaataattgactaggggctaagagacttgaggggaactagcccacttctgatgctgcatrnctgadnagaagtagtatcatagaatcatggtactttaaagctggagagaaacatctcaaaaataagcaacctggaccagagattaractccaggtctgagagccagataacagccctcctcaagataaccagtcaagtttggcactgcaggccctgagccattttggtccaccctgctttgaccccaccccttgtccacatcagctcctgtgaan

SEQ ID NO: 8987 - DNA, 542 bp, Homo sapiens
ttgaggtaaagaagatcaggtaatcaatgtttaagagctgaaggatgaataggaattaactcgataacagggaggaatggaggagaaggaggacatttcaggcctaaggaagagtcagtgcaaaggccccaagagccagtgaggcttggtgcatttaaggaccctactgaaaacaagactgttgtttcagagaataaagagaaaggggagaatagagtgagaaaagactggggaagcttgatcactgaggtcttatgggccattcaaagtgtgtagtttagtcttgattctaagaatagtaagtcactgaaaggatttaagcacaagttttacctgatctgatttgcattactctggctataagaagatgcatttagatatgttactctggctataaaaaggataatttcagtagttgaagagagagatgatggcagcttggttttggacccaggatctttaaattcttaaaaaattattgaggaccccaaagtgcttttgtttatatggcttatatctattgatattcactatatttgtaa

SEQ ID NO: 8988 - DNA, 58 bp, Homo sapiens
ctctccgccagaccgccgccgcgccgccatcatggacaccagccgtgtgcagcctatc

SEQ ID NO: 8989 - DNA, 410 bp, Homo sapiens
tgaatgtccatgtaatttattgaatattgtactgaaagcgtaaaaacagaatggtttatggatactcgaagtatggtttctactgaatgggaatcacctttgaccatcttgaagttgcaaaatcctaaactgaaccattgtaagtcaggcaccatctgtaaatgtctcatatttcctactgggaataaagtttaaaatgaaataactgattttctgaaactggcactcaatttaagtcaaaaatagtttaacagtaaggcttgcattgctaggacttacagctttagtgggcagaagtatcatcaggggagcgtgttaaaatgcatattctcctgagacgagattgcgccattgcactccagcctgggtaacaagagggaaactttgtttcaaaaaaaaaaaaaaaaaaw

SEQ ID NO: 8990 - DNA, 247 bp, Homo sapiens
ttttttttctttctaaggtatgtattgtgtggaggagcattacgtattgaacttctcacaaaacagggctgaagcagtgcctactcgacagaaccggtcatcgtacaaagaaatgccacgtgactcaaaggcaaagccagagtgcagcttggagcaaagaagatgatgtctcactctgtcacccaagatggagtgcaatggcacgatctcagctcactgcaacctctgcctcccagtagagacgggg

SEQ ID NO: 8991 - DNA, 89 bp, Homo sapiens
agaagagagaagtttaatggggaatctagatttgtataggtagagagatgagaggaagatgtttactaacaaggtttaaaaaaaaaaaa

SEQ ID NO: 8992 - DNA, 478 bp, Homo sapiens
atcaaagaatagaaggggaaaaaatgaggagtggaaaagctcgatttaacctttaagtacagataactatcagggtatgaaaaggcaagaaaacatgacaaaatgaaaggattattgatgggcaataaaggaagcgtagtaggtttaccttgagatttcactgagctaatatactggctcccatttctatgtttattgtaggaaaaagagaaaaacactaatccagggatagagctgactagggatgcccaagtcaaaaagactttgtagcactgggcttkgcagagggtcctgaagctaaatgcagaaaactgcgggaaatgtcttcaactggggctaaaggtcgtaagcaaggacaatgaacctggaatttggaggaattcatactccagtgaagaatttccagacccctcatgaaaatagcagattgcctactcaccagagaatactcaagctgaaactaagcagcccctggagg

SEQ ID NO: 8993 - DNA, 530 bp, Homo sapiens
aacaaaaacaacaacaaggaaatagagaagcaagagcaaacaaatccaaaagctagcagaaaacaagaaataactaagatcagagcagaactgaaggagatagaaacacaaaaaaacccttcaaaaaatcagtgaatccaggagctggatttttttgaaaaaattaacaaaaaatacctctagctaaactaaagaagaaaagagagaagaatcaaatagacacaataaaaaatgataaaggggatatcaccattgaccccacagaaatatacaaattactatcagagaatactataaagacctctacacaaataaactagaaaatctagaagaaacagataaattcctggacacatacaccttcccaagactaaatcaggaagaagtggaatgtctgaatagaccaataacaaattctgaaattgaggcagtaattaatagcctaccaaccacaaaaagcccaggaccagatggattcacagccaaattctaccagaggtacaaagaggagctgataccattccttctga

SEQ ID NO: 8994 - DNA, 522 bp, Homo sapiens
cacagaactttggccccctaactctggctgcaaaccagacttatctaggagactttgaaaagtagattccgggccagatgcggtggctgacgcctgtaatcccagcactttgggaggccgaggcgggcggatcacgaggtcaggagatccagaccatcctagctaacatggtgaaaccccgtctctactaaaaatacaaaaaattagccggatgtggtggtgggcgcctgtagtctcagctacttgggaggctgaggcaggagagcgtgaacccgggaagcagagcttgcagtgagccgagatcgcaccactgcactccagccttggcgacaaagcgagactccatctcaagaaaagaaaagtggattgcaggccaggtgcggtggccctcacttgtaatcccaacacttggagcggccaaagctggaggatcgcttgagcccaggagtttgaggctatagtgagctgtgatcataccactgcactccaggcagggcaacagagaccctgtctcaaaaaaaa

SEQ ID NO: 8995 - DNA, 206 bp, Homo sapiens
atccaagttcccacagctaccaagtggtggttgtggaattcaaaccatggctctcaaacttcagagtccaagggtgcggtggcacgtgtctgtagtccagcactttgagaggttgaggcagaagaattgcttgagtccaggagtttgaatccatcttgggcgatataatgagaacccatctctaaaaaataaaaaaaaaaaaaaaa

SEQ ID NO: 8996 - DNA, 62 bp, Homo sapiens
gaagggatagaggccttggaccaagatatacaggtatctttttttttttttttttttttttk

SEQ ID NO: 8997 - DNA, 526 bp, Homo sapiens
tctagagatgatttaaagggacgggaagatatatgtaggttatatgtaaatataccattttatataaggaacgtgtatatccatggattttagaatctgtagggattcctggaaccagtcttccatggataccgagggatgactgtattgttctgtgaaatttttgtcccagctacatatttgtatgtatgtatgtttttggtccggtataattgtataatatttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttaaagaagggctttctgctctctggtttaccccattgtatactaattagcctggtcttacttttatatat

SEQ ID NO: 8998 - DNA, 603 bp, Homo sapiens
atattaaataactttgtcccagagagaaagagagagtgggcagacatcgaagccaaacagcagtatcccggaagcactcatgcaactttggtggcggccactcagttttctctgccagtgtctggtaaattcctctattttgtcctaatctgacaatagtaaatagtaaatttccaaaactgtcgtttcatcatcagtttcagcaccgtgggcagctgctcgggtcctctcttgttgccccaaacctgcccggctattactgttcgtcagtgatgcagcagaaacagtgaaaactgatgcattcctttcaacaatgatgtgtttgttctccaaggagaacatctgcagtttttgatacaatataaataagtaaggtggctgtgctccaaagagttcttctggagaaacagatcaattcaagatttaaggtagggctttcaagagtttatgctatttaagcacagttttttaatgggtggacattagctccatctcgaagtaacaaaactggacagtgatagcaattaaaaagactttaaacaggaggtaagaagtgtagtgcagtgctgtagtgcaggaagtgtagtgcagtgctgtagtgca

SEQ ID NO: 8999 - DNA, 521 bp, Homo sapiens
ttaaaacaaaaatgctaggacagaaaagcaacatcggttagtacatccacgtctaaaagcattctataaataggccttgtttagctacacgagtctgcttagcagcccatggggagtgaggtttcttttaaagaaaatacagtatcgctcaaggtcataaacttcctgagtcctcctattagtgttctcatccccgtagtataacaaatgttttattacaactaaacagtgtaaggcctaataattaatgggtaatcaaaaacctttcacaatatcaccttttatctccaactatcggtctgtgccacaatggtgagtgcgtgctctaaaaacattcatattgtttagatgtacttcagataatcttctataaaaatagttatttgtacaaatgtttttaagatagtcttcaaatgagaagtttaatgtcttacctaattcatccacaagcaccagagaatgtgctgttgcatgcatgagtatgctggcagtttcacttaattcaacaaaaaatgtacttt

SEQ ID NO: 9000 - DNA, 169 bp, Homo sapiens
actttgaaattagccgggtgtggtggcacacacctgtagtcctagctacttcagaggctgaggatcacttgagcccaggagtttgagactacagtgaactatgattgcaccactgcactccagactaggtgacagagtaagaccctgactcaaaaaaaaaaaaaaaaaw

SEQ ID NO: 9001 - DNA, 446 bp, Homo sapiens
cagcacgagattttaaaaactcaaataagattgtgttattcacctgcttaaaacctttcatgactttcagtgtcacgtagaacagaaaacacttttcttaccaaaggctagagagctctacgtgatctggctatttttaacgtttcattgcactcamccttttcctctataatcaaactactctgatctcaagggttagttcttgaaagatgatcatgttctttaatgactttaggtttttgtgtgttattttctatttctgggatgtttattctctgttccttacatgctggcccttttgcatccttcttcaggtctcagcttacatgttaccttcaagaagcctttgaccactctaagtgggcccttccttccacttctgctgtgtaatcccactcccttctcccacttgttaattagttacatacttttttgtaattgtttat

SEQ ID NO: 9002 - DNA, 341 bp, Homo sapiens
tattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaacccgcaaaaaaaaaaaaaaa

SEQ ID NO: 9003 - DNA, 381 bp, Homo sapiens
caaagagttacttgttcagggggaaggagggagctacgattgagtcagggcatgtggtggggtttctgaggtggccggcacagttctatttcttgatttgggtggtggttataagggtatttgccttatcataactcctcaaactctagaggaagaagtctgctgtgaagaaaagattaaggccgcggtggctcaaacctgtaatcccagcactttgggaggccgaggcgggcagattgctcgagctcaggagtttgaggccaggctgggcaagatggcaaaacctcgttcctacaaaaagcacaaaaattagccaggtgtgatggcgcatgcttatggtcccagctattttgggggttgagggaggagaattgcttgagc

SEQ ID NO: 9004 - DNA, 171 bp, Homo sapiens
ttttattcagctttattctaggaatgaaaattggtctaccataagctactctatcttggaagtagaagtggcctattcattttttaaaaaatcatttttcctatactgatacagaaaaccttatctttcatatcttcttttgttacctaggtaacaaaaaaaaaaaaaaaa

SEQ ID NO: 9005 - DNA, 366 bp, Homo sapiens
tctctagtagtctattatcttgcagtctgttttgtcctgtgttcataccattgctctgacttactgttttcagcgaaaatctttttccattcttttcctttaagctcctttatgtttgtatttaaagtgattatttagtagacagcacgtaattgcaacttgctttttcagttcctaactctgctttttaattagattgagtttttgttgttaccttttaaatttttttaattttaatttaatttattttttctagagttgggatcttgctctgttgcccatgctggtcttaaactcctgggctcaagcaatcctcccaccttagtctcctgtgtagtcccggctacttgggaggcttgggcaggw

SEQ ID NO: 9006 - DNA, 349 bp, Homo sapiens
tgtagatcaaagaacaaatctttaagtcctcctgttcacctgctttactggcagatgaagcctagtcatggttcaccagggggaataccaaactcgccctgcagatcggtagtaattgtgcggagatgataggaaacaggagaggsctctaccgctgaaaagcacgggtctgaaarggcaggtgcctgtcctggaaaccaccttctcttggggcatccctggctgcccttctgcctgttgccaccaggtggggctctctcccagctcaccgttcttcctgcttaggacagcgccccacgtgacgttagtgaggcaatgcatgggaaactgcagcccaaacagactcctc

SEQ ID NO: 9007 - DNA, 452 bp, Homo sapiens
tatatttcatatatgggaatttaaaagttattttatatcctgttgtgctctgtagagagtggattaattcaattacatctttgcatgtgactaacattggagttcctaaagaaagccctaataaccagcatctctgggagtaaacggcttgcctgtttgtctcgtctgctacacatatgaagccacgcgtgataaggcatacctctagtcagcttctaacatgagcagtaggcgaggaaatagacaaataccagccattcttaagaaaagccatagaacaatgtttgttctgggaaaaagacatttattgcttttttatgcaaaggacagaaatatgatgtgtctttcaactttgaaaaggtaaggtatcatggaacaaagcctattccacttgaagtcctgattcttccatgatacatccctctaagagatcagaaacgtaaaatcagtgt

SEQ ID NO: 9008 - DNA, 425 bp, Homo sapiens
ttccattattccttagaaaatattttaaatttgccctcagtgagacatttgcttaagtcagtaataggtctgcaatttagtgtcaggcttgaaatgtgacctagtgcggctcaggagacggggtattagggttggtagattgcccgtgaaagtctttgcaagccaaaaattcatggatgaagccaaattcaggagctttgtcataattagacagtagagttcagagtgtggtttcttgatacattctttgtggtgctttccttttgcccttgattgcttgttttcccgcagtaatggttactctctctcaggttatttgaggagtaagtaaccgtattctaaatgtggttggtgaaacagcagcatcagcatcacctgagagctaggtggaaatgcagaatatcagacctactgaatcagtatct

SEQ ID NO: 9009 - DNA, 422 bp, Homo sapiens
tgaaatcgagactatttatttggaatatatacaacagtgtttttccactgtatttcatttgcaaaagttgagaactgctttctctaccttttgcaaaataattgatattccatattggattctcaaagacttcgatatggtgaacctawtwaamcctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtvaccagtttcatgctgtgtcattcacactcactacttaatactgccatggtgaaaatgtggaggaaaaatgtatccatgtgtgtctgggaagcatatacacttgtacat

SEQ ID NO: 9010 - DNA, 405 bp, Homo sapiens
acaacaacgagctggtcaagtgtgagcggcgcatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgcacagcgccgcccctcccggcccccagcaagtgtgtgctcagagcatctttgttcttcacggcagcagctaccttccctcactgtctcaggtgccgagaggggcaggtgccagcctccactggcatcagtgacaagcccagggsacagccacccgggggtcctcgcttcatgctcacacaggctatggggatg

SEQ ID NO: 9011 - DNA, 380 bp, Homo sapiens
aaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagt

SEQ ID NO: 9012 - DNA, 468 bp, Homo sapiens
tacccaactaaacctagtgtgctacacattctaggcacttgacaagtatttgtgaactaataaaatgttcaaagaaagtggttgcttatgaaataaaattggacctaggtgtggccatatagagggaagaggtatttgggttcactatgaggaagacaagcagtaagaactcttaatccaaaaggcaatagtctcccatgtgaagaagtgtcttcctcgtccctggctaggatagccagtggcaatattatttttatatccttctttaaacaattacttattgtgcacctactgattgcaggctactgtggtgaggataaattgccaaccaaagcagaaaggtctctgctctcttggaactaacttagcatctagtggcatagagagaaagtaatccaataatcagaaaaataaatccataagtaccaactgtgatttattttaaaagtcaagaggctggccaccgta

SEQ ID NO: 9013 - DNA, 443 bp, Homo sapiens
catggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcattaaaagagaaaaaar

SEQ ID NO: 9014 - DNA, 81 bp, Homo sapiens
taaattttgagcccattgttacaattaagtctttctgagagtattttttataccctgtatttttctttctttttttttttw

SEQ ID NO: 9015 - DNA, 381 bp, Homo sapiens
  misc_feature 167: n=a, g, c or t
cagttaatcgatctgaagatacttagtagcaatgagattttgtggtgaagctatatggattcatgcacaaaaagggctaaaagaatttcaggactgggyatagtggctaacacttgtaatcccaacactttgggaggccaagacgggaggcttgcttgagccccagnagtttgagaccagtctgagcatcatkctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaa

SEQ ID NO: 9016 - DNA, 515 bp, Homo sapiens
caatttcaacttttatgtgaagcatatttcttgtctgactttcagaaactgtttatgtgttccaaactttcattcttctatgctagttttccaaccctgattaaataactttatttaataaccagctttggtccctttattatcaacttagaaaaataagctaaaatgtatatatttagcatttatatatttataatgtaatacctacatgtctaaatacagaaatacacattttgtctctttttcctttacaggatatgtaaaactcaatgcttgttctatagaagaatgcataaaatttttagtgatttagaaaatgtatgttttcttgaagcccttcaggtagaatttggccaaataaagaatagagtatcacataaactacttaggaaatgaatcattcgtctctataaaagtaagggagatatgtctaattctagtcaggatgatgacatggggcaaaatgtgcctctttctgctgtcatttcaaacccatcccgagtgagccagaaagg

SEQ ID NO: 9017 - DNA, 442 bp, Homo sapiens
cgtcatttaggcttttgggatttgttggtatggaaaaatacatggattctcatggtactcggtggtttgagtagtctggcgttctctaggacactgtggggaggtaggacgcagttgtctgcccctgtgccccaaacattcagctcaggatggctgctgagctkggktttgggaaaactcacaaccctgtggatgtaacaggagtcagcagttttgatcactggttcatggaaacatgtgagaatatatatgaacatcttttgagtcttgctggtattgtcattcattctttcaatcactaattcattcatttatacattcagccccttgtttaaatatgtgcttcctgccggtcagcaggaagtcttaagaatggagcctggggtccaaatgagagccctcagtggctgttcaggggscaatccgttatgtacagtgggtc

SEQ ID NO: 9018 - DNA, 460 bp, Homo sapiens
tttttgggaatccctgtggacagatctctgttgaacaacaaaaattagtcacctatttaaactacaaagagcacttgtgattgagttaatgtcccatgcatgggaattaactaatcattagaaattgcttttgttaaaatggggaaaggatttcctatttaataaatggtgctgggagaacaggctagccatgcagaaaattgaaactgaaccccttccctacaccatatacaaaagttaactcaagatggattaaagacttaaatgtaaaactcaaaactataaaaactctagaaggaaatctaggtaataccattcattcaggacataggcgcgggcaaagattcatgatgaaaacgccaaaagcaattgcmacmaaagcmaaaattgacmaatgggrtcyaattwagctaaagagcytctgcacagcmaagggaactatcatcatagtgagcacacm

SEQ ID NO: 9019 - DNA, 261 bp, Homo sapiens
tttcaagtaaatctatagacccctgggaacttaaagatatgaaaataggtctaaaagttctccacaacttttttaatgttattttttcattttgatgatgatcttttaaaaaatacatggtgggcccaggcacggtggctcatgcctgtaatcccagcactttaggaggatcaccaggaggatcacttgagcccaggagttcatgaccagcttgagcaacatagtaagaccctttctctcctaaaaaaaaaaaaaaaaaar

SEQ ID NO: 9020 - DNA, 411 bp, Homo sapiens
caagatgagatttgggtgggtacatagccaaaccatatcaatgtgcaaagtctgatttgaagctaagccttatgctatgccctcaaaagagatgctacctaagttaatcacactctgaaaggaagaaggcaaaccgccccagggagagattattagcattcctgggaaactcagtggcctattgcctgtgagaaagacagtctgacgcgagtacagatctctgatgtggtaggggaccagcccaaatggaggctggcctagagtcatcaaaaaatgtgtttgtgtgactggagtctacatttctacaggtcaagagtcaaagaggggctgtgacacttcatctctgtgccaagagtcagcagagtgttttttgatctgagcacataggcacagttcttttgttgcctcttc

SEQ ID NO: 9021 - DNA, 303 bp, Homo sapiens
agmaggtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcytttttgacccttctggatttccgtttccwtwtctgtaaaatgaggagcttggaagatccggaaaatgaggcccataggaaacaagtgacttgctgagtccagataacactgactgtcagaagtctcgctctgtctccccggctgg

SEQ ID NO: 9022 - DNA, 281 bp, Homo sapiens
ctaaacgaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctggccaaatatgcactttccctagagagccatattycagcagtgaaacttgtgct

SEQ ID NO: 9023 - DNA, 509 bp, Homo sapiens
gatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataaagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcytaaatattgtacactgt

SEQ ID NO: 9024 - DNA, 387 bp, Homo sapiens
tttttcggaggctgccagcgtcccacaccatccgcagtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgtacagtgcttggtactgagtaggcactccgtcagtattttagtagctattattccaaaggacactgtattctaggtactaagacaatgtgaatggaatggaaaacaattcctccctgcagaagccaactgtctaggaagacagataatgacattattaaaataatcagaacattggcaaaataaagaagattgaaatgcaa

SEQ ID NO: 9025 - DNA, 76 bp, Homo sapiens
attgtgsggctgsaggaggtgtcgagcggcgttatttttttttgcggtttgcctttttttttcttttttttttttk

SEQ ID NO: 9026 - DNA, 472 bp, Homo sapiens
tatgcccataggttcataaattgcttttgttcttttaaaattcatccatttggtttaacttaaaggaaccttttaaatgcctcacccttgaccctcagagctggaatttaaatgtttctaatacagtgatttggctgttatcaagaggttacatttycagctgggtgtcagccaggtgtggtggctcacacttgtaagcccagcactttgggaggccgaggcaggcagatcatctgaggtcaggagtttaagatcagccatgaccaacatggtgaaaccccatctctattaaatacacaaaataaaaattagccaggcatggtggcacacgcctgtcatctcagctactcaggaggctgaggcaggagaatcacttgaacccaggaggcagaggttgcagtgagtggagattgcgccattgcactccaacctaggcgacagagtgagactccgtcgcaaaaaaaaaaaaaaa

SEQ ID NO: 9027 - DNA, 315 bp, Homo sapiens
agcaacctgctctggtccctttccacactgtggaagctttgttctttcactctttgcaataaatcttgctgctgctcactctttgggtccacactgcctttatgagctgtaacactcactgcgaaggtctgcagcttcactcctgaagccagcgagaccacaaaacccaccgggraggaaggaacaactccagacgaacaactccagacgtgccgccttaagagctgtaacactcaccgcagaggtctgcagcttcgctcctgagccagcgagaccacaaacccaccagaaggaagaaactccaaacacatccga

SEQ ID NO: 9028 - DNA, 385 bp, Homo sapiens
cattgggaagsctatgaggsctttacatttttggtgtgagatggggaagaaacataaaatgccactttacaacttcaataatagcctgtaatttakatttactgtgtgaatttttagtcctakattttaataatttgtaaattgatctcttattccaagaatcctttgaacttgtagamcatctgggagtccacttccctgtcctcttcctgatccctgctttctggactgtktaaatcctctttgggatggatcagagagtctagagaggccactcataggtccagctgctggcctcctgactctccaaagccttcactggaattgggacatttgctccagccctagctgtgaacatgaccagagacattatttataattcagc

SEQ ID NO: 9029 - DNA, 465 bp, Homo sapiens
ccacttgccaatcgtgtattcaaagttaagcctagttctatactcagatctcttttcccctattgcaataatcttgaataaaatttgtttttaccactttaagtattgtccatctctggttttccctgacacaaccatgtgacttcttacattgtttactgtttgcttatcttaactcattcttcaaagctaagatgctgattcaaacacttatttctacttgcgtgagaaatataaaagtctgaggtctagtgtggtactaattcactataattgaaagaagtgcttgacctataaatgaagcttatgcttaccttagaattgaaacatatggctgggcgtggtggctcacacttataatcccagcactttgggaagccaaagcaggcagatcacttgagcccagaagttcaaaaccagcctgggcaatatggtgaaacatcatctctaccaaaaaagtcagaa

SEQ ID NO: 9030 - DNA, 470 bp, Homo sapiens
ttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccatgaggacatcttagcaagggtgcctgcgagggagtgtgggactgggcctcatcctcgccgga

SEQ ID NO: 9031 - DNA, 484 bp, Homo sapiens
tagttatctctcaaatatatttatatcattaattgctaaagtgtacattgatttcatttattcttgttacagaggtaaaaggtcacaaaaatcttgtgttctaacagcatttcaacggaaactcaattacactctgaataagtcaattttcaattawtcttttgagagcttaagtatctttctcttataaataattacattgacctaaagaatagttcctaattctatgaataattcctaattctatgaagtataacatatgcctaatgaagcatagaggctacccatgtaatgtggtttctatcttataatatttgaggatgataaagtctttaaattaaacttactgtgctaaattagacagaaaattttatttaacatttttctaaatgtatgtataaaaatatcatattattttgacctctaatatcagtatgaataggggttcaaaagttctgcttactaatatagcaagtatatgtgt

SEQ ID NO: 9032 - DNA, 62 bp, Homo sapiens; identical to SEQ ID NO: 8200

SEQ ID NO: 9033 - DNA, 136 bp, Homo sapiens
tgttatgtagatgttctttagaagatctggccatttggtacataatccagcacagataagctgggtggtaatgataataaaaatggttttctcaaaaaaaaaaaaaaaaaaaaaaaaaaaaaaaaaaaaaaaaaaw

SEQ ID NO: 9034 - DNA, 422 bp, Homo sapiens
cttagagctgggccgccttggccctgctggccattagcgcgacttggggttattcagtacacttcttgtttgcagatggtgaagagcgctcgcccggtagcagaaccgaacccgggcttctggtctcagctccagaagtatgaggaggccctccaggsccagtcctgcctgcagggagagcccccagccttagggttgggccctgaggcttgaagcttgaaggcctgctgcctggaggaaggatgtccctgcactgatacagaagctgtttctggcaaagcctgccgtgtcttacatttgtctctctatccggattagatgttgctatatgaacacatcgggactgtgtctgcaggaaggagctccccattcgaggccttcacagtgtcacccacattcasctctttccacttaaacgtgtc

SEQ ID NO: 9035 - DNA, 83 bp, Homo sapiens
gcaatctcttgacctcttgatctacctgccttggtctcccaaagtgctgggattacaggcgcgaggcactgcgcctggcsgcc

SEQ ID NO: 9036 - DNA, 280 bp, Homo sapiens
cctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagbrrattggcccgaagaaggcccagctaatcgtgggctggcgggastccacggccccttcagccaggtggaggacctggaacgcgtggagggcataacggggaaacagatggagtccttc

SEQ ID NO: 9037 - DNA, 117 bp, Homo sapiens
cataccactgttgaacatactttagacstgatttattccacaactgcttgagaaaggtcctcttttaaaaattttgttgtaataacaaamcamcatgaaatataccctcttaacaaa

SEQ ID NO: 9038 - DNA, 72 bp, Homo sapiens
attgacagaatggtgtagtagtagatggggtggagccgctgggtggggtcgagactggcagctgagagatac

SEQ ID NO: 9039 - DNA, 471 bp, Homo sapiens
caaaattgaaatgatagtaattttagggaaaaatcttacttccctctttaaaaatacgatttttttttccacattgaccctttacctctgtgtgtactgagcctacttgcttcctccaagtttctctctcctgggtttatggaggaataacccaatgcagataatttttgacatcaagcctttgtctttatcatctttactggtttagaaatgtcaggttagccgggcgcagtggctcatgcctgtaatcccagcactttgggaggccaaggtgggctgatcatctgaggtcaggcgttcgagaccagcctgaccaacatggagaaaccccgtctcttctaaaaatacaaaattagctgggtatggtggcgcatgctgtaatcccagctacttgggaggctgaggcaggagaatcactcgaacccgggargcggaggttgcctaggcaacaagagtgaaactccatctcaa

SEQ ID NO: 9040 - DNA, 139 bp, Homo sapiens
kkgtctgagaaaacaatggcctcaagggaggggccttgggccaccctcacagggggtctctgtgtgatctcttgggatttctccttgtttttgtgagtacctgggaagtgttgtttgttttcttattttctttttaatt

SEQ ID NO: 9041 - DNA, 523 bp, Homo sapiens
ccagtgtgactagagccaaatacataaggctcaaaatagcagatgacaaggacagaagggtaatggaaggctggcttttgtagggtcttcttggccattgtaaggactttgacttttactctgaatgagatgggaaccctgggagggttttgagcagaagaatgactttggttttaacaggatttctctggctcctgtgtagattgagggggcggggggcagtatacaagcagggagaactttgggaaactcttgaaattattgaagtaagagacatggtgtttggatcatggtggtagtggtggaattggaattctgagtatgttttgaaggtagacccattgggatatgttgatgcattgtgaaagcagggagtccgagacgatgccagaacacagttggaagacggagttgccatctactgagatggggaaataggaagagcacatttggggaaaagatttaggagtttgattttggatgtgttaaacctgatgtgagaggggatatcaagtagatagtg

SEQ ID NO: 9042 - DNA, 432 bp, Homo sapiens
aataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggatttgggatgaaatacttaatgatctttccattggaaataactgggagtgaagaagtttttgttgcttgtacagtgtcagatgaagaacaacactatcttaat

SEQ ID NO: 9043 - DNA, 455 bp, Homo sapiens
atttattccaaggaacaacatcagttcactgttgttggagacatgacaatcattttcatcccaagaacactttaaggaaacattttacaagtatgcttgaaagaatgtcactaactggtccagaattttatcttcttgatttttccagatttctctatgtttttgagaaagatgttaatgttttgccatggtaaaagatttcaaacctcattttttttgttccttttcttgttacttttaagaaaactcatgctctgtttctctgaatcaaatgaagtagaagtttacaaagctarctttcttcttgtctagctattarcatgatttgtcaaatgcatgtttttttcagccaaagccttgtttccatttttgttgatgtgtactcttgctcttttagctagagtgtatgtgaaaataaagaaatacatcattgtattcacaaaaaaaaaaaaaaa

SEQ ID NO: 9044 - DNA, 287 bp, Homo sapiens
gaccttttgcatttggattctttcacttggcatattgttttgaagtttatccatgttgtagcttgcataagtacttccttccttttgagaccaagtaatattccatatggatacactgcattttatttatccattcatctatttgtagatatttgggttgtttctaccttttggctaccatgagtaataccgatagaacatttgggtacaggtatctgatggagcatgtaactgtattcaagtctctggggcatatacctaacaacgatattgctagctgtatagta

SEQ ID NO: 9045 - DNA, 372 bp, Homo sapiens
cccctttgttaatctatcttgaattactcacttttaggtttcagctccctactgagaccccaacttgctttaccttctgttccctcctggttctgcttatcttccattgaccctgtggacctgctttctgtcattgccttccctgccctcagtctcaggagcctgagactggcttctagatgggtttggacaatggatagcactggcaggaggagagtagagttgctgtgtttattttcctggtttcctcctgcaagatcatgtcatgttggctctcccagagggcatggctcatatcatggggccctctttgtctttccaagcctgtagatgatagcagcttcaggaggttgcactatcttttgactgtgc

SEQ ID NO: 9046 - DNA, 508 bp, Homo sapiens
ttttattttcatccatttcagtccaaccaccttccccttctccaccaagtttcagagtatacagctcctcaaattcaatttctctggagactaaaccactggtcttctgtgggtttggggactgggaaaaggaactttggtggggktggtctaagkgsykacatacagtgtttctaccttctgtttttagtacagtaacttatccctgcctaccttggtactactgtacacttctaatttatgaccatctccaggattcttatggaataaaacttgtkdctataaccctctctgctgccactccatttatagcttctttcattctgctaaatttaattagcatcatccagaaatgtgttaaaatctctcttcccctgttgtcttctctcttttgtatttttcgtattttattgtcattttaatgagtcagggtggagaagaaatagacacagtgtgctatagttaatcagaagcctcatggttctttttgagatggggtcttgcctgc

SEQ ID NO: 9047 - DNA, 467 bp, Homo sapiens
ctttggggtgactcttagatcaggtatggtcttttattcaacatgtagaaatggaaaaaatacctgagaaagatacttatattctctagctttcagttccaatttcattttcaagtggcaactcagtatgaaagtatgttcttttggccgggsaaaggtgactcatgcstgtaattccagcactttgggaggccaaggcaggcacatcgcctgagctcagcagttgcagaccatcctggccaacatggtagaaccctgtctctattaaaaaatacaaaaaaaaaattagccaggtgtggtggtgcatgcctgtagtcccagctaatcggaaggctgagcgggaggctgaggctggagaatcgcttcagcccaggaggcagagaggttgcagacagccgagatcacgccactgcactccagcttgggctacagagtgagtgagatgccgtctcaaaaaaaaaaaaaaa

SEQ ID NO: 9048 - DNA, 461 bp, Homo sapiens
tatgagttgtaaatttatacaggttataaacttacaaaaaaatgacagaatttcaaactaatagaaaactccatagtcacagtggaaaatcttaccactttacgcaataattgaagccgagcagtgtggcaggtgcctgtaagtgctagctaactaagctactcgggaaactgagaaatcacaggtgggaggatggctgaagcccaggagtttgagttcagcctgggcagcatagcaagacctatctctaaaaaataagtaagtaagtaaataaataaataacaaaacaagcagactaaaaaatcagtaaagatagagaaataagggccaggtgcagtggctcacacctgtaatcccagctactcgggaggcttaggcaggagaatcactcgaacccaggaggtggaggttgcagtgagctgagatggcaccattgcascctggccgaggcgacaacagca

SEQ ID NO: 9049 - DNA, 232 bp, Homo sapiens
ctatgctgcatctgaaatctatgaaatctatcattgtctatagtatactgtgattctccatgtttaatattgtataaaatttaactttatttaatttaaaaaatttacttttaattttwatttaatggctaaattactacttgagataaattttgagaacaacattrmcaaaaccacttgaggccaggagtttgagactagcctggtcaacatggtgaaaccccatctctca

SEQ ID NO: 9050 - DNA, 132 bp, Homo sapiens
ccataacatcattaaaaacatttgttttgtytwgtyttgttttgagacaggagtttcactcgttgcccaggstggagtgcaacgacgcgatctcagctcactgcaacctccggcctggacgacagagccggr

SEQ ID NO: 9051 - DNA, 434 bp, Homo sapiens
ggacacgggagcaagatggcgattccgggcaggcagtgagtgatccgggagttagggtcaggctgggggatgagaaactacggcgactgtatctttggccgaggagttttaaatgcgctggaagtgaagggactgtgtcgtcaagggtagagacgggaaaaaacgagaagtcctgaggaacatagattcccctcccccgtacattttcccggatggaagcccgaagtttgagggagaaacttgtgaggaaataaaggaagttaggctgaggggcagagagcgagacttttctattttccaaaagctcggtctgaggcccctcagtcttgcttcctaacccgcgcttgagtttctccccgcttggatgctctcaggggcagtgtgaagagagacagttcctggcttccttagagggccttgttctccttggcaga

SEQ ID NO: 9052 - DNA, 63 bp, Homo sapiens
ttdccactgcactctagcctgggcaacagagtgagactcttgtctccaaaaaaaaaaaaaaaa

SEQ ID NO: 9053 - DNA, 438 bp, Homo sapiens
cttttttaagatgatcttgctccgtcacccaggctggagtgcagtggcgtaatcatggcttcctgcagcctcaaactcctgggctcaatgagttccttgagatcttccatcctcagcttcccaagtagctagtagtagtagtggcttgcaccaacgctccctgcctaattttcaatatttttttgtagagatgggatctcactgtgttacccaggctagacttgaactcctggcctcaagcgatccttccgccttggcctcccaaagtgttgggattacaggcattagctaccacacctggccaaggcccaggtttcgacagaaagggagagaaaacctgccagagatgccatttcggagccactctgcttggcagggacctgtgttcccctcatgcaggttcatccttagagggctgcggtcttatctggttgtgca

SEQ ID NO: 9054 - DNA, 392 bp, Homo sapiens
caatcgttgttacagataattctgctgaagtttgtgtaagtaaaacttatgtgaaacagtctgattttatcttggagagttaagttcatgattttgtgcaacttctgaagaaattaccatgtattcaaatgtgactgtacttgctcacagcatttatgcaaactgctatcttataactgtcaatagagaatattcacatctacaaagaatatatcttatttcattacaactttaagatacttcacttgatgtaatttttttctcattcttcctcttttaaaaatgttgcttagctctggctgggcgcagtggctcaagcctgtaatcccagcactttgggaggccaaggcaggcagatcacgaggtcaggagatcgtgaccatcctggctaa

SEQ ID NO: 9055 - DNA, 404 bp, Homo sapiens
agtgggagmagcggcagagcttcggctgctgctttcaggctgccgctgcattaggggcttcctgaggaagcgcgggcggacgacagaggatgccgaaccactccagtgagtaagctgtccgcgcagaamvygaacttgccvttgacaacttccccsggaaagcggagggacctcctcgtcccaaggtcctccggtacccggaggtcacgcgcggacgtcggagccggagtgggtgctggagggctgggtccgggtcccgcggtgaggcgtgggttgtttcctaagtgtgggtgcaaagtaatgggcgctaggcgctggcgtcggtattcagcccagctgcacatctgaggcttggcagcttctcatagcgccttatcctctgccatacagcatccatctggagc

SEQ ID NO: 9056 - DNA, 149 bp, Homo sapiens
taatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtat

SEQ ID NO: 9057 - DNA, 386 bp, Homo sapiens
agdtgargcatttacctatctaggtaagtcakgakgagctcaaaaggagragaaaacagtaggaggcagggkaagcagcctctgtctccatctctgscctttgaaacaaaagggtatttcttttctctcttcagcccccaacccagtgggagaagtgatagcdgctacgasttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggwgascatcactcagcaaggacgaacgccaakgacagtaactga

SEQ ID NO: 9058 - DNA, 381 bp, Homo sapiens
  misc_feature 148: n=a, g, c or t
tcaaagtgagtctgttcctacattcacattgtcttggagagacaggtttgcatagttgtttacagaggcaggctctgagaggggtgagcctgggtttcagtcttagttctcttgatcttgggaaagtcacttaacctcccaackagkntbcyysakgtataaagcggagactgtaatattacttatgtcctaggatggctgtgagaattacaggagatagataaagagcacttagcccactgcctggcaaaagcaagcattcaataattatcagatatcactagtaattaataatcaggtagtgckattgttaacgttatcattacatcacagcactgcagaagatgaaagggcacctagaggttttttgaaaacacctgc

SEQ ID NO: 9059 - DNA, 79 bp, Homo sapiens
  misc_feature 79: n=a, g, c or t
awwtttcgcaacgrgtttbccgccagaacacargtstcgtgaaaactacccctaaaagccaaaaaaaaaaaaaaaaaan

SEQ ID NO: 9060 - DNA, 459 bp, Homo sapiens
  misc_feature 378: n=a, g, c or t
tctcaaaacaactcagtgaggttgatacaggtataattggtgtcttttttttcttttttctgacactggcatatcgaggcccaaaggttaagtaatctatgcaactaggaggcagtagaactgggatttaaacttagactgcctgtwrraggccatgtycttaaccactactagatttttggcgtccagatgtcccttgtatttctaacttccgtttagtttttctacctcccattcaatacatccattcagttaatctcaagtgcctgcctctttcccttgacaaaacacacttgctcattctttattccttgccacattaaagttaacactatcctccccatcgctagtactatagaggtcattgaaccttccccntgcgtatggcctgtgagttttattgattccagcatgattatttggtgatatttgagtgcgattttgtgctagatcctgggs

SEQ ID NO: 9061 - DNA, 358 bp, Homo sapiens
tttgagattgggtaaataatgttttaaaaagttgcaatacaaatgctgcttcaaaaagtttttgttatggccaggcacggtggctcatgcctgtaatcccagcactttgggaggccgaggcaggtggatcaagaggtcaggagttcmaccaccagcctgaccaacatggtgaaaccctgtctgtactaaaaatgcaaaaattagccaggcatggtggcacatgcttgtaatcccagctactcaggaggctgaggcaggagaatcacttgaacccgggaggcggaggttgcagtgagccaagatcgtgccactgcactccagcctgggcgacagagaccatccaaaaaaaaaaaaaaaa

SEQ ID NO: 9062 - DNA, 423 bp, Homo sapiens
attacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtggcgccaagttcagtttcgacagggatatgcatccgggagagaatttttcagcccccgcccccactggcatgtgagaggaggaactcgctgttgccctgtgtcttccccaacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagat

SEQ ID NO: 9063 - DNA, 442 bp, Homo sapiens
tacaaaaaattagctgggcctcgtgccgggccgcctgtagtctcagctactcgggaggctgaagcaagagaatggtgtgaacccgggaggcggasttgcagtgagccgagatcacgccactgcactcaagcctgggtgacagagcaagactctgtctcagaaaaaaaggaaagagtcatctgggtttggtgactaggagcgtactggtgacctcagtgagaggggtttcagaggcttatggagacagatgcaggttgaagtgggttgtggagcgcgggagaggtagaaagcagtaaacacacccccctgccaacaccgctctcaggagactggtgtgaagggtaggggtcaggacgctagctggagaaggaatatgggttcaagggagaagggcttttttctttttaatagaagagatcagcaatgtgtttagatgctgatg

SEQ ID NO: 9064 - DNA, 439 bp, Homo sapiens
aaaaaaaatttttccacagaaaagaagagaaagggctacccaaaaaatgggagaggaaaaactaatcggatgttagcagagctcaaatccttatgaacccaaactcccaagccactggatccggtgagatggctggaactcagcagggtcagcatgaggaacaccgcgaggactgctgaaacaccacattcccatggctgccgcagacagcggggtggctggaaggcacagtgtctgtgaaactgtggtcctcggcaaggggtgtgacctcatggtgggtcgcctgacctatgagcagagatggaaggaagaatgccaatttggaggcagatgtgggaagtaggagtgctgtggcaacacggtgtggaaatagggagttctcttcaggcgtgatgctcacagtttacataaatctattgatctatgtaaaaaaaaaaaa

SEQ ID NO: 9065 - DNA, 62 bp, Homo sapiens
taaccctgagattcttactactgatgagaacattatctgcatatgccaaaaaaaaaaaaaaa

SEQ ID NO: 9066 - DNA, 455 bp, Homo sapiens
aacgtttagcttaagttcaggaaaacaaaatactcagaagatggaccttttagtatgtgtgttcttgtatgttatgttcaagttttggtttttattttaattaccagctttatcttgagtagtataattttccgtggtggcacgccagagatttagggttatagaaagatgctctgtttaagactcttgacagggaagagctgtaaattgaaacagtggttatagttaccaatcaagccttgtacattaaaatatacacacgcaatttgaacgaaccgatggttcttaaaacagaaaatattggctgggcagtgtggctcgcacctgtaatcccaggactttgggaagccaaggcaggaggatcatcgcttgaggccaggagttgaagaccagcctgcgcasatagcaagaccccatctctacaaaaataaattttaaaaacaaaagcaaaaaar

SEQ ID NO: 9067 - DNA, 439 bp, Homo sapiens
taaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccamccmactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataatgctcctttagtttttcagccagtgctaacacagtaatcaaagcagcaaatcgaacctgaaa

SEQ ID NO: 9068 - DNA, 485 bp, Homo sapiens
atgtagcaaacccaacagttcttcacccctaacaatttatcatcaggaaaacaatttcgcattgcttaccagtcagtatgcaggaaaccatttttgtttcatgctccagcttttcttctttaagagagaaatttgaaacatcttaatwaargggtatgtgcacgggaggctagatagtgctgagggtgtggtttttagatattttgtcatttggattttttggtcaggatccttaatgttttgcatcagcttgggcttttaaattagatgtgaagtaagacttctttctacatttttatagttaatttagtgaaagatgtgaaagtgaaagcttgtgaaagatgctgggattggcagccccgcagactgaagtcctctgttcatccacagaacaggtacagcacgggcaagatttacccacccamcctcagccctgatctggagggaccaccactaggggtgggagggtaattcagcttctgaga

SEQ ID NO: 9069 - DNA, 487 bp, Homo sapiens
cttcatattttgtttttaaaaataggtaacttatccacattttaaatttttgggctgggtgcggtggctcacgcctgtaatcctagtgctttgggagggaagcaggcacatcacttcagatcgggagtttgagactagcctggccaatatgggtgaaactctgtctctgctaaaaatacaaaaattagctgggctttgtggcacacgcctgtaatcccagctactccaggggctgaggcatgagaattgcttgaacctgggtggtacaggttgcattgagcagagatcatgccactacactccagcctgggtgacagagtaagtctgtgtctcaaaaaaataaataaataaataaataaataagcatgcctgtgggttccagctactcgggaggctgagatgggaggattgcttaagcccaggaagtcaaggctgcaatgagccatggttgcaccactgtacttcagcctgggtgacagagtgagac

SEQ ID NO: 9070 - DNA, 361 bp, Homo sapiens
gaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttgacatttctttgtggkgtctgtctggacatgcttcctaaaaacagaccatttttccttaacttgcatcagttttggtctgccttatgagttctgttttgaacaagtgtaacacactgatggttttaatgkatcttttccacttattatagttatattc

SEQ ID NO: 9071 - DNA, 447 bp, Homo sapiens
aaatattttttttttgwatgkgcatactaaaaatgtacatttaggttttttycwatcagtgttactgaatatattatatacttacccatctaaagtgtataattcactggttttagcatcttcacagtgttaaaagaaaaacttcagccaaattaaatttaaaggcgtttaattgrgcaatgaacgattcgkgaattgagcagtccccagaatcacrgcagattcagagagactccagggatgcctcatggtcagaacagatttatagataagaaaaagggatgtgacatacagaaaccagatgtgaggtacagaaacaactggattggttamagcttgcwgtttgccttatttgaacactcagcaatgtatgagtggttgaaatacagccgtgagcctggggcscadtggctcacgcctgtaattccagcactttgggaggctgag

SEQ ID NO: 9072 - DNA, 403 bp, Homo sapiens
  misc_feature 50,320: n=a, g, c or t
agtcggcgccasggccgcacgccgcggasaggggctcggaggtcccgggnttacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagraagatgtagatgtccgtaggagaattgaacttattcaggactttgaaatgcctactgtgtgtaccambattaaggtgtcaaaagatggacagtacattttagcanctggaacatataaacctcggggttcgatgttatgacacctatcaattatccttgaagtttgaaaggtgtttagattcagaagt

SEQ ID NO: 9073 - DNA, 383 bp, Homo sapiens
tcactctgcsccacagccacagmccctgactgccgcakcccccacagagcccgccgcgcaccccacgtcccccacgccagcgcccagccatggaggccatcaagaagaaaatgcagatgctgaagttggacaaggagaatgccatcgaccgcgcggasaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggargagt

SEQ ID NO: 9074 - DNA, 463 bp, Homo sapiens
tagaatgcacagattttatctactttctcatttgtttccatctaggaactgagtaatggctccatggttaggatcactattcctgaaattgccacctctgagttaggtacgattgagaagtttcatttataagacatgaagtaattgtgatttacattaataattggggttttaaacattattttgccatttttgaagccactggatcaagttcttagctttgtagaggagctttaaagagctagggagtgctttgtgatgtccactctacgtgcgctctaaggttggagtacaggtgaaggatgtgctagttctgttccctgaggttcttctgttggggaatattgtgcagtataataatatattgacatgcctgctgggcatggtggctcacgcctgtaatcccagcactttgtgagactgaggcgggtggatcgcttgargtcggtagtttgagactagc

SEQ ID NO: 9075 - DNA, 385 bp, Homo sapiens
attctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaac

SEQ ID NO: 9076 - DNA, 372 bp, Homo sapiens
ttcrtaaacttctatagacagtggtcttgkcagtagcccaagtggsagatagtacatggatctggggasaaacagsctctactgttaggaatgktccatcctcctggcctgagttacacctgctcattgtgattccgaatttgaaaggwacacagtargaattttcaagaccctggggaagaggaargctgtggtaaacaggaaggatgagattagragaaggagtttaggtgaggtgagcccttgttttactagtagggtttaagaatatccaagtcagctggacatkgtggctcacacctgtaattctagcactttgggaggccgaggtgggcagatcacctgaggtcaggagttcgagaccagtctggc

SEQ ID NO: 9077 - DNA, 245 bp, Homo sapiens
ctatgsaactagcaaaaatctgcataatgsaacaacacagttttcacacttcaaattttacatgaggggttcttcacgattctcctggaacccagtctagcaaaatgagaggaaaggscctagggagatttatttctgktaaataggttaactctgctgagtatgacaaatagtgtctactatctcaaccctccaaaatttgcagagtgttgggactgtcatttgtgatttttttttkttttttk

SEQ ID NO: 9078 - DNA, 435 bp, Homo sapiens
tttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaaaaaaaaaaaaa

SEQ ID NO: 9079 - DNA, 223 bp, Homo sapiens
accttgtgscgcagtccttcccgggaracctggggaccggaactgcccggagttcccgcccccagasagaaccctgggttgctgggcaaccgatgcggcccccgsagctggtctctgtggtgctgggagcgagcccagtatagstcccacctcctgsgctggtaacctcccgtsccghscggctcccttgttgtcgcctctcctcgmgtcgcggaatccttgs

SEQ ID NO: 9080 - DNA, 209 bp, Homo sapiens
ammctaaaactcccacagraagggggaaaattasaaaaggggtgatataatttgactctatgtcaccrsccaratctcatcttgarttgwaatccccgtaatttctcacctggcaagagtgggaccaggtggagacaattggatcatggggggcagttttccccatgctcttctcgtgataatgattgrgtctcatgggatctgatgat

SEQ ID NO: 9081 - DNA, 370 bp, Homo sapiens
tagttacataacttgtagtatacccaggcaatggaagactatgcaatcctcagaaagaacgaggcagctctacacatgctcacttggtaccataccctaacatgtacaattaaaaagcaaggttcaggattgtgtgtacagcatgctatattgcacacacaggatgrataggcaagsaasatattacacaaatatggctatatttgtataaaaatttaaaaatgtatcaatgtacacatacatgcacttatactcatgtgttcattgactgtctttgggaggatacaccaagatctctggggagaagtaaataactgaagtataagggtatgtgttcctttggtagctttcaaattgtataccatttatt

SEQ ID NO: 9082 - DNA, 456 bp, Homo sapiens
aaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtargagagrarscgccgsgaacagcgakcgcccagcaccaagtccgcttccaggctttcggtttctttgcctccatcttgggtgcgccttcccggcgtctaggggagcgaaggctgaggtggcagcggcaggagagtccggccgcgacaggacgagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgc

SEQ ID NO: 9083 - DNA, 511 bp, Homo sapiens
aactaagttggtctccaaaatgtacctttctggcatttagatggctactttgaaacccttttgtaaatgaaatttacatctataaaggaaatcgccatctgtaagggcatctacactgagaagagggtggactgggtcactagaaactcttaccactgatctaacataaatcttamcsattgttwaaggtgcttttccttgccatcttgtcttaaccgggcctttaccgacacttttcttccttggtttagggaaccagtggtacagtatttaggcccaaagtctcagctctgtgcttttgagatatgaatttttcaccgtgttccacctaatagcatccctttagaagtacaaatttagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcg

SEQ ID NO: 9084 - DNA, 468 bp, Homo sapiens
gtaaccacctgggaaaacttcacagaaaatcagagtttcagatactgagaatagaaccactaagaagcagaaaagagaagatattctcgtgggggagaacaacggctgggaggggaggaagcatggccaaggcaaagaggtgggcattaataaggaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaaataccgatttatatgamaattaagattacaaattaaagcctggctatcctggagttttccagttcatcagccatccaataaaaatgatgtcaagcctgaaaaa

SEQ ID NO: 9085 - DNA, 459 bp, Homo sapiens
tatatttgtgctgagtgawctatcacataaatggcttcagcacagtcaaaatgcagaggatyctgkatttcaatgtctagtctggagctctcagttgagttctggatctgtgtatccacctggccacttgacgcctccacttggatgtccacaggcacctccaatgcaaatgactcatgaccttctcctccccatcagcactctcacaggagttcctgtctaaggaaatggtatcaccatcttcccattacaaaagccatacatttgagcaccatccttgactaattcctgttccttcctctgttgtacccagtacccaaaagaatgcccagcacatggtaggtgctcactaaatagctacttgattgaatggatatgcaacccaccaccaaggaatgccactgtgatgaattagaactcttctatctaattccattctctgcaccctggtccagacac

SEQ ID NO: 9086 - DNA, 97 bp, Homo sapiens
tgctctctagccaataaaccgtccttgtgtgcgagtcaaaaaaaaaaaaaaaaaaaaaaaaaaaaaaaaaaaaaaaaaaaaaaaaaaaaaaaaaaar

SEQ ID NO: 9087 - DNA, 498 bp, Homo sapiens
aacactgaccagctctgattcagtttgagaaaagaggacacaaaagcatgaataacaggaggatggatatagaataccagcatcagcaagtgtacacgatttaaagcacatttggtatctattaccaagctgcccttcagagaggttgtctcgttacacatyccacagctgtgactgagaaaccgtcttgtcgcatttgacaatccaggttactatctaaaaacttgagtttgtaagagcaacacgccatgagataatattcgtgcaaatgtaactgacaaaagactaacatcccataatactagagcacctacaaaccaagaagataaacatcccattgggaaagtgtaaaaatatgaacataaagtttacagaagaaaaaacacaaatggctcataaacacacaaaaagatgatattgcttcctggtaattggggaaatgcaaacaaaaactacaatgaaatatcgtggtatcgtgtatcaaatttgcagagcata

SEQ ID NO: 9088 - DNA, 183 bp, Homo sapiens; identical to SEQ ID NO: 8195

SEQ ID NO: 9089 - DNA, 471 bp, Homo sapiens
  misc_feature 157: n=a, g, c or t
tgtaatcctagttctttaaacagtagttctcaaactttagtttgagattgcaccactgcactccagcccgggggacagagcaagattccatctcaaaaaacaaaaadcaaataatcacctggagagtttgttaaaacaggttactgcataccactcntggagttttctaattcattgggtctagggtggggtctaagaagttcgcagatgatgcttctggtccaggaccactgtttaagaactgttggccttaaatgttaaccttatggcttttttcctatatcttttattctccccaggatgtattgttttcaacctgttgatcatactgtatgtgtctgccctgtttttgcttaatatttttgcaactgtttttcccagttaaaaataatgactaggggccgggcgcggtggctcacgcctgtaatcsbaacactttgggaggttgaggcagacaaatcatgaggtcag

SEQ ID NO: 9090 - DNA, 219 bp, Homo sapiens
tggtaactaacgatactacaatggtctgctatttgctaggcaattgacattctgtaattttcaacctgtatttgtacccacctctctttcttctggtatattttaaagtaaatataagttatgttattttatttctaaatacttcagtatacatgaagaagaggacattttattagttattttttatttcattttatttaaaatctttttttttttttk

SEQ ID NO: 9091 - DNA, 448 bp, Homo sapiens
  misc_feature 373: n=a, g, c or t
ttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggachsthnhgcatagctggtaaatcaagttagagatgtaactgccttaaaacatgccagcttaggctgggcacggtggctcas

SEQ ID NO: 9092 - DNA, 420 bp, Homo sapiens
ctgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactacaaaaaaaaaw

SEQ ID NO: 9093 - DNA, 175 bp, Homo sapiens
agggacacaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctgggtgcagatgaacc

SEQ ID NO: 9094 - DNA, 267 bp, Homo sapiens
  misc_feature 173: n=a, g, c or t
caacatctacataacatttaggattgaaattgtggtagttgagaatctgaaggacagaaatactggagtaaagaagcaggctttcagctgggtgaggtggaggttgcagtgagctgggatggcgacactgcactccaacctgggtgacagagggaggccctgtctcmaascanccaaaaaaaagaagtggtctttcaaactgagagagagaattgagattaaattattgctacctgtttacttagattactttcttttttttttttt

SEQ ID NO: 9095 - DNA, 156 bp, Homo sapiens
aaaaggaactgtactcaataaatatcagtggaacccagagctcctggcctttgcaatctccacgttgcgatggatccttggacccacttttgttaactctcaaaaaaaaaaaaaaaaaaaaaaaaaaaaaaaaaaaaaaaaaaaaaaaaaaaaaaa

SEQ ID NO: 9096 - DNA, 448 bp, Homo sapiens
cacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactt

SEQ ID NO: 9097 - DNA, 556 bp, Homo sapiens
aacaaccgaagtaacccgcaatgcgaagggcgaggggattgcgagtcaccgagtttcccgcgcggcttgagaacgtgttaggaactagtacttaaataatctcaagtccctgaggggccagagatcccaccatgcaaaatagcaaacagacccaagacttggggagaggcggtgagtgcatcagaaatggatgggtacatctgattcccaccacgcggggctcagcttagttagcaggagaccttcagactgagaaaaaatgcaagtctttttttggcctctaatatctgggaaggatggagggagctcaggagacacagaaaagatggcgtatgaatcctgtccggcctgaacgaggctggagttgtgcctctggatagcttcaagcactgatcagattgtcagcccccgctgcttgaacagatgctttagagcctcttccagttgccggtttgttcctgaagccccttcaccacctgcgctgcccaagtattcctggactcgatgttctgacatcctgcataagagtcgacagaaacttgctagcgtgatgtca

SEQ ID NO: 9098 - DNA, 429 bp, Homo sapiens
gataaggaatctctaacctaagctggaacacagaggccaactctacatctaccttcctcaaaagcaagaccactgctacaatcatcagggaatgggcccaactggcactgaacgtctgaccgccactgtctttcatcaggcgaatttgaacatgctggagataggcagagaatgctattcgggcctgcattttgctatagaaatccaaaacaacataccgttatgtgacagaagtgtaaaactacaaaatgtgtacttgcttctctccaagtggcctttgaggatgcttctattatgatggctaagaaatatgaaacccatcttacagcctgtgaataaggattccttctaagcagtacatgaaggtttttctttttaaatttcctattaaaagaatcagagatggagaatccaaaaaaaaaaaaaaaa

SEQ ID NO: 9099 - DNA, 475 bp, Homo sapiens
gaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatactbaagttgtatctctttcctttttgtacttcatggcaaaattaattttctaaaggattcagagaggcgtttatattttataacaattattagaaataatttgttccaccactagattactgtattttatggaatctaagctgtatatgtgtacatttgtatacatgtatgtgtaaatgtaagcctgacgtgggttcagattccagttttgtcac

SEQ ID NO: 9100 - DNA, 442 bp, Homo sapiens
acaatgcatatttcctaagaacatggatattctcttttatagctacagtataattgtcaactctagtaattttaacattgatgtaatactttattttctgaatttctgttttgttagttgactcaataatgtcctttatagcttatttttttccttccagtacaggatccattcccaggcctggtattgtatttagttctcatgtctttttagttgattttttcttgagacgaagytcactctgttgcccaggctgcaacctctgcctcccaggttcaggtgattctactgcctcagcctcctgagtggctgggatgataggcgcctgccaccatgcccggctagtttttgtatttttagtagagacggggatcacctgaggtcgggagttcgagaccagcctggccaacatggcaaaascctgtctctactaaagatacag

SEQ ID NO: 9101 - DNA, 475 bp, Homo sapiens
caattttataatatgttaatttaaaggtaaaaataaatatttgagaaatatcatagatggaagctgcaatgataaatttactctcataaacatattgacaatttattaatcccaagtttgaccttgaagaaacttcaatatcmawttgaaataagagttctacatgcagaaatgcctgaaagtaggacattatgtaaaagtggcagccttggcatggggcagcagatgcaatggggagatgtgtgtaacaggatgagacgtaacaggcagcataacctagccaaggggccagaggatcagagagcaattgctcccaggtagacataaaggccagggtcaagtacaagggtctgagaacagaaaccaaaagcagaagttcaggcatggagccaagaacacgtgctggcgatgaaaaatcagactacagtttagctgcctcacagagctcaaggcaagagaccatccagctcttgga

SEQ ID NO: 9102 - DNA, 460 bp, Homo sapiens
gacacaagtgcatctgctagctgttagcacttggcagacggagttctcctctagggtagttctaactttgggtaataatgtttgtcagctacctgatattaacattgctccacgttcaaacagcagtgttagcaagacctkggggaaaaggtaagccaaataaaatatcttgtcagaagttgtattttttttcagcattatatttcctcttctatctaccaagagggatcagggaatggaattttatggggtgcaaagagtaatgctttatattacttttgtaggcttctcttgccttttcttatatgaagacttcttttcttcttgaagaattttatactttctaaaatgtcattttgaagctgtctgtgcagttgccacactgggaagttgctctggccttggtgacagatgcctgtagcacgcacgcttctcctgctgtagcaaaaaaaaaaaaaaa

SEQ ID NO: 9103 - DNA, 413 bp, Homo sapiens
tatgcagtgaaattttaaattatgatcaattctgcaaatcggaaagtatacaatactatgagaatatagcaatcagggacctaacctggcttgggggaaaaagtgatgttaaggttcatggtcaagggaaagctttcttggggaaatggtattttgagttgtactctaatgatgagttgaagtcaaccagggaaaagttaggtggggaagacacgaattaaaaacttacagatcaggaaactggcacattcaaggaactgacagaaggtcagtaaggctggaacaaagaaaataagggagaaaataactcaagctggtgctgataaagtcagcaaaaggccagatgctgcagccttataaactaagtcaaaaatcttgatcttggctaggtgcggtggctcacacctctaatc

SEQ ID NO: 9104 - DNA, 414 bp, Homo sapiens
gagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaacccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggcaagtcaggattaactatttacaggctgtggattgggtgttggtctgcttcatcgrtaaggaaactggagcaactcam

SEQ ID NO: 9105 - DNA, 248 bp, Homo sapiens
agccccggatgttcgttggggattcaacatggcggcgggagtgtccgcggtggtggcggtgcaagagagcggaaggagtgtvtggaggagggaggagggtgaagactgaggctaggtgccagaatgaactggagtgaaggcgtgtctagagtgtgggctggctgttgtgctggaaagctggggacaggttgatggtaataaactgctcaatgaccagtgaaaaaaaaaaaaaaaaaaaaaaaaaaaar

SEQ ID NO: 9106 - DNA, 464 bp, Homo sapiens
  misc_feature 394..395: n=a, g, c or t
gagtccgggtttcgctgtgttgcactggctggtctcctgacctcaactgatgtgtgcatcttggccttccacagtgttggaactgtaggcgtgasaccgcacctggcctactcctgtgttcttagcttgagttcctggttgatgggtggtgcaccaattgagagagaataccatggtttgtggattgggtacggtggcttacacctatagtcccaacactttgggaggctaaggcaggaggagttcaaggcttgagctcaggagttggagactaacctgggcaacatggcgaaatcccgtctctccaaaaaatacaaaaattagctggctgtcatggcgtgtacctctagtcccaggtaattgggaggctgkkgtggaaggatcgcttgagccnngaaggtcgargctgcagtgagctttgattacgccactgsactccatcctgggtgacagagtgagatctt

SEQ ID NO: 9107 - DNA, 157 bp, Homo sapiens
acagttggtggtaagtatttggctttatttctgggttctctattctgttccattctatgtgcctgtttttatgccagtaccatgctgttttggtaattacaggcttgtagtataattagaagtcaggtaatgtgatgcctacagatttggttttttk

SEQ ID NO: 9108 - DNA, 470 bp, Homo sapiens
  misc_feature 441: n=a, g, c or t
tctggatctttcctttaactgcattttttagtttattgtcaaagcctgtggtttgtaccataaaaataatataatacaaggaagaaaaatgagttatttcactgagtggtttgggtatgtttgggtttaaaataatgtttacttgcagccggggcgtggtggctcacgcctgtaactccagcgctctgggaggccgaggtgggtggatcactggatcacttgaggccaggagttcgagaccagcctggccaatgtggtgaaaccccatctctactaaaaataagaaaattagctggttatgctggcgggtgcctgtggtcccggctgctcgggaggctgaggtgggaggatcgcttgaacctgtgaggtggaggctgcagtgagtcgagattgtgccactgactccagcctaggtgacagaatgagactctgcctcaaganaaagaaaaaaaataatgtttacttgggat

SEQ ID NO: 9109 - DNA, 251 bp, Homo sapiens
tcttttggcttaggattgacttggcgatgcgggctcttttttggttccatatgaactttaaagtagttttttccaattttgtgaagaaagtcattggtagcttgatggggatggcattgaatctataaattaccttggaaggaaatagagacacaaaaaacccttcaaaaaattaatgaatccaggagctggttttttgaaaggatcaacaaaattgatagaccactagcaagacaaaaaaaaaaaaaaaa

SEQ ID NO: 9110 - DNA, 247 bp, Homo sapiens
aacgtggtgtggaaggtagcctgttacagtgctggattcataaaagggcctttatggtttgtgaaagaatatctgtgtgcttagggaggaaactttttgatctgcagaaaagccagaagacatctaggacatccataaaaattcatcagagagcattttactactgagctgcaaagggaaaaacttaaaatggatatgaaaagtgaagaaagtgatgcttctcgtgccgtttttttttttttttttb

SEQ ID NO: 9111 - DNA, 452 bp, Homo sapiens
taawcaacccaagttcagtttatttttgcacattgctttagagatataacttggctgggcacagtggctcacacctgtaatcccaacactttgggagaccaaggcggatggatcacttgaggtcagttcgagactagcctggccaacatggtgaaaccctgtctctactaagaaacaaaaatcagccaggtgtggtggtgggcgcctgtaatctcagctactcaggaggctaaggcaggagaattccttgaacccgggaggcaggggttgcagtgagccaagatcacactactgcactccatcctgggctacagtagagcgagactccatctcagaaaaaaaaaaagatacaactataaaagatacctcataaagaacacggrttcactaggaagaggcgtcattaactgkgcccttttagaatattttgtccattaacttaaatawattta

SEQ ID NO: 9112 - DNA, 416 bp, Homo sapiens
tgttataaagtaagcactttttctttggtgccttggccttctgcccataattttgtttaaggcttcccaaatgtaatgtctataggtgtgaaatgttgaccctgtgcagacctctaataacagtagcactgatctggccgggcgtggcggctcaggcctgtaatcccagcactttgggaggccgaagtgggtggatcacgaggtcaggagtttgagaccagcctgaccaacatggtgaaaccctgtctgtattgaaaatacaaaaaaattagccgggcgtggtagcgcgtgcctgtaattccagctactcaggaggcagaggcaggagaatcgcttgaaccctagaggcggaggttgcagtgagctgagaccgcaacactgcactccagcctgggcgacasgcgactccatcccaa

SEQ ID NO: 9113 - DNA, 444 bp, Homo sapiens
ctttgggatcccaaggcgggcagattacttgaggccaggagttcaagatcagcctggccaaaaatggcaaaaacctgtctctacaaaaaatacaaaaaattagccaggcgtgatggtgcacacctgtaatcccagctacttgggaggctgaggtaggagaatcacttgaacctvggagacagaggttgcagtgagctgagatcatgcactgcactccagcctgagtgacagagcaagactctgcctccaaaaaaaataaaaaattagccaggtatggtggtgggctcctgtagtcccagctacttggggagctgaggcaggaggaacacttgaacttgggcgcaggagtttgaggttatgggtaagccatgatagtgtcactgcactccagcctggatgacagaatgagactctggccamcctactcaaaaaaaaaaaaaaaaa

SEQ ID NO: 9114 - DNA, 359 bp, Homo sapiens
tctgtagatatatgagccatgtttttcctttatttttgaatttttttttcctgtgctctaatggcggtaggagattgtggattatctttttaaatagctgaacaaattataaagaaattaaagtacggtattgcggtagggttggcgtaggcttttgggtctcatttcatgtgtcagtattattactgtcctttatagtaggcacgtaatacttttgacatgttattatttttagtaatctcagcactttgggaggctgaggcaggtggattacttgaggtcaggcgtttgagaccagccttgccaacatgatgaaaccctgtctctactaaaaataaaaaaattagctgggtgtggtg

SEQ ID NO: 9115 - DNA, 298 bp, Homo sapiens
tggatactgcgggcaacacagctggaccagatcccccagtgcaaggggttggcaagcatgagctcagccatgggaacgaggtggcaagtggttctccctgggacacggacaggcccgcagctgagctcttagctacacgcagccctcaggatgtcccascaggcccccaccagggcadatagtggtgcccagccctcccctmagccrsgccgtgtgctctgcctcamagaaaaagatcaacatccgsgtgstgraccccttsaccatmaagcccctggamagaaaactcattctcgav

SEQ ID NO: 9116 - DNA, 326 bp, Homo sapiens
ttctatttttagtggagatggggtttcaccatgttggccaggctggtctccaactcctgacctcgggtgatccacccaccccggcctcccaaagtgctgggattacaggcgtgacaccacacctggcctcatttcatcttctaaagtactctccctaaaatcctagtgagtcttgctttccaaactcaggtaattcacccccagtctggaaagccacagagtgtctgtgcagctccagagttggtgctcttagctacttcagtagcagccctctgcatcagactatgaagaaatcagtgtcactggagggacacaggtacaatatt

SEQ ID NO: 9117 - DNA, 312 bp, Homo sapiens
cataaagatttctgtgggtccttttctttccttaggatacaaaatttggatttaaagtctttcatatgttaacttggacttaaaattctaatcaactaatctagaaagaagaccacaactcatcaaatattycctaatgcgcatttacagaatttaaacatataagtcagccgggcataatagctcacacctataatcctagcactttgggaggctgatgcaggcagatcacttgaggtcaggagttcaagatcagcctggtcaacatggtgaaaccccatctctactaaaaatacaaaaaaaaaaaaaaaa

SEQ ID NO: 9118 - DNA, 277 bp, Homo sapiens
cwaaggttacacaggtgctttatatctctattttgcttatwttttttcattccaggaatacttcattgctccatcagtagatatacaagawcaggtttatcgtgtccaaaaactccaccatattctaggaaatattagtcagtkgcatgcctttcattaaatctcaacatgaactcctcttttctttaacacagatctgcataaagtattacaaacaaaatcctcttgatgagcaacacatttttcagctgccagtcagaccaactgckgtaaagaa

SEQ ID NO: 9119 - DNA, 258 bp, Homo sapiens
aacccatcccctcaagcatttataagatatttcttaatgaaatatgaattagattaagtcaacaaatgtttggtattaattagcttgattgtaataataatttcacaatatacctatgtatcaaatcatcatatkgtwcakcttaaatgtgtactatttkwatttgtcaatcatattttaacaaagttggaggggaaaaatgttcagtaacaaatatatacatatgtatttagttyctgctactagaacagttccagd

SEQ ID NO: 9120 - DNA, 494 bp, Homo sapiens
  misc_feature 357,359: n=a, g, c or t
caaaaattagccaggcacattagcgtgcatctgtagtccagctacttggagggctgaggcaggaggattgcttgagcctggaggtcgaggctgcagtgagctgtgattgtgccactgcattccagcctggggtgacagagcaagaccctgtctcaaaaaaaaaaacaaaaagcaaaaaataaacaaatatttattgtatgcctactatgtgccaggtactctcccaggtgcttgagatacagcagagtacaaacaaagccgtgttcttgtcctcctacagcttgcattcacgcagcatttgaagggcttactatttagtcccaatttatgaaaggttctgtgtgattaaaggctgtndnhtggagaatatgttgaataaagagatgggcagggttggccaggcacggtggctcacgcctgtaatcccaacactttgggaggccgaggcgggcggatcacgaggtcaggagttcgaggccagcctggcagcatgg

SEQ ID NO: 9121 - DNA, 434 bp, Homo sapiens
agtgggccccgcctctacgggggcactggcgcggaaactggccctgtgtcgaagaaggaacgtactttggcgttcttatgagctgcctagtacaaattattggcagaaacaatgaattaaacattcaaaaagtaacccaccggccggccgcagcggcttatggctgtaatcccggcactttgggaggccgaggcgggcgcatcacctgaggacaggagttcgagaccagcctggccaacatggcgaaacctcgtccctactaaaaaatacaaaaattagccaggcgtggtggcgggcgcctgtaaccccagctacttaggaggctgaagcaggagaatcgcttgaaccccggagtggaggctacagtaagttgagatcatgccactgcactctagcactccagctgaggcgacagagcgagactctcaaaaaaa

SEQ ID NO: 9122 - DNA, 212 bp, Homo sapiens
gaggagtttgagaccagcctggccaacatggtgaaatgctgtctctactaaaatttcaaaaattagctaggcatggtggctaatgcctgtagtcccagctacttgggaggctgaggtcggaggatcactttgaacccaggaggcggaggttgcagtgagctgagatcacaccactgcactgcagcctgggtgacagagcaagactctgccaa

SEQ ID NO: 9123 - DNA, 410 bp, Homo sapiens
  misc_feature 346: n=a, g, c or t
tgaataaacctcttaaagcaaaggaagcatatcttaaagcactagagctggacagaaataatgcagatctttggtacaacttggcaattgtacatattgaacttaaagaaccaaatgaagccctaaaaaactttaatcgttctctggaactaaatccaaagcataaactagcattattcaactctgctatagtaatgcaagaatcaggtgaggttaaactcagacctgaagctagaaaacgacttctaagttatataaatgaagagccactagatgctaatgggtatttcaatttgggaatgcttgccatggatgacaaaaaggacaatgaagcagagatttggvnmaagaaagccataaagttacaagccgacttccgaagtgctttgtttaatctggctctcctgtat

SEQ ID NO: 9124 - DNA, 286 bp, Homo sapiens
atcttasggactgrtattggtaattatggtcaatttaataatattttggggcatttccttacattgtcttgacaagattaaaatgtctgtgccaraattttgtattttatttggagacttcttatcaraagtaatgctgccaaaggamstctaaggaattagtagtgttcccatcacttgtttggagtgtgctattctaaaagattttgatttcctggwatgacaattatattttaactttggtgggggaaakagttataggaccacagtcttcacttctgataas

SEQ ID NO: 9125 - DNA, 422 bp, Homo sapiens
tcttgtagttttcgtagcatctttgctatctggtatgaccaggtgttgcaggcttatcttttacagtttctaccccagatttataacctattatttcttcaacaagccctggttttagtggcagaggtatttagggcgcctaatatggaccttagagattattgctgctgtgagttgtcattgtttctaggacagagttatgggtgatatatatgtatatgtgtatatctgtacacatgcttttttataaaacttaaccacttctgtattataatacatcggtgtatatttttccatgttaaaaattctggttctcaaggatagggaataatgaactagaatatcctcattattaattactcgcttgttttctcgtatattacacagtagtctcagaatagcaatactaataataccataac

SEQ ID NO: 9126 - DNA, 390 bp, Homo sapiens
agtcgggaacggttctccgagtccgagctggcggcgcgctgtgggctgtttgcctgattctagagctcaatgctgcccatcaggtgtttgaagtcatgatttggtgaaaatgggacagtgaagacgttctgaaaaaaaaaaaggcwtwtgatgrggtttggacattgagaggtataggctggctgtaggagtcgggtttatgctgtgatgcacagkgamasgkacctctctctgttcagcaaggttcattccggctattcatttaacagctggaaagttctatatctgtggcaaaratgatctscggtggagggtttattcctggcccctggcttcctggccttggtcttttgartgcttgccggatccctaattcctttccggttccak

SEQ ID NO: 9127 - DNA, 453 bp, Homo sapiens
tataagacacgacttacagacatcttttagattattatagtttggttagacattgtcataaaamcagaagagaaactggtttaaccttactttattcagacttcactgtggtgtcagccaactttatccctcaaatattttaacagtaatgtacaaaatggagctatagatctctaatgctagaagagatgtccaagccttcactttgtagacaaatcccaaggcccctgaagattatgtgatttcccagaagttctattacgagttaattccagaacaagtcaagaattaggtttcttgactctaaatagagtatattttctaccatgttacattgactcatataaggtgattgttttcatgaatagaatatgttgtaattttttaattatatgtgttaataattaagtaaaaggatctggtacagatgtgagctcaaaaaaaaaaaaaaaa

SEQ ID NO: 9128 - DNA, 528 bp, Homo sapiens
tcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaacccagttccgtcccatcctgagggcaagatcctgggctcataggcagtccctttcacttc

SEQ ID NO: 9129 - DNA, 271 bp, Homo sapiens
ksgaaaaggaaaaccaccatctttcttttaaggctgttcctgggcctggcgggggaggcaggggtgagaggatggaattgtgtgcacaagaactgtggctattttaatatataatgttagagggctgcgttctttgtcgccgcctcccctgtgtgccagccctgtgtgcacggyctctgccccccggcctttgctgtggctggagctggacagtgcagtgactgsgrgsgkgggggagccaggtcgcccttttggcagctgctavgctgas

SEQ ID NO: 9130 - DNA, 275 bp, Homo sapiens
ttattttgtgacagggtcttagtctcgtccaggctggagtgcagtgctgtgatcttagctcactgcaatcgccacatcccgggttcaggcaattcttgtgcctcagcctgccgattagctgggaccacaggcatgcaccagctagtttttatatttttggtagaggcggggtttccccatattggccaggctgtcttgaactcctggcctcagttgatctgcctgcckcggsstcccatggtgctgggattataggcatgagccactgcccgggw

SEQ ID NO: 9131 - DNA, 108 bp, Homo sapiens
arttgtgttcgcagccgccgccgcgccgccgtcgctctccaacgccagcgccgcctctcgctcgccgagctccagccgaaggagaaggggggtaagtaaggaggtcts

SEQ ID NO: 9132 - DNA, 221 bp, Homo sapiens
araatgcgaaagcgactgccttcttggtccaagcacaaatgtggatcactgaacacagtactggaagcgccatttgcagggaatctacaaaccagtatcacatttaggagtcaaagtgttawttcttcagcattccttacaactagaaagcacattcactgaaggctgaaggagcctcacactgttggaagatgtactgctgctggttaaggtcaacctgg

SEQ ID NO: 9133 - DNA, 93 bp, Homo sapiens
cttsttgatcctgaactgggttaggtgccgctgttgctgctcgtgttgaatctagaaccgtagccagacatgggactggaggacgagcaaaag

SEQ ID NO: 9134 - DNA, 94 bp, Homo sapiens
ktgttcctggagttcttcccattgaggtcctaggatttgcacaccactgtcccacawkagctttcctgcctaatgaaaggaggtcttgtggtgy

SEQ ID NO: 9135 - DNA, 303 bp, Homo sapiens
  misc_feature 231,233: n=a, g, c or t
tcggacacttgggttgaattttggaaggcctctacatatctatctgggtcatggaggacttgcctaggtccccctttatttgtctaaggtcctgaaatggaaaagaaagtttwaagtatagtagcaccatgtccatcagacatttcttgtaagggcaacagtgaagttgggtgtgttacdtargtggcatatccagaggatctcataaaatggkrrrkggaaccccaggtnangggatcaggtrgggcatbcagaaggtgcattagagggttccccmgggaatttgwctttctgactttgggg

SEQ ID NO: 9136 - DNA, 235 bp, Homo sapiens
acttccggcttttgtgacgctttccctgggctctgaaggccagggggcttggatgtgagtctagtgctcctggtccccaaagtcacaaccccttctatcccagcatyccagacttctccgggcggggacagagttggacgtgcatggctgtgtcctgcaatcccctcgccacgaccgcccgggacggagtggaagcgggtccgtgcccccgttcctcgcgccagcctcggcggtk

SEQ ID NO: 9137 - DNA, 465 bp, Homo sapiens
cctttatggcctatcttttgatattcagagctttactttgtgatataggagatttatgttcgtgtttcagttgacttatggataaattcctaaaggggaagatacacgtttcatttggtttcttaaactgtctcggtgccaggcagtgcctagcacacagtaggagcacaataaaaaaagtgcgctgagtcagtcgccacatcctaattatagcggccttgtgtgcctgttgatactggtccagctcccctggcatgggcctgtgttcactgggtaatacttggaattaagttttaggtctgggcatagaaggtttataagatagtgaatataactgtagaggaaataggtctcttttaagttttacaaaaccttacttgtcttggcttgtgtcaattacaaaacgaaacaaaaaagagactcatcagaccgtgacaaatgatagtaaactttgcgcatggtggt

SEQ ID NO: 9138 - DNA, 335 bp, Homo sapiens
ccawagaaagaaaaagtaraaactaaaaggcagaaatgaaatccacaagcagacagcccagygccacaccctgggcctggtagttaaagatcaacccctgacctaatcggttatgttatctacagattacagrcattgtatagaaatgcactgtgaaaatccctatcctgttttgttctaatctaactaccggtgcatgcagcccccagtcatgtaccccctgcttgctcaatcaatcatgaccctctcacacacatccccttagagttgtgaacctttaaaagggacaggaattgctcacttggggagctcagctcttgagacaggagtcttgc

SEQ ID NO: 9139 - DNA, 380 bp, Homo sapiens
catttaaaaaaataccttccaacaaacaacactcttataggataagaccaaatcattgttttaaaattgacagagtcttaaacagagacacattaatggcagataagcccatgaaaaagtgcccatcattattggtcatcagggaaatgcaaattaagtcacaataagatccccaaaacagcctctagaatggctaaattgaagagatggataaccctgaatgttagcaaggttgtcaggaatgcaagttctcatacattgttggtggcaatgaagatggtacaaccacttgaatagtttgacaatttcttaaaaagttaaatatgaatctgccctatgattaatctgtgatggaaatcagagtagtagcaggatctggt

SEQ ID NO: 9140 - DNA, 294 bp, Homo sapiens
tyaggatgtgacatttaagctkrtttctgaaaagaattggtgraagttaggactggaggtkagraartyaactaggaavcaatttcaggrtttaggaaggagctaacctgrtcctgaattaggacacaggctttagagataasmatgaagargccgggmrcartggctcacgcctgtaatcccagcactttgggaggccgaggcaggcagatcacagggtcaggagatcgaraccatcctggccaacgtkgtgaaacctgtctctgctaaaaatgcaataattggctgggcgtk

SEQ ID NO: 9141 - DNA, 477 bp, Homo sapiens
aaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataaaaaaaaaaaa

SEQ ID NO: 9142 - DNA, 359 bp, Homo sapiens
ttttyttaatccagtctatcattgytggacatttgggttggttccaagtctttgctattgtgaatagtgccgcaataaacatacgtgtgcatgtgtctttatagcagcrtgatttatagccctttgggtatatacccagyaatgggatggctgggycaaatggtrtttmtagttctagatccctgaggaatcgccacactgacttccacaatggwtgaactagtttacaktcccaccaacagtgtaaaagtgttmccgcatmgccaagtcawtcctaagccaaaagaacaragctggaggcatcacactacctgacttcraactatactacaaggctmcagtmaccaaaacagcatggy

SEQ ID NO: 9143 - DNA, 366 bp, Homo sapiens
gaagggatagaggccttggaccaagatatacaggtatctttttttttttttttttttttttttkgggatggagtctcgctctgtcggccaggctggagtgcagkggcmcaatcytcggctcactgsgacctccacctcccaagtttaagcgattctcctgcatcagtctcctgagtagctgaaactgcgggtgcgtgccaccatgcccagataatttttkgcatttttagtaratggggttttactgkgtkggccaggatggtctcgatctcctgacctcatgttccccccgacttggcctcccagagkgctggaaagtatwcagaggagaascagaaaaatgggaataaamctagaaaagtttak

SEQ ID NO: 9144 - DNA, 373 bp, Homo sapiens
ctgacctttggaattttatctgtgtttttactgagagctatttctgctgtcttctaactactagttttaagatttacaaattttattatctgtcttatgttacacttagtttctacctttaattgtaacaaaatagtatttcagggatgatggttcaaaatcatggtgtttcatgacttggattctcatgccacccctgggcttgctggttggataggctgtcttggcaagatccctggatttttatgaaatgcaatttccagagtgagagctactaggcccagaaaatacttgaaacaaacatatccttgagtttagttaccgttgaatatgatgctgttcagaagccagatatctacagtccagcttgaaa

SEQ ID NO: 9145 - DNA, 350 bp, Homo sapiens
taaaatgttaaaaattttgaagtatgtgtttattaaaagaaagaggtgtatttacataaagttatgacaaatgacaagtcctaagagtttgcatttaagttttatcaactaaaattgctgaatttcacaaaattaaaattcctagaattttaagtgtgataagattgtgaagatagctcaagggagtgtgtctataatatgcagaaatcacttctggatttattcctaataatgtatccagtatcacagtatcacctgtatttccctgtttataacaaaactggcatcatgatgattagtaggccttaatagtgaaaaggctttttaagtacacaacaaatgtttctgtm

SEQ ID NO: 9146 - DNA, 102 bp, Homo sapiens
agttccagcggcggctacggtggtggcagttccggcggcggcggcggcggctacgggggcggcagctccggcggcggcagcmgctccggcggcggatacggm

SEQ ID NO: 9147 - DNA, 412 bp, Homo sapiens
taaagttattttgccaagtcatgccaagatatattgaaatttccactcatattggtttttaaaattttttttagtcctaaaattaataagtatggaaaatcactaaaagcagtgtaggataaggtgtgtttwaactggccgggcacggtggctcatgcctgtaatcctagcactttgggaggccgaggcgggcggatcacttaaggccaggtgttcgagaccatcctggccaacatggtgaaaccccgtctctagtaaaaatacaaaaaatagctgggcatgatggtgggtgcctgtaatcccaggtactcgggaggctgaggcaggagaatcgcttgaacccgggaggtggaggttgcagtggccgagatcgcaccactgcactccagcctgggtgacagagcgagactcc

SEQ ID NO: 9148 - DNA, 422 bp, Homo sapiens
aaatatataacaattttaagtatatgtgcagtcaaccctggagcacccagatatatgaagcaaatattattagaggtaaagaaagagatagaccctaatacaataatagctggagacttcaccccactttcagcattaggcaaatcttttagacagatattaacaaaaaaactcaatctgcactatagaccaaatggatctaatagatatttacaaaacttttcacccaatggctatggaatataaactcttcagcacatagatcgttctcaaggatagaccatatgttaggtcataaatcaagttttaaaatattcaaaaaatggaaataatatcaaacatctactctgaccacaatgggataaaactagaaatcaataacaaggaattctgaaaaccatacaaatacattaaaattaaac

SEQ ID NO: 9149 - DNA, 447 bp, Homo sapiens
acttaaaattcatggtcccaaacagcaattacttttgcaccaaactaaaaatataagttaaaatggaagagtctaggagcaaaccaagaaaagatcacctacttcatcatctctggtcaaaaacaaamccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttt

SEQ ID NO: 9150 - DNA, 432 bp, Homo sapiens
  misc_feature 219: n=a, g, c or t
tagaagatgctgtggggatgaggggcatgtccctcgaggaccgtgccagcagcgaggccattcggagaagacctgggaatggctgtggtcacaggcagttcagacctggcgggcaggtctacagcctgatttggggaagtcttgaggccatgagtctgcaggcacagagacagccctgcagcagcatctgcggaggctgaagagggagcccctggtgtncacctgggcagggggagggacctgttgcgattgggtgtaactgcgagaacagcatagtggatgggcggtctctgcacctgcgtgtgtggagggaaaagtaagacaggaaaggatgtgtcatgaaaaacgtggtcgtgagttaaaaatgaggcacatacaacaatagaaattctgcagatgtatttaaataatacactgtctaccgtgtgtgra

SEQ ID NO: 9151 - DNA, 369 bp, Homo sapiens
tatctaattttggcaaagtctttagctttttagtgccgtattttttttttcawataavggatagaatatttaggccgggmacggtggctcatgcctgtaatcccagcactttgggaggctgaggtgggtggatcacttgaggtcggtagttcgagaccatcctggccagcatggtgaaacctcatctgtactgaaatgcaagaagttggccgascgtggtggcacgcgcccgtggtcccagatactcgggaggctgaggcaggggaatcacttgaacccgggaggcggaggttgcggttagccgagattacgccactgcactccagcctggtgacagagcaagactccttcccaaaaaaaaaaaaaaaa

SEQ ID NO: 9152 - DNA, 432 bp, Homo sapiens
tttttgcgtccgggaggagccaaccgtggcgcaggcggcgcggggaggcgtcccagagtctcactctgccgcccaggctggactgcagtgacacaatctcggctgactgcaaccactgcctccagggttcaaagctttgcctcagcctccbaagtagctgggattacagattgatgttcatgttcctgacactactacaagattcatactcctgatgctactgacaacgtggcttctccacagtcaccaaaccagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctgt

SEQ ID NO: 9153 - DNA, 398 bp, Homo sapiens
  misc_feature 320: n=a, g, c or t
aagtttagggaagtgaaaggcgccaggtgccagtcctggcctctgatgtaacccagcgccccgcagtcccgacacagattcctggatctcagccccatagcagctatgatcccgctgctgctggcagcgctgctgtrcgtccccgccgggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccgganggsrccgtgggcgaagcctgcagccgctgtaccggagcaacaccagccagstcgscttcctgctctacaatgaccaac

SEQ ID NO: 9154 - DNA, 439 bp, Homo sapiens
cmgcccattgtggtggggcatctgtccagccccattgccactcagggcatccaaacaggaggcacccgctgggaagggtctaaagatactccttgtggccactgctactgttcacacttgacttgtggagaagcgaagggctgagggggaggtttgtgtacacccatgtatttaaaagtgactgactgactgaaatgagcacataccgacatatgcaacatactaataccttcctgattttcgagactttctaattactacaactaacctgttgtgctcacctctggaattcagaaagagagccactgcgagcactgaccacaagggctgccttaggaaggaaatgtgtgctttcaggagttcttattaggggaattttaagagcacaaaaattttattgaacccaccttagtgacaaacagaaaatgatttgttagat

SEQ ID NO: 9155 - DNA, 56 bp, Homo sapiens
ttctcacttaatttgtcatgttgttgatttctgtttacacagtttttttttttttt

SEQ ID NO: 9156 - DNA, 423 bp, Homo sapiens
ggaagaaaacgcaaacggcggttactgacaggctgggcgagcgctcgggggctcaaactgcctggagacaggcggggctcctgctgaggcttggtccgcccggacgrgtaaggagaggagccagggaggasstgctggcgtgagacgcctctgcccggtagaagatactggaagatcaactctaatttgtggctgccttcccagcagtctctacttcagcatatctgggagccagaagcactcaagtttgataactcaaaagacagaacaatcagtcaaggggtagaggctaccttccattctgctcatcttacacttcttggaaaggagacattcggtgaagatcactactattctccaaacttcattcgggaccctattccttccctgtttgatgtcagtgtgtcaaattctaaattatgt

SEQ ID NO: 9157 - DNA, 426 bp, Homo sapiens
acacctgagccaattagctccggagatcagaagaggcctgaaaacggagccgagcccttattctcgggatggagaaagtcacttgatcccaggtgacacacaactcccagctgatggaagacatccccaggcagaggagggagggcagcctctggctcgcccggtrgacaatcactgttccgtgtgcagaaccatgactgactctgaccaaatggcaagttcctgacagatattcccaggaagcagctaccccagctctcggtcctgatgcacacaagtccctcgttacagacatgccatgatgtgcacccacctccaccatttcagggtgggaattttgaaataaaatgtatgttcttcctttgatgttagtaactrcagagttatttaaaattcttattggacttgatttatgaaaataacaca

SEQ ID NO: 9158 - DNA, 432 bp, Homo sapiens
tgatttctctttcagatagttcactgttaatatttggaaacagtactcatttttgtatactgattttatatcctacaacattactaaatttgtttattctaatagttttttggtgcagtctttagggttttttatgtataagatcatgtaacctgccaggtgtggtggctcacgcctgtggtcccagcactttgggaggcagaggtgggcagatcatgaggtcgggagttcgagaccggcctggccgrcatgctgaaaccccatctctactgaaaatagaagaattagccaggcgtggtggcgcatgctgtggtcccagctactcgggaggctgaggcaggagaatttcttgaacccgggargcggaggttgcagtgagccgagatctcactgctgcrctccagcctgggtgacagagtaacactctgtctc

SEQ ID NO: 9159 - DNA, 433 bp, Homo sapiens
cttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggg

SEQ ID NO: 9160 - DNA, 434 bp, Homo sapiens
caccgtcctcgatctgtacgaaatgtgaaatgtttagggacatctccatgctgtcacttgtgatttgccctcttatgtattttggtcatattgccaactggaaagtcaaaattttctaacaactttaagtaagttctttcaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattatagtgttttgtaaatgtatccagaccatgatgcattgttttgtgctcaacttgtgttttgtatttaaagcatttt

SEQ ID NO: 9161 - DNA, 436 bp, Homo sapiens
tagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatccc

SEQ ID NO: 9162 - DNA, 342 bp, Homo sapiens
tgaataaattaatgtgtgatttcttttaggatggaagagtgtagaaagtgtccaaagttggtgtctgaatatatgtccaaaaagataaaagttgatgaatttgtgactcacaatctgtcttttgatgaaatcaacaaagcctttgaactgatgcattctggaaagaggtaggctttctctttatatatcatagaatgtaataatgatgttgagtttgaggggatggagagtcgaaaaacacaattttagttgtcttaaaggtatcatttaaaacttagtatgttgcttccttttacagcattcgaactgttgtaaagatttaattcaaaaaaaaaaaaaaaa

SEQ ID NO: 9163 - DNA, 367 bp, Homo sapiens
ttaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcaggkkgcaggactgttcctcccaatgtggcccccagccctgatgtgggccccctgctccagcagcggctgaggakctagatgccttgctcctggaggaagaaacagtagatcgggagcagccccactggacctaggtgccccatctgttggtcatccatcctgaagggacaggaaacctcccaggcagttatttttttw

SEQ ID NO: 9164 - DNA, 395 bp, Homo sapiens
tcagtagttaacagcatctacagccccgtgtttccacatttgtacaaaggaatgttcagactgaaccacacttaagtacaattttgaaacagcatgaggctgggcgtagtgcctcacgcctgtaatcccagcactttgggaggctgaggcgggtggatcatgaggtcaggagattgagaccatcctggcgaacatggtgataccccgactctactaaaaatacaaaaaaataggccaggtgtggtggtgtgcacctgtagtcccagctacccgggaggctggggcaggagaatggcgtgaacccgggaggtggagcttgcagggagcagagatcgcgccactgcactccagcctgggcaacagagcgagactttgtcccaaaaaaaaaaaaaaaa

SEQ ID NO: 9165 - DNA, 464 bp, Homo sapiens
cacagtggaacagccatggatgagtaacttaaagtaataattcttataccagagaggctacaataattttactgttaagagctggacagaattttgagatcttgagagtaagatacttcataaatgctttgtattgttgtctaacttccatatggtctgttaaaataacttactcaaaaaataacttaattcaaaaagaacaatctctattgaaaaaactaaaataggctgggtgcagtggctcatgcttgtaatcccagcattttgggaggctgaggtggccagatcatgagatcaggagttcaagtccagcctggccagcatggtgaaaccccatctctactagagatgcaaaaaattagctgggcatggtggcacatgcctgtaatcccagctatttgggaggctgagaggagaattgcttgaacgtgggaggtggaggttgcagtgagccgagatcacac

SEQ ID NO: 9166 - DNA, 190 bp, Homo sapiens
cactgtggttttgtattgagttttgaaattagaaagtgtgagtcctccaactttgttcttctttttcaaaattgttttgtttattctgtgtcccttgcatttctttgtgaatgcagggatcatgttgagactgtagatcatttgggggggcattgccattttaatggtattaaaaatcttctcatccarr

SEQ ID NO: 9167 - DNA, 168 bp, Homo sapiens
acagttggtggtaagtatttggctttatttctgggttctctattctgttccattctatgtgcctgtttttatgccagtaccatgctgttttggtaattacaggcttgtagtataattagaagtcaggtaatgtgatgccctacagatttggttttttttttttttttb

SEQ ID NO: 9168 - DNA, 401 bp, Homo sapiens
catgagcttcagtgatgtttaggaagtggagaagtgtagcagtaaaaacagaacaagagacatataggaaagaccttatggatttgattagataaagttttataacatttgcatgagtamcatgmagaggcgtcgaagatgttgataaacctacattagggttgacctatatgaagttaccagtatttgactttttaaacctacaaaagtggtagttttaaatagttctttgtaatagacacctggcttgggttggagatgactactcttcaaaatggacaatggcatcagtgaagaaccamgaattgcaaagatactgcaattctgccagttaagtgaggacaaaagccttaagtgattaccggcattttcagagctcttagctggtagcatagtgaatt

SEQ ID NO: 9169 - DNA, 385 bp, Homo sapiens
tacgtatattttaacaaacctgtccttgatattagttaaggtgacacataagggtgacacagaatgtgtaatgcaaatttcatagtaatagtaactttataaaataatattataaaatacaggatttaaacctttyctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtktggtagcatgtgcctatagtcccagctacttgggaggtggaggtgggaggattataah

SEQ ID NO: 9170 - DNA, 469 bp, Homo sapiens
aagtgctcccccatccccacagtataaaaagattatttgcatgggtgcaaaagaaaatggtttgccgctggagtatcaagagaagttaaaagcaatagaaccaaatgactatacaggaaaggtctcagaaagaawttgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgcc

SEQ ID NO: 9171 - DNA, 404 bp, Homo sapiens
atgttgatgatcaaaagtaacatgttgagactctgagcttaatccattaaatggattttagaatctagtagaagttatctttcttataaattaaaacatattttatgcttcttttttgagggaaatacctgggatcttttgcatcactatatgttagtgtctattatagatgattaatctttctaacttgatctttaaaagaaagaaattgattttagtgattgagtgttatataatagtagatacaaatctagttatggcattataatgtcgtagttcctatattctatttcatttctatgaatcaagatgcccatgtttagatgagcttagaaagctacttctcattgttcctactcaggccacatttttagaaaaaattttaagataactcccataagcaa

SEQ ID NO: 9172 - DNA, 424 bp, Homo sapiens
  misc_feature 72: n=a, g, c or t
ctggaggtttgcgtaccggtcgcctggtcccggcaccagcgccgcccagtgagtgaacaccggccgcagggnggtggggagaagggtcagcccggccatgtcagtcagcgcgatctcctgggctccgggcttgccargcagcgctgggccccgctcctcgtgarcggccggytctttggtctcgaacksccccctgggtgctgataggtgtggtttcccataaggaagctckkcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctgr

SEQ ID NO: 9173 - DNA, 350 bp, Homo sapiens
  misc_feature 297: n=a, g, c or t
tttcttccagtgctcctcgcaaacttaggctctaaacscatcagcgattcttgtcacaatttcactgacaaaatctactttatccttgtctcacagagagtgttgtatcttatgtagaatatagtattccatatactttccaactaacagaggaccatggattcctttctatcacctcagcagcatgtttccaacacttccacctaaaattactttagagtatcagctcaacacacgactgacttggaaacatcaggaracctctgtaatgattacaccaccttgtactttgctccnatttctggtctctggattttaatccctttccttccttctgagatggaactgga

SEQ ID NO: 9174 - DNA, 390 bp, Homo sapiens
agagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagac

SEQ ID NO: 9175 - DNA, 473 bp, Homo sapiens
attgaagaacataacatcaaaatctatcacttacctgatgcagaatcagatgaagatgaagattttaaagagcagactagacttctcaaggtaagaactggcttcagatccacaacataaataactcctgtttactgttgtccatgttgaggtgagagagattgcctgggtatgttcagttacgagagtatttttgctttcaatatattttaagacctcatgcagtggctcatgcctataatcccagcactttgagaggccaaggcagatggatcagttgaggccaggagttccagaccatcctggccaacatggtgaaatctcatctccatcaaaaatacaaaaattaggtggatgtggtggtgcacacctgtagtcccagccactcgggaggctggggcaggagaatcacttgaacccgggargcagaggttgcagtgagccgagatcgcgcctctgcactctagcctggc

SEQ ID NO: 9176 - DNA, 428 bp, Homo sapiens
twagrwtgggkwaaggcaraascaccasctgwactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaacaataaaaaaaaaaaaa

SEQ ID NO: 9177 - DNA, 384 bp, Homo sapiens
aaaaaatgccaccaatcaagccatttctttctcaaggggaactgagtgatttgcagggtttggggaaggttgcttgtccctaaagcatcattccgtcccactctggtgctgtgcaggagctcgactatcctgaatccaccatgattcgacctcatgtcagtcctttggctgccagcccagttcaactccaagctgatgaccagtgtcgaccgccagtcattctgaacatttgaccagttgagctttcaaatgatggcagtcctggctgacattttgggtgaacaatatgagagactgactggttgagcccttcccaaatttctgacccacaacattgtgagaaaaataatcttaagcctctcaaaaaaaaaaaaaaaatgcgaa

SEQ ID NO: 9178 - DNA, 470 bp, Homo sapiens
  misc_feature 222..223: n=a, g, c or t
acaagaccagcctgggcaagatagtgagacattgtctctacaaaaacattttaaaaataaaatgaaaattagttgtcgtggtgcatgcccgtagtcccagctacttgggaagctgaggtgggaggatcacttgagcccaggaggtggaggctgtagcgagcagagatccbaacactgtactccagcctgggtcagagcaagaccctgtttcaaaaaaagagnntttcaagaaggacagaatggtcaacagtaaagaaacaagtaaagaaacatctgcttaaagcacaaaagcagatcttaagttcagctatcatcctggaatatatttgccttccctttttgattgttactttcttcagtttacgtataatttctcagggagatcctccttcgttaggattgatcttcttgctttgcattcccgtaccactctttttgtccttttatatactgatcacctcataattgct

SEQ ID NO: 9179 - DNA, 435 bp, Homo sapiens
taaaacgataagtcagattactgctttttattgtaaactttaacaaactatttgactctctaaactatatgcatatgcaactttatttattttattttatttttatttattattttttgagatggagtttcactcttgttgcctaggctggagggcaatggtgtgatctcggctcatggcaacctctgcctcccaggttcaagtgattctcctgcctcagcctcccaaatagctgagattacaggtgcctgccactatgcccagctaattttgtatttttggtagagacagggtttcaccacgttggccaggctggtttcgaacgcctgaccccaggtgatccacccgcctcagtctcccaaagtgatggaattacaggcatgagctactgtggctggsctaactttattttttaaaataaaaataaaagctaca

SEQ ID NO: 9180 - DNA, 185 bp, Homo sapiens
cctctgtaatttattttgtcagtgttttgttgttttcagtgtgcaggtcttttacctccttggtttaatttattacaaagtattctaattttttgatgctatcacagtctagttttcttgattttttttttttycagtwaggckgtwatttrggcatgaaaaaatgcwactggactgggtgcggk

SEQ ID NO: 9181 - DNA, 424 bp, Homo sapiens
  misc_feature 332: n=a, g, c or t
caacaaaatgtggtatattcatacagtggaatattattcagcctctaaaaggaagatacgctgacatgtgctgcaacatggatgaatcttgaggacatgatgctaagtgaagtaaggcagtcactggaagacaaatactctatgcttccatttatgtgaagtatctagagcagtcaaatgcatagaaacaagtagaatggtagttgccaaggactgggggaggaggaaatgaggagttgtttaatgggtatagtgtttcagttttgcaagataaaaagtcctgtggattggttgcacagttaagttatgtgaatgctgtatgccaactcaantgtacactctaaaatggttaagatggtaaatcttatctttattttaccacagttttttttaaagcatggtaaacaccatttcccaggatgta

SEQ ID NO: 9182 - DNA, 435 bp, Homo sapiens
cagaaaataggattattctagtcaaaaagaatgtgaacctaattttttaatagttgggagaagtttttgtagaaatcatttcatgctttttaggtagaaaaggggctagacatggatcaaggaatcatataagaatagaaagagcttctgaaaagggacacacatatataagagatggtgaaaggaatttggatttagcatcccagtacctttagttggtgatatagcagtttagtagagggtaactgtaacacagtaacaaagacttttcagaaactcaatgtaaaagaaagaactgtagcagtggctcacgcctgtaatcccaacacttggggcgtctaaggcgggcagatcacctgaagtcaggagttgaagaccagcctggcaaacgtggtgaaatgccatctctactaaaaatacaaaaaaaaaaaaaaa

SEQ ID NO: 9183 - DNA, 427 bp, Homo sapiens
catggtgctggcatctgcttggcttctggggaagcctcagggagcttttattcgtggcaaaaggtgaagagggagcaggcacatcacatggcgagagcaggagcaaggctgggggagataccacacatttttaaatgaccagatctcatgaggtctcactcactattgcaaggacagaactaagacatgaggaatccacccccatgacccacacatctccaaccaggccctacctccaacactggggattaaatttcaacatgagatttgggctggacaaatatccaaaccatgtcagtgaatatattttagagtttaaaagtctgtttctaagcttaactttgatatgaataatttaaacacacatgaatgtgccttcaaaccaaactatacaatgtgtaaaaaccccttcgttccacattggggt

SEQ ID NO: 9184 - DNA, 422 bp, Homo sapiens
tagctgggattgcaggtgcctgccaccacgcgcastgatttttgtagttttagtggagacggggtttcgccctgttgcccagtctggtctcaaactcctgggctcaagaaatctgcccatctcagcctcccaaagtgctgggattgcaggtgtgagccaccgcacccagccttcttgtactgtttcacaacaccttgttcatagttgatatctawtaaatttggtatcaatatattttgatacctaataatttttgtggacttaagtgcaacaaaggtatgcacagtatagtatctttcctatggaaaagtctgggacaaaaaagtcaggtgaagtaaaaaggccaattctagggccaggtgcggaggctcacccctgtaatcccaacactttgggaggccaaggcaggtggatcacttcag

SEQ ID NO: 9185 - DNA, 392 bp, Homo sapiens
aaaaaatgccagsaatcaagcccatttctttctcaaggggaactgagtgatttggcagggtttggggaaggttgcttgtccctaaagcatcattccgtcccactctggtgctgtgcacggagctcgactatcctgaatccaccatgattcgacctcatgtcagtcctttggctgccagcccagttcaactscaaagctgatgrcccagtgtcgaccgccagtcattctgaacatttgaccagttgagctttcaaatgatggcagtcctggctaracattttgggtgaacaatatgagagactgactgggttgagcccttcccaaatttcgtgacccacaacattgtgagrvbkaataatcttaagcctctcaaaaaaaaaaaaaaatgcgaa

SEQ ID NO: 9186 - DNA, 417 bp, Homo sapiens
gttttggggcttgccctttcagaatgctacctccaggtgatgaaacatgaccagctgacagccaacaccaacctctagacatgtgtgtgaggccatattagaccccacccctccacccaggctcagctgaactgccagatagatggcttcggcagcatgaaccatcaggcacaaccagcagaagaaccactaggagctacgcaatcacaaaggtcacttcttcagtcaagtgcagcagatgggatcttgaaagtgcctacaagtagtctagaacaccttgaatccggctgtgaaaatgtagggtaaatctgtagctctcagtaggtaaacaccttatttaggtctggaggcattttgctatgttattgagtcatggaaacctattaaaagagctctatggcaaaaaaaaaaaaaaaa

SEQ ID NO: 9187 - DNA, 411 bp, Homo sapiens
aaaattaaaatatttttttaaaaaagaaaacattcaagtcatggtttttgaatgttcatatgaatcattttattaaaatatttcaataaaatcaataaattcacaaaaaaactgtactttttaaatggaaaaggtttatctcctggcaccctacactaaaagcactttagtattttttctttccctcattctgttgttctaaaaggatcattattatacatggccaggttatgtgatatgatagaggttgaagtaagataatgtgcatagccttctacttttgtcttccaatgataactgattttctacctgtttgagcccaagagtttgaggccgcagtgagctgtgatcacaccactgcactgaagcctgggtgacagcaagaccctgtccctaaaaaaaaaaaaaaaa

SEQ ID NO: 9188 - DNA, 460 bp, Homo sapiens
  misc_feature 166,263: n=a, g, c or t
ctgattcagcttccagagtagtcagagctacaggcatgcaccactatgcctggctaatttttaaatttttaataatctatttatttattggcttatgaacaacataaatgtatttcttacagttcgggaggctgggaagtccaagatcaaggtgctggcaaacttngtgtctggtgggggtccactctctggttcatagatggctgtcttttcactgtatcttcacatggtggaagaagtgaacaagctcctttgggtgwcwnwcataagggcactaatcccattcatgagggttccacactcatgaccttatccccttccaaaggcccctctagctaataccattaacttagggatttgaatttcaacatatgagttttgaggggacacaaatattctgaccataacaccatacaaaaaaaaataatttggccaggtgtggcggctcatgactgtaatc

SEQ ID NO: 9189 - DNA, 426 bp, Homo sapiens
acttgtctgtctctaataatatttcttctctaattgccccaaaggtttagaataggagtgagcatcacggtgaaacatgctactcaagtttgttttgctaatcagcttttccaccacagcataaaatttaaaagaggctttcaaggtgtatatttagtttgttttcagtgggaaaattttctagagggaaaaagtattcataatgtttaagtattgatttggctttctgccagtctgttcaaataagcattaataaatttaaatacaaaagcaaaatagacctgagtggtagctgaactgcaaagcaatttgcctatacaaaactacatgcgagaaatacatgctttaggctgggcacgctggctcacgcctgtagtcccagcacttttggaggccgaggcgggcggatcatctgaggtcaggagt

SEQ ID NO: 9190 - DNA, 369 bp, Homo sapiens
cagtgtcatgaaatctgggttgaaggagaatacagtatatatgagaacacttaaagttcaaatagaaatcatttctgaagacaaaagcagaggaatattgtcagtgccaagtaatggaagaataagggcggcatttacactgtgcaagtattgagaagagtgcataaagacagggaactactctcatggagacagtttctctcttataatcaagtaactagaaggggaaaaatcatctaagttatgaaatccaacataggcgctatattacaaactgtgccggattatgcaaattgtagttgttactgatcaaagtttaattgcttcatttttgtttaaaaagggatactgatgtcagaaaatctgtaa

SEQ ID NO: 9191 - DNA, 380 bp, Homo sapiens
aacatgcaagaccagatggctaatctaaacagagagaaactctaagaaagaatcaaaaggagttgctagaaatcaaaaacactgtaacaaatgaagaatgcctttgataggctcatcagtaagttggaaacagccaaggaaggaatcagtaaggaaagaagacatggcaataaaaacttcccatgctgaaatacaaaggaaaaaaagactgaaaaaaaggaacagaatatccaagaactatgggacgatttcagagtataacatacatgttattggaataccaaaaggagaagagaaaaagaaggagaagaaatatttgaagtagtaatggatgagaattttccaaaattaatagcagataacaaactacagatctggga

SEQ ID NO: 9192 - DNA, 313 bp, Homo sapiens
atagctgctttttcactcgtggtcctctccccatcccttgctctgaccccagagctctgtgtatttgbcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagacaaaaaaaaaaaaaaaaag

SEQ ID NO: 9193 - DNA, 349 bp, Homo sapiens
ataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggcc

SEQ ID NO: 9194 - DNA, 371 bp, Homo sapiens
cttagagagttgaaatcaagtccaaattctttactgtgtgtaacattcaggatcatcaagtgatctgaattgaacctatttttccaacctcatcttcagttattctcaagccaaactagactcacccttctggaacatagcctactttacagttctctctatcttaattaccttaaatacattacctgccaaaatcttatctctttttaaactaaagaaatgtgacattttctgggttttctatagtttacatatatttgtaatataagatgtgggaagacaaatgtctggataagaatgggggtagggggattgcctgacaggtgggaggttgtgtggggagactaatgtatacatggagtgagaatggc

SEQ ID NO: 9195 - DNA, 167 bp, Homo sapiens
acagttggtggtaagtatttggctttatttctgggttctctattctgttccattctatgtgcctgtttttatgccagtaccatgctgttttggtaattacaggcttgtagtataattagaagtcaggtaatgtgatgcctacagatttggttttttttttttttttk

SEQ ID NO: 9196 - DNA, 283 bp, Homo sapiens
tattggatacttaccaggtgtgcagattacaccagcttctttggtttgtatgaggcatacataatggaaagccctgccctaggatagctttcaatgtatttgagaagtccagatgtataatgaaaccagaagacatttgaaaagcaaatgaacagtaattatactgaacaaattttattatatgcaaagtggccctgaagatgtagaataaaggagtgacctgcttagtataggctcagtaagaaaggcacatcttgttggatgggtgagttttgagctggay

SEQ ID NO: 9197 - DNA, 418 bp, Homo sapiens
cgtttgcattttaaaattaaagttttcaatagttttcaatacaacaatgatactatctcaaaatactcagcatgtctaacaggcctcttttaaaagctcagcatgtttaatgtaggtgttgctaacgtccaggtggctcctataagttaagggtccattgatttagaagttctaaaagagactaacctaagggataccaataacagatatttttaaagaatttcatagaggagatacacattagaaacccagaactctaagatgtgcatttgctaagtcctgtaaacagacaagaaaacacatttacattagtttgccctttaaagattatttcctacttgtcycttatcaatgkgagtacataaaagagaccttattacaattaaaaacaatgatggtttagcagcagatttagatr

SEQ ID NO: 9198 - DNA, 383 bp, Homo sapiens
cattacatgaagtccagtgttaggcaggcaggagctgctcccgtgactcagtgacatcaggttggtccacatcctagcagttctcttggtgttcctgcgtgatcaaaggatgactgccacaccccagcctgctgacctcagccctggcgtgggcataggagggtctgcgtggctgagcatccagtgtccttcgtactgccactgacagcctcaggcctgatttccagcactgtctgtccaggagcaatgggagcaagagtcactccacaagactctggaggcctgatagacaaaatacatgaagaccagtttctacacagagaatcactaaaagatggccaggcgcggtggctcacgcctgtagtcccagcactttgggagac

SEQ ID NO: 9199 - DNA, 415 bp, Homo sapiens
  misc_feature 415: n=a, g, c or t
agcacccgccaccgtcgccggccgcccgcacgtccgtccggagctgtgactgatgagaattaaaggccatggatgaagatgggcttgaattacaacaagagccaaactcattttttgatgcaacaggtataactacttgaattgttccacttcccatctaccagatttggagttggttgtcatcaatgaattgctagaactctcacattgatcattcacaggttatcttgttatcctgtcaaaattcacaggtgttacggtgagcacattattattaccctcctcaaagatgtggctccctcacaaccaactctcatattcttgtcagtaacagcagcaatatcaaaccttagttttatcttcagttatgaagataatatcttgacgagttatgtccctaattcctgttgttttn

SEQ ID NO: 9200 - DNA, 446 bp, Homo sapiens
ctgaagaggctgagaatcccgacagtaaggggatgcccagggcatgttggaaagggttttggggggaacagtgaaagaatgatttggaaagagcaaagtatgagggtgattttttggaagagatcagtgtctagagaagcagaatactctgctctaagcctgttctgatttagagagatttccttagtcatcagacttgatcctgggaaaactagtcaagtatagaccttgtgatgttcaactcacacagcttagctctgtatctactcaccaagacttcttagagacttactcctattgtctgaactttaatacagacataacttgttttttcaaatttaagttagcattttgttttatgattataagagtactatatgctcttataaaattcaggccaggcacagtggctcacacctgtaatcccagcactttgggaggccgag

SEQ ID NO: 9201 - DNA, 420 bp, Homo sapiens
agttccccggggcggasgaggcggcggccgccgmrccrgabggawwttcctcagataggcgactacatctctggaagcagcagctccatgctggatgtggtggaagaatcgwgagggaatggactggaagtttggaatcaccggamaataacaaggcatagctaagctgtgactagcaagataaacgatttgttcgaggtttgattgtcctttccctcctccactcggaagacatagttgtctttttttaaatcatgttttgtaccgaaatatttktattttataattgaatccctgttgttgggcctttaaaaacccatagaaacattgttatgtgccacgaaggtgggaaacacggctttctcagtcattgctgtactcccacaattctgggtcatgcacacaatacaggtttagtaa

SEQ ID NO: 9202 - DNA, 442 bp, Homo sapiens
tcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattgatctgtaaaaacttctttaatctacaactgtttacaaaaacaacattcaaacaaatagtacagatgtcagtgacagaacaaaatgacttttcttggagacattccagattgccatattactttattttaaacagcgctatgactttaaatccaaggctgctcggaagatttttttaggtctctcataagcctattcttccctgatcacatgagtgggaraggtagccaaattttgaatt

SEQ ID NO: 9203 - DNA, 414 bp, Homo sapiens
cactggttggcagtctgaaatctgcttttatatttgatgaaacagttgatattgaaccccatttctgaacttctaattctattaaaattaacattataatcatgcatattcctgtgaccgccccgccacaagatataattggtttgttgttgttcttaattttcaacacctttgttttaccacatagccagaatgataagcaatgctcactggatccaactaggagttggaagtaaattataggtagccatctggtaaatatacacagccaatgagttgttcttagaaaattgtcaaatttagatttttcttccagattaaaaaaaaagacagccaggcatggtgtctcacacctgtaatcccagcactttgggaggccaaggtgggcagatcatgaggtcaggagttcaagac

SEQ ID NO: 9204 - DNA, 423 bp, Homo sapiens
gtttggaaattggttctattagaaaacactgtttgcacatccaaatgttcccagtcaagatttcccaatagtggcagtgagaaagagaggcagagagaattaggatacttgggttcaaattttagcttagtcactgatgggctgattgagtgagaagaacttaatcacctgcaaaatgaattgcttacagtattttgatctctaaatacacttttgattctgatatttaatgattttgtattacaaaattgggcagaaaacgcatagcttcataacaagcaaaaattttactgttaacacatcatacttattttagagtaaatttgaaggaggttgatgttttggaatttggttggagagttatccaaaagcaatgtttccctgactcaactacaaccaattacacacagtggccagtaggaa

SEQ ID NO: 9205 - DNA, 149 bp, Homo sapiens
gtagttaagacgttctaggcartaccatagacacatctgactgtgtctctctctttgagtgcaagaaactcaagtcatcttaaaaaaaaaaaawtmcaaaaaaaatttwcaaaaaamcaaacmcmcaaaaaatatcttttttaggccar

SEQ ID NO: 9206 - DNA, 89 bp, Homo sapiens
cagcattaatgtgtaatttaaatacaataaaactcacatatttcacatgtacatggctgttggttgtatacatccaggtaataatcaag

SEQ ID NO: 9207 - DNA, 378 bp, Homo sapiens
cattagaagtactcaccgtgtcaggatctttccacttatgtatttggaggaagtaggccctcatgcctggcttataagttgaatttttaaatgggtattaagaaaatagcattcaaccagtaaggttaactttttaaacttttttaaattaaaaaaaacaattttaggccacgtgtggtggctcacacctgtaatcccagcactttgggaggctgaggcgggtggatcactttaggtcaggagtccaagaccagcctggccaacatggcaaaaccccatctctgctaaaaatacaaaaattagctgggcatgttggcactcgcttgtagtcctagctacttgggaggctgagacatgagaattgcttcggtctgggaa

SEQ ID NO: 9208 - DNA, 473 bp, Homo sapiens
tcttcatcgagcgccatggccgcagcctgcgggccgggagcggcgggtactgcttgctcctcggcttgcatttgtttctgctgaccgcgggccctgcctgggctggaacgaccctgacagaatgttgctgcgggatgtaaaagctcttaccctccactatgaccgctataccacctcccgcagctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacgg

SEQ ID NO: 9209 - DNA, 448 bp, Homo sapiens
aatatgagtaatgcagtggcagatcttctatgagaaattaaaactggagaaagagggctttcctccttgaaggaagggtgttgggtgaactaacactattttctcctgccctttcccccaatctcaatccctttctctccaaacattcttccttcagcaccccactctggcactcaaaaagccatgggaatgggaaagaagtggctggaagtaaacagcctgcttactcacagcaactgaaaattttgtttcgacgattctggttccaggggcaggagctgaagattaatgcctggagtctgccccattctgagagcagcagcctggctcctggtggctccagcagcagctcctcacatctcctagttctggtgaaatatgctgccatgggggaaatgacaaagcagaggaagaaatcagcagcaatatcagtaacagcacccagaat

SEQ ID NO: 9210 - DNA, 434 bp, Homo sapiens
taatggatgttaaaattttatttctttgttttggtaagtagattaaatcgagaatcatataatcagtacatttgagaahkatataaccagtatataataatactggacacaaccatttgccatcttttcctgttatcatcccatagagtgggtggggagaatgaatagacataaacctagaataatgataaatggtttttaaaactctatattgaatacattccagctgataatgacttttctttttcaccttggtgatatcagcctcagggtaaaaaaaaagtttcataaatcttttagttataaacaggaaagttttatattagtggtgtcatttcatttctagactgttgatggtgatgatgataaagaatttggagccaattttgatatatgaatgtwtkgcttttacatgtgatgattaaagctcttca

SEQ ID NO: 9211 - DNA, 369 bp, Homo sapiens
caaaaaatctgaccaaaacaaacaaacagaaaacagaaaacaaaaaaacctctatgcaatctgagtagagcagccacaaccaaaaaattctacaacacacactgttctgaaagtgactcacttatcccaagagaaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtagcctccaggtttccttaagggacaacatccttaagtcaaaagagagaa

SEQ ID NO: 9212 - DNA, 361 bp, Homo sapiens
cttttttaagatgatcttgctccgtcacccaggctggagtgcagtggcgtaatcatggcttcctgcagcctcaaactcctgggctcaatgagttccttgagatcttccatcctcagcttcccaagtagctagtagtagtagtggcttgcaccaacgctcctgccctaattttcaatatttttttgtagagatgggatctcactgtgttacccaggctagacttgaactcctggcctcaagcgatccttccgccttggcctcccaaagtgttgggattacaggcattagctaccacacctggccaaggcccaggtttcgacagaaagggagagaaaacctgccasagatgscatttcggagc

SEQ ID NO: 9213 - DNA, 457 bp, Homo sapiens
actactgtcttcacatgttgttcttaaacttttcccagtttgatggaatattagttaatcctatgattaggcctagtacttttggaaaaacaaaaaagatctacctattacatgggctggttaaatccagatgggggtattccccagcactggttctattaacttctatggggcagttaaataatgttttaagtagtgtacttgtccttcctatcagtatcagcagactaaagagggccagccaacttattcttgacgggtacagaaccaggagttgcaaattcaaaagccttcactaggcaggaaaaagagatgtatgcagcttcccagcagaggtccacaggagagaggaaaacaaactgcagtgtgtctggtgattataaagttcattctaggtataaggaaccggagctaggtattcattcacggagctcacagtcttgttctgaagattaga

SEQ ID NO: 9214 - DNA, 388 bp, Homo sapiens
  misc_feature 140: n=a, g, c or t
aacctgctcgggtcacgttccacacagtggaagctttgttctttcactctttgcaataaatcttgctaccgctcactctttaggtccatactgcttttatgagctgtaacactcacctcgaagatctgcagcttcactcntgagcccagcaagaccacgagcccaccgggaggaacgaacaactccagacgcgctaccttaagagctgtaacactcactgtgaaggtctgcggcttcactcctgagccagcgagaccacgaacccaccagaaggaagaaactccgaacacatctgaacatcagaagggacagactccagacgcgccaccttaagagctgtaacactcaccgcgagggtccgcggcttcattcttgaagtcagtgagac

SEQ ID NO: 9215 - DNA, 429 bp, Homo sapiens
atctgcagcttgctggctctctctttctccttctctgtctcactctctctctttctctccctctcctatcggagcacaatgaaagcctgtgtatcgccgtgactccgggcgggagccagtgtcagcaaagcggctaacaacagacgagaaagagaaaggaaaatacaagctactttttttttccatctatagagcggasaaatacaggagatagaaccagattgcttattgcgagtccagaccctcagatccactggccggggatggaatgtacaaaagtggacagaaaagtggctggacatgactcggtgcaatttgctggaagtttgtaagtttgaccatcgtttgtaaattactctcggaagagtttgtctctcttgatactgtattagaatagagccgggggtgaggaatagaaacgtaagcgaa

SEQ ID NO: 9216 - DNA, 56 bp, Homo sapiens; identical to SEQ ID NO: 8337

SEQ ID NO: 9217 - DNA, 465 bp, Homo sapiens
ttgcccgggcgctgggttcaggggctttccgcccctctggttcacagctggacgtcgggagtgctagtttggagtacgccatttgagagtaggcgtgagaagttgctctgtgtgctgagcgttctaaaggaagccgtccgttggccttcgtacccgtcttgattgagctctcacactttggatacgctcctctaatcctgtctgaaagagctaagctgacccccaccaccgttggaggaaactcctggagcagtgctggggttttcactgcaatcagctgctccaactttgtcttgtacatggctctttgaccttgggcttgtggattaggggcctgtggaggagctctgtgactgctctgatatctgtggatggttctgaggcattgtatttagtgaaaaaactggaaaccatatgcatgtccatgaataaaaaatggggcataggcaaaaaaaaaamaaaaaa

SEQ ID NO: 9218 - DNA, 861 bp, Homo sapiens
gtaggcgtctggcagcccggcgccatcttcatcgagcgccatggccgcagcctgcgggccgggagcggcgggtactgcttgctcctcggcttgcatttgtttctgctgaccgcgggccctgcctgggctggaacgaccctgtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagsaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatagtttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggg

SEQ ID NO: 9219 - DNA, 448 bp, Homo sapiens
cttctttttttttttctgaratggggtcttgctctgttgcccaggctggagtgcaatgttgagatctcagctcactgcaatctccacctccctggttcaagcaattctcctgcctcagcctcctgrgtasctgggattacrggcacccaccaccatgcctggccaattttkgwatttttagtagagatggggtttcaccatgttggccaggctggycttgaactcctgacctcgtgatctgcgcacctcagcctcccaaagtgctgggattataggtgtgagccaccactcctggcctatttcttcttgtccaatctgcatgccttttatttcttgtcctttttaaaatttcttttyctttycttattacattgactggattctcgrgtaaaagcaatgaatgaagacatctttgccttgttttcggcaatagbaagaaaaacatgta

SEQ ID NO: 9220 - DNA, 225 bp, Homo sapiens
tcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaa

SEQ ID NO: 9221 - DNA, 452 bp, Homo sapiens
cacttgtgtggtcatgcctagctctaagagaagccaggaaatataaacttattgctgtgattctttttgtgaagaggaaggggatatagtgaggcagccagcattttcatggcagtggcagtcatgtggtctttcttcatcatgtgtttcaaacccagagagaagagtaacagcagctaaaaggtgggtagaaaagagagaagaagcctacaggctacctgtacagatcctagctggggatgcagcaggaagtcttactgtttgtttgatcttctttagagtcaatgthmgacattgacttgaacgttctattttctgaatcacaattattttttgtgacttaaaagtaactttaggactttctgttacctacaagtggccagaaaattatagggcctactagatttttccttgagtagcacgatagaagcataccccctaaatatcatata

SEQ ID NO: 9222 - DNA, 451 bp, Homo sapiens
gttaattacatggggctgaactgataaaatgccaaaataatattttcataacctttttttggtttgagacattgctgatactttttatgttttgttttccagagtcaagaaaattgtttttttcttttgagctgtacatagcttacagtaattagataaattacacttttgtgagaacaattgaaacactaacctttctctctacctgatgtctccagaatttggaaagtatttgtgagtattcttcacttttggcaatatagttatttgtacaaattcgataggaatctgttttcttttgtaacagaacacagttggatacactgattattttgccaagactttcattggaatggcataattttttaatgaccagactgctttgaggatttgaagttgactttatagagcctataaaaagcctgttggaaaaattagcctgataccttgg

SEQ ID NO: 9223 - DNA, 449 bp, Homo sapiens
taattattttagtatctctctgtctgtatctgttttaagctaaactgatatctcttgatctaatctagcatcacatggtttgttctggccttcccccattgtttatctgtagtttcctaatccagtagtaagaaacctggctttcgggcgggtgcggtggctcacgcctgtagtcccagcactttgggagacggagggggtggatcacagggtcaggagatcgagaccatcctggctagcgcggtgaaaccacgtctctactaagaatgcaaaggattagccgggcgtggtgatgggcgcctgtggtcccagctattcgggaggctgaggccggagaatggcgtgaatccgggaggaggagcttgcagtgagccgagattgtgccactgccctccagcctgggcgacagggcaagactctgtctcacacacaaaaaaaaaaaaaaaaag

SEQ ID NO: 9224 - DNA, 277 bp, Homo sapiens
  misc_feature 200: n=a, g, c or t
cattctttttttttcytttttgaagacagagtctcactctgttacccaggctggagtacagtggcacaatcttggctcactgcagcctccaccttttgggcttaagctattctcttaccttagcctcctgaatagtggggactacaggtgcacaccaccatacccagctaattttttttttgkgtatatatatataabbnbbktttgagacatgcagttttgccatgttgcccaggctggtctcgaattcctgggctcaagcgatctgcctgtcttr

SEQ ID NO: 9225 - DNA, 97 bp, Homo sapiens
tatggatactggstccasctgyttgkktctcttgctggggtttgtgatacccgtagctgtggtyttctgtagtcasatctctctccagtkttgggas

SEQ ID NO: 9226 - DNA, 355 bp, Homo sapiens
atgataaaactgaaacccataaagggtaagggatttgccgaagtcacacggctaatgacagagctggtggcaccagaagaagtctacctgttctttgtatgttttaaatagctttattgaggtataattgatcagcaaaagctgtacatatttaacgctcacagtttcgtgagtttaatcattgtgcctctttggttttgggggcggtttgggatttttttgttgctattgttataagaacacttaacatgagatattccctcttaacaagtttctaagtgtacaatacagtattgttaactataggcacttctgtttctccaacagatctgtagaacttacacatcttacataa

SEQ ID NO: 9227 - DNA, 447 bp, Homo sapiens
tccttagtgtcagaacagtacttagcacatcataagcactcactaaatatttatcaaatgaattaacgttggagatgagaggaaggaggaggtaataatggaaagaggacaaagaaagagaggcaagggaagacagaaagaaaacagatttggcctccccacattttctgggcacagatataacggctctctcttgctctttgctcccaatcaaaactcagccagcctcatgtccaacatctcatgggcttgcctccagttctctgcactttccaaagtgatagctgactaatcaaagatattgtgataatgaattgcctaactacgcagcctgccttcttctcttctagcatgtatttgattaggggcctgctgaaaccaattaagtaaataattcagtatgactttatgaactacctactacatgcatggcttaacacaggcagc

SEQ ID NO: 9228 - DNA, 371 bp, Homo sapiens
cattagtctgtcttatactgtaaataaaaatgaaagcaccagctggtaaagttttcaaataaagacataaataaggtttgatatgactcagtgtggtatgttccttctcttcctaggaaactgaaaaacagagtagcagctcagactgccagagatcgaaagaaggctcgaatgagtgagctggaacagcaagtggtagatttagaagaagaggtaaaactacttaaggtcaaactcttttatccattgtatacccttccttggtgaatgttctgatatttgcttcccatcccaagttgtttcagcccctattagaatacaattgaatatatgattaaaagttaaactaggctgggcatggtggctcatgc

SEQ ID NO: 9229 - DNA, 384 bp, Homo sapiens
acctttatttttgaccagcttcatttgtcagctttgctcagatcagatcgatgggattggaatacattgtaactaaaatcttcctcaggactataaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtaattccatcattttgggaggccacagtgggcagattgcttgagcccaggagttgaa

SEQ ID NO: 9230 - DNA, 379 bp, Homo sapiens
twrgtttttaaawttsyttttttymawarggwattwawaaakttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagaaaaaaaatgaaatggttgtttactaattttatactcccattaaaaatctctaatgttaagaaaaccttaaataaacatgattgatcaatatggcagatgatttacagtccattatatgacatttgtargccactmaacacta

SEQ ID NO: 9231 - DNA, 409 bp, Homo sapiens
  misc_feature 409: n=a, g, c or t
tatgagtcaggtactttacaaggtgttcaatggacattatctattttacttatttttattttatctttttggtttactttttttctttttttttcattttacattatctattttaatcctcacaatatccctgtaargtaggtatattaccttcagtttccagatcaagaaactgaagtgcacagaagtttgaagtaacttactcaaaccacttcactaataaccagggtaggcaggactcaaatacagacagtttgcctccaaaatacatggtcctaatcacctcccwatgttgtgtccatgcagtcacgagtttggcatgaggagagctggaggaagagcccaggagacagtgaagaggaatcaagaggctgtatatgtagccagctgggtttgggggcactcatan

SEQ ID NO: 9232 - DNA, 408 bp, Homo sapiens
  misc_feature 131: n=a, g, c or t
attgctcgcgctgtgaccccggcttgaggtaacaccgcgagctgaggctggggcccttggcgcggaggctgagggacccgccgcggcgctgtcgccggagagggagggcaccgctgtcgtcggccagaagncaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggataggccctgggtcccgggatgcccctgcccgagcccagcgagcaggagggtgagagtgtgaaggccagccaggagccatcccccaagccaggcacagaagtcatc

SEQ ID NO: 9233 - DNA, 427 bp, Homo sapiens
  misc_feature 378: n=a, g, c or t
aagacggaggttgcagtgagctgagatcgcaccaggggactccagcctgtgcaatagagtgagactcggtttcaataaataaatgaacaaactggaaatgacattttttccawccatttaaattcatgttgaaaaattttagatgtctgtttaaatgtgtgagggcatatatagtttataaaaatttaatttatagcaggtatatgtgcagaatttttttgaagatgactaatctatagcagggtttctcaacctcagtgctattgattttttggactgggtaattcattgttgtggggaggctatcttgtgcactgtaggatgtttatgagtatccctggtctgtastcrctatatgcccctagcagctccccagtnacaactgaaaatgtttccagaccttgccaaatgtcctctggggagtaaa

SEQ ID NO: 9234 - DNA, 425 bp, Homo sapiens
  misc_feature 390: n=a, g, c or t
tccccaggcagcctgatttgcttctggatttttattctgttccattcacctgtccttgttcttatgccaggatccacaccattttcattaaagaggctgtatagaaaattttaacgtctgggcagcccattcccctctgatactctccagggttttctcaggtgttcatgtttgtttctctaagtgggttttatgatcaacttgtctagcaccctgagaaagaaaaagatgatgtgtttattggggctccttaagtgtatgcattaattcagggagaactgatgtctttgtcatgtggagcttccctatctaaagctatcatataccttttccatatgttcaagtcttctgtgtctcaggagtattttatagttttcctcgtatcagcanttattaaacgagaatgctgaaaaaaaaaaaaaaaa

SEQ ID NO: 9235 - DNA, 438 bp, Homo sapiens
caaaataataatttacaaagatgcatctttacccattattttaaaatgattaaggaggatagttgcttcaggtaacaagctaatttttcaaatattaggcccttacagaactatttagtcaaaaagtaagatattcctwwaaaatatataacccaaagctttcagttaaacatgatatatcacaaatactattaaaatgttaaagagaaatgcaaatagcattaaatgatgaccaaaatgtaaaatattgtagatttcaaaagctgtgtctctattaggtgggataccaaatgtatgatgtaactgacgttgttttttactttttactttttaaaaaagactaaaaacgttttgatattatacaatgtatttgtttcagataaggtcattgtcatttagtatatataattaatatatgtacaagtttaagtaaattcc

SEQ ID NO: 9236 - DNA, 435 bp, Homo sapiens
ccagttttctgstrggagtccggattctggtgctttgctccgaagcagtgcccgtgggcctccgggcctggctcatcatcacagcttctctgctcagtgaggagaccatcattgtgctgcttttctgatgccttccatttgcctttttctccacttgggaaaaacaaaaaaagctagtatgctacatcctgaaaagttgttaatccttcaccaccacatacattgaaaaatcagttcctgccgggaagtaccactaaaggcatattgtaaactttttttctaattggaaaggtaaacttttttcccccataactatttttcgtgtdaaggaagtamygagctcttgrgtcaaagarratggcactcsgagtttttccccawgggtcttgcctgctamactcctggccaccctttctgtggggcttgaccaaatgg

SEQ ID NO: 9237 - DNA, 88 bp, Homo sapiens
tatattattttcacttatttcttctttaatgtttttcctttatatagatctcagcttctgacctatattttccttttttttttttttk

SEQ ID NO: 9238 - DNA, 455 bp, Homo sapiens
caataaaatgtgatagaaagtagtctgtgcgttgttagcgccttggtgtcctcttagtggaatgctgtaacctctcctattcagatctcaagtctctggtgaaattttccatcttctagttttttgaacataattctcatagcttttttaaaaaagtcattctctgttaaacatagaattatcatatgctctagcaatctcacttctgggtatatacaccaaagaactgaaagcagagacttcaacagatatttgtccaccagtgttcatagcagcattactcccaagagccaaaaggtggaggcagcccaagggtccactgacacctggatatgaatggataaacaaaatgtggtacatacatataatgggatattattcagtcttaaaaaggaaggaaatgatgatgcatgctacaatacagatgaaccttgaaggtacattatgttaagtga

SEQ ID NO: 9239 - DNA, 126 bp, Homo sapiens
cacatttagattataagtaagatatattgcaaaactgtagtaggcagccaatatgatatacctgcttatgtatagcagatgactgagaaaacttcaggtaacctattttaaaaaaaaaaaaaaaat

SEQ ID NO: 9240 - DNA, 510 bp, Homo sapiens
gagttttggatctcagctcctttgagagttgtggaccagtcagacacaaaattatctttaaatatacagatagggatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagattttagaaatcttgagctgtgtcttcagtatgctgtctgtgaaataaggctatcattgcgtggcagccaagattttcaccagattgtgattcccttatgaccatttgccttcctgggtaggaagtgataaatggcctgataacaaacctggcaaagaaaacggtctcgacaatgagtaggccacccatcactactaactacagatgacttgccatttcatttacaaagatgtcttctgctgctgaaaatggagaggcagcacctggaaaacaaaaaa

SEQ ID NO: 9241 - DNA, 483 bp, Homo sapiens
  misc_feature 440: n=a, g, c or t
acataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctcntttcctttcctaaaattggggaagtacagcccatgctgacatt

SEQ ID NO: 9242 - DNA, 496 bp, Homo sapiens
atttcatattttatttatttgggtcatctcccttattttgttagtctgttaattttgctcatctttaaaaaaaaccaactttttgtttcattgatcttttctttatttcaaattcatttatttttgctctgatcttcatttcttttcttctactaattttggtttggtttgttcttgcttttctggttctttaagatgcattgctggctggatgtggtggctgatagctgtaatcccagcactttgggaggccaaggcacgtgactcacttgaacccagaagtttgagaccagcctgggcaacatggtgaaactccatctctaggaaaaatacaaactagtcagatgtggtggtgcacgcctgtagtcccaactacttgaggggctgaggagggaggattgttgagcccaggaaggtctaggctgtagtgagccatgatcatgccactgcactacagcctgggcaacagagtttctctctatctcaaagaaacaaa

SEQ ID NO: 9243 - DNA, 214 bp, Homo sapiens
  misc_feature 12,128,159: n=a, g, c or t
ttgtctagcccnagtgcaggtgatacatgcagttatcatttattgagcatgtaccgtgtgccaggcactaaattatgtgttttgtatacttttcatgtaatgtttgtgatagtgtaggtcattttatncccactttacatgggaaaactgagactacangamataattagcctagttcttgctgaaaaaaaaaaaaaamaaaaaaaaaaaaaaa

SEQ ID NO: 9244 - DNA, 439 bp, Homo sapiens
tactcaaagaagtgtagaacagatcctgtggaatttcttttcaggactagtaacagtataattwtwgcttgtacacaaatcaggttttttccccccaccagaatgccaggttaaattatttcaagtctataaaaattgtttgttttggccaggcatggtggctcacgcctataatcccagcactttaggaggcctaggtgggtgaatcacgaggtcaggagttcgagaccagcctggcctacatgattgaaaccccgtctctactaaaaatataaaaaattagctgggtgtggtggtgggcgcctgtaatcccagctactcgggatgctgaggcaggaaaattgcttgaacctgggaggcggaggttgcagtgagccgaaattgcgccactgactccagcccgggtgacagcacgagactctcaaaaaaaaaaaaaaaa

SEQ ID NO: 9245 - DNA, 472 bp, Homo sapiens
caattctattttattgatctatatgtctatgtttatgccaagaccacatagtcatgattactgtggctgtgtagtaaggttttaaatttagaagtgtgagttctttaacattgttctttttcaagatagttttgactatttttggtccctttaatttccatatgaatttcagatcaccatgtcaacttctgccagaaagacagctgggattttgttagacattgcagttaaatccgtagaacaatttgagggaatatttccatcttaacaacattaggtgttctgatacatgaacatggaatgtctttccatttatttaggtgttctttcatttctttcaccagtgttttgtagtttccagtatacaaagtttgcattaattagttaaattcatttctaagtattatttttcagaccattgtacgtgaaacagtgttctttatttttgcattgtttattgctagtgtataga

SEQ ID NO: 9246 - DNA, 409 bp, Homo sapiens
aaaataatgtaaaaatcctctataaaatattagcaaactaaagtcaacaacacatcaaaaagatttcatatcatgaacaaatgggattcatccctgacatgcaaggctggtttaacatatgcaaatcaatcaatgtaatatatcatgttaactgaatgagagattaaaaaccacatgattgtctcacttgatgcagaaaaagcattcaacaaagtcaaaaatcctttcttaataaaaactcttaacattttaggtaaatacggaaaattcctcaacataataaaggccatttggaaaaactcaccgctaacattagaatcaatggggaaaaactgaaagctttttcattaagatccagtatgaagccaggttgtctactctctttaattctattcaacatagtgttaga

SEQ ID NO: 9247 - DNA, 398 bp, Homo sapiens
  misc_feature 328: n=a, g, c or t
cagaaaattttggtttcagtccaggcactgctactgaaaaactttggtctaatcactttatctcaataagtttcaattatttctcttataagatggggccaataccacttgcttttctaccctaccagagattgtagctactaggaagaatggaaataattgaaagctttaaaacaatataaatggaaatgtaccccatcttaaaaaaaattagccaggtgtgtttgtagtccccgctacttgggaggctgaggcaggagaatcccttgagtttaggaggttgaggctgaagtgagccatgatgatgacagtgtactccagcctgggngatagagcaagaccttgtctcccaaaaataacccctaaaarggasgctgaggcgggggaattgcttgaac

SEQ ID NO: 9248 - DNA, 387 bp, Homo sapiens
ctttccggttagcagtcatgcctttccaaagatttgtccaaactggtcgcattgcgaaatgctcggctggtcccttgaagggacgtctcgtcgctattgtcgacgtgattgatcaaaacagagttcttgttgatggtcctttgactggtgtcccccgtcaagaatacagattgaacaatctgcacttgaccaagtaccgcatcaagttccccttcactgcccccacccgcattgtccgtaagcatggcaagacagtgacatgaaggcccaatggaaggtcagcccctggtccacaaggtctcaaaacatctgcaagcgttcccgtttgaatgatttcgatcgtttcaaattgcgttatgccaaacgtcaacgcaacaagttgctcac

SEQ ID NO: 9249 - DNA, 509 bp, Homo sapiens
tagcgcttagacacggttcctttactaaagaccatttgtaggagattaggtgtcctttttttccctttcatttcaccgtctaggaagcgaaatgccttgttctataggcactaaaccaccacccctaccaaacctttctcggggaagcagaaggggaacttgtgccttgtgaggaagcgacaaaggccccttctggccctggagacttcacgccaatggagcaccagctctctgtcctcgcaatagcccgagtgcaggcagaacgcagtcatttgtgtttatctgagaggagctttgggatataaatagtttcaggccccgctgcgctgtcattccagcccagcctcctgattgagctgcttccgggcgggctttcttcttgttggcggtcccatgctgtgttcagatgggctctgtgacaggtttggatgttttctatcactgaataaaactttccactttggaacatattttctacactctattatctcatgtaagtcctgcaacaa

SEQ ID NO: 9250 - DNA, 203 bp, Homo sapiens
cactgtggttttgtattgagttttgaaattagaaagtgtgagtcctccaactttgttcttctttttcaaaattgttttgtttattctgtgtcccttgcatttctttgtgaatgcagggrtcatgttgagactgtagatcatttgggggggcattgccattttaatggtattaaaaatcttctcatccaaaaaaaaaaaaaaaa

SEQ ID NO: 9251 - DNA, 440 bp, Homo sapiens
  misc_feature 289: n=a, g, c or t
aaccttatgtaacttgtgttacatcaagtaacaagctaatctagtttgtttcactggactaggcttgtgctccctacttcagtattttgatgctttccttgatctttgtttcacaaaatgttgtgaattttggtatcattcaaaacaaatgacatttattaggtbtcattttgaaacgatgtacagacaagtccccaacttagaaaccggtttgttcttaaggttcttgcgtcasccatggaagcccactgacctmcaccacagcccaaatggagggctgtggtggccngatctggttggcttttgtgggctgacccagacatttaatcaccatctcttatgttgttgccgtaagaaatgcattccaggttgggacttgggatcctgagagcacattcgccccctgtggtggccgcttgccaccttgcaagatggaagcc

SEQ ID NO: 9252 - DNA, 163 bp, Homo sapiens
caacaaaaaattagctgggtatggtgtcacgtgcctgtgatcccggccgctggggaggctgaggcaggagaacctcttgaacccaggaggtggaggttgcagtgagctgagattgcgccactgcattccagcctggggtgacggagtgagactgtctcaaaag

SEQ ID NO: 9253 - DNA, 376 bp, Homo sapiens
agaaggcaacggscccgtggaaagtaatgcagtactcaccaaggccgtcaaaaggcccaacgaggattcagatgaagatgaagaaaagggagccgttgtcccccctgttcatgacatttacagrgcacggcagcagaagcgggattcggtagggttttaaacgcctctgcagaaaactcctgtccaggattccttttgcctcaagtggtatgtttaaaagagacaacgctttgttacaaggttcttggaaacaaagttgtattgtcattggtgcctctatcacatggttcttgagaaaaaacaaaccaacctgtgtgaattttagaatacggaacagacctatgctctaagcaaaattaggttttcaaaaatgtga

SEQ ID NO: 9254 - DNA, 441 bp, Homo sapiens
ctggttctcgtctctgccctgccggagactgggacatccttttctctccctgggtctgtgtccccgtcgctacatcccagcctggagggcatggcccagcggttgcataggtccctcggtttctgcagagcccgggagtcaccctattttggtaaaggtgaattgctcctccatgggtcgtgaaagaagatcatgtcagtggtggtgtttctgctcgtctcagaagggaagtctgtgacccgtgggagttgctggggagggcctggtctgggccaggcctcttctttgggttgccccctcacacactctggtcatccaggaagcctctgtggccctcggaatgtgtaaaagatggtggttttaggagctgctggttttgcaactgagtgctgacggcttatttcttgttaatgattctgtcaaaagtgtcttagcgatgsc

SEQ ID NO: 9255 - DNA, 402 bp, Homo sapiens
tagacatgadatagagttccaaagtcaagttaacctatttctcattaagatgtattagtttcagtgtatcttgccctgctaraaacaatcttttttaatgctctatgttttgatctatttaatttttttaaaaraarcataataggrgtttccagtatggaaaatctggttgtctctaattcagtctctttatactaagtccagtagatccattttaagagcaggatagacctttttaaggtgaatatctttcagaggggaacacagtgtctgatgtatgctgatctaaatctaagaagttttttccaatctgagatctcttgccttacagatactgaaagcatcagtgtttctcttttctaaaattttcacacaaatttcagtcctgatggtgtgattttt

SEQ ID NO: 9256 - DNA, 531 bp, Homo sapiens
catttattgcccagtccatttaaagacccatgcaagagcctggtttgtcatccctgccctagcccaatctgaggctaagattggtaaactgtaagcccacacttaaccttgtcaataggttcttgaaaacttgtacttcaagagaaatgatgtataacaaaaccatactttttctcatcagttgttacaaggaaaggatgttgaacaaaaggcagttatttgaggactggctatacactgtttcacgtaaaagttggagttttcattgttctattaacaatgttaaatgaagacttactgtattttgaaaaccatcattaccttctccataccatttggctcccaaatttaaataaacaagagaaaacggtgttcatctattaaggacctgcagggtctgttcatctctgtggctcaacttaccattgcttttttgcttgaaaagcagcacagatgcaggaggaaaagtgattggcgcatagactgtcgccaccagggccatgtcagcagtcaggaatctctgcaattatg

SEQ ID NO: 9257 - DNA, 402 bp, Homo sapiens
atgggaracatatttagaatagaactagtaacacaaaggcaagcggaasaaagctatgtcatgaataagggtaagacattgcacaaaaaaaatccaggctcaggctaactattgcaatcaagttcagagtgtatcacttcctggtagccaaagtaaagagggaaatacaatgagttacttctctctaatgaaagagcaagcaactttctccaacgtgaagaaggggttttggctgataaaaggatcagtaaggaaatcttctggctttgtaaattatgttcaccttattggttcaacagattgaaaagtaaaggcaaccggccggggcgcggtggctcacgcctgtaatcccagcactttgggaggccgaggcgggtggatcacaaggtcaggrgatcgaga

SEQ ID NO: 9258 - DNA, 461 bp, Homo sapiens
caacgagtgatgatgaaatccctaggaaaaggccagaaatttggtctcgatctgcaatagttcactctagggaaagagammatattccacgaggcagtgtccagtttgctcaggaaatagatcaggtatcttcttcagagatgawacagmagatgaaagatctgaagctgaaaacgttgcagaaaatttctctatatctaacccagctcctcagcagtttcagggaataattaatttagcttttgaagatgcaactgaaaatgaatgtcgtgaattttctgcagataaaaagtttaaaaggtcagttttactttcagtcgatgaatgtgaagagctgggatcagatgaaggagaagtccatactccctttcaggcttctgtagattctttttcacctkctgatgtytttgatggcatttckcatgaacatcatggaaggacctgctattccagattctcac

SEQ ID NO: 9259 - DNA, 504 bp, Homo sapiens
aattgtgtgttcttatccttaaaattggcaatactaaaacctaccttatggggtggtcacaaggttagatgaaatcatgtatttgaaatttctatgtgaattttaaattactataaagatgggaaatgctgtttcaactttggttctacatccctattcccagtggggcagtcctagttatcataaaatgatatttttctcttgttgaaattaaacttgctcttatgacctttaacttttgcacaactgagaaccattaaaatagatttcctggatacagtgattgtcaaactatgggtaaagggcactggataattgtaggttggttcgttggtttgttttaaggaatattttkatttttcaaagcactatarracaaattkkcttagaaggtctggaatatgaaaatcatagccatgaacatttgtatgcttacaaagctgccaaatgatgcatggctagtgagtctcagagtatttcactgatgctcaaatgctgcttgtc

SEQ ID NO: 9260 - DNA, 291 bp, Homo sapiens
tttcattcacatttcgtcttcgtgtttcagatgtaaattataaggggttttaaaaagaggtggttaaatatgtgtacatgttaatagtgtgatcaagccaagaaggaggcctttgtctttgactggaggactcagaggaattttaattttgaaactcgctgattcacagcatagtcacgctcaagttcattagcacatttaaatggcagttttgtttcctcttctaagagtttacagtaaggtaaagaactcaaacttcctttcagagcaagtagactttttttttttttk

SEQ ID NO: 9261 - DNA, 590 bp, Homo sapiens
gaaatatatataaaatagaaaatcaaaacaagacctcatctaagatcatttaagctcaggggattttcctctacccactttcctctacccagtgttgtgttttctgtggcactgtttaccagttaacaggccactgaaactcaggatattctaatgcacattcaggacataaattgcattagttgggcagtacttggataaaactaggatgctccatggtgtcttactagatatcataggggtaacatcattttgcttatcatttcatcaacacgtttgttagaaaagagcccatgatgatcttacttttctagcttactbatatcacctaacagtttttgaagtgcacttaagtgccatttgttttcgaaaaataaaaaagacattaaaccacaccataagccataagtactaataaaggttgatagttgggtaaacttattggggaaactctaattattgcacggtgctcatgtgggactttaataaagtacattaagagtataggcctgaactgaaaattttcattgagaagttcatgagaataaaataaaatcataggtgattctttccaacatcattaaatatac

SEQ ID NO: 9262 - DNA, 519 bp, Homo sapiens
atctttgtyttccttycttgagacagagtcttgctttgtcacccaggttggaatgtagaggcacaatcatgtctcactgtagccttggcctcccagactcaggtctttttttatcctcttaatttgtttcaaatgtatatgatgttgaaagcaaaaaaaaaagtaataatgtgtgatttatatgtagatgtaatacatatggcaactatatcagaaaggactgggataggcaggtaaatagagtcatatggttacaagtttcttaacatttttcataaattgtatgatattaactctaagtagagttaatatctactagagctaatatctactcccatgtatagttcctaaggtccctcctgcttcagcctcctgagtagctgggaccacaggcgtacatcactatggccagctaatttttaaattatttgtagagacagtgtctccctatattgcccaggctggtctcggactcctgggctcaagtaatcccagcactttgggaggccgagacaggcg

SEQ ID NO: 9263 - DNA, 466 bp, Homo sapiens
catgattagaggaatgaatagtgctgtgttttaactttgtaaaatacaactcatgattagaggaatgaataatgtcaactcacatctctgtgactagatgcaggcttcttaggatatttgtaacttgaagaaatctggaaggacctcattctctaattgcccattttcccaatttgctttacaaatccttctgtggaaagtctttttgaaaatagcatttttgctccctcttagcctctggggttctgaacgctttggcagtgaccattgagaatcaccctgccttccatcagttaccttgtatcaccttataaaagtcatttggccgttgcagtggctcacacctgtaatcccagcactttgtgaggctgaggccagcggattgcctgagtacagaagttgaagaccagtctgggtaacatggcgaaaccctgtgtctacaaaaaatacaaaaaaaaaaaaaaaa

SEQ ID NO: 9264 - DNA, 455 bp, Homo sapiens
aggatttccaagcaacagagcatatccagatgaggtaggatgggataaactcttattgaaccaatcttcaccaattttgtttttcttttgcagagcaagctaggaattgtttcccttctactgggcacaatacacgcattgatttttgcctggaataagtggatagatataaaacaatttgtatggtatacacctccaacttttatgatagctgttttcctwccaattgttgtcctgatatttaaaagcatactattcctgccatgcttgaggaataagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaaaaaaaaaaaaaaa

SEQ ID NO: 9265 - DNA, 491 bp, Homo sapiens
aacaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacarattagatctaatactactgtcagttttaatgtccactgtgttttatacagtatcttttttkgttcactttggaaatttttactaaaaattgcaaaaaataaagtattgtgcaaagatgtaaggttttttgaaacttgaaatgcattaataaatagacgattaa

SEQ ID NO: 9266 - DNA, 534 bp, Homo sapiens
  misc_feature 86: n=a, g, c or t
acataaaacacggacagtgttttggcctcaggagcaggactgcagctggtggataacattctggcttctcattctcattctttaantgagataaatggtggataacattgtkvcttctcattctcattctttaaatagacaattcaggatgtgttctatctgtttctcgtggtagaattccctcactagtgaccatgatgaatgcccttcagtgagtttctctccttcccctctcactttccctgatctctcactcctggttcctggggttacttcctcaataaaccacgtttgccccataacagtgagtaaaaaggcacttcagagaagactatagtacaatgtattatttttataaatttcaaaaacatgtttatttagccagcagaaggggaagaaccactgacatatacaacaacatacatgacaaatctcacaataattatgctgagcgataagaaagtctgactggtttcatttcattttccagaaaatgcaaattagtttacattaaaataaagctgaccaaaaaar

SEQ ID NO: 9267 - DNA, 252 bp, Homo sapiens
tttctgttagactgcttttcagttctgtattgagtatcttaagtactgtagaaaagatgtcacttcttcctttaaggctgttttgtaatatatataaggactggaattgtgtttttdaagaaaagcattcaagtatgacaatatactatctgtgttttcaccattcaaagtgctgtttagtagttgaaacttaaactatttaatgtcatttaataaagtgaccaaaatgtgttgtgctctttattgtaaaaa

SEQ ID NO: 9268 - DNA, 487 bp, Homo sapiens
cagaatttgtgttaataymtgtaargctacagaaggtactctgaataatcgctgttacatgtaagagatggatttttcattccctttcattctctgcattcttaatatggaaattactctgatgggagggatgtgcagagggagtgactgccttagaaatagatgtatgaatggcgtaacttctatcattagtcaggaatgacctccatttataacctgtgcgttcccttccatttgcagatgtaagcaataatatgatacagcaagtgttcactcctgtggcatacttttaacctttctaagcttgtcagtgggaacaaatgagaggggtagagttttttgcactaattctgctctttggacaagtgcctgacatctgcttcattgggttttagtttttactggtgttggtgcttttgtctgtcataccatagtatttcaaaacttcaattgtttctactctgcaggttaatatggctccaaaagg

SEQ ID NO: 9269 - DNA, 357 bp, Homo sapiens
agaagctcctcaatggccagcgccagwsaagccccggctgccactcgcctcacctgagcctgggtggaacaatccaaagttttaatcaaagaaggtggtattcagttgctgcttacaatagttgataccccaggatttggagatgcagtggataatagtaattgctggcagcctgttatcaattacattgatagtaratttgaggactactaaatgcagaatcgcaagtgaacagatgtcagatgcctggtaacagggtgcactgttgtttatacttcattgctccttcaggacatggaccgttacataactgaagactcccaccttcaggcaggattgggtagtacatgtttgtaa

SEQ ID NO: 9270 - DNA, 424 bp, Homo sapiens
gattttgcagatgtcattaagaatactttatttggccggatgcagtggctcacacctgtaatgccagcactttgggaggctgaggtgggcggatggcctgaggcaaggagttcaagaccagcctgggcaacatggcgaaaccccatctctacaaaaaatacaaaaaattagcggggtgtggtggcacgtgcctgtagttccagctactcgggaggctgaggccagagggtcactcaagcctgggaggtggaggaggttgcagtgagctgagatcacgccactgcactccacctagggaacagagcaagactccatctcaaaaataaataaataaaaagtgaaaacactctaagtatctatcaactgatgaatggataaacattgtatattattacacagaatattgtcaaaaaaaaaaaaaaaa

SEQ ID NO: 9271 - DNA, 578 bp, Homo sapiens
aacttcgctttctgcgtccaatcagatgttttcatagggcataactttgtaacttcacttcagcctcccattgatcgctttctgcaaccattcagactgatctcgggctcctatttcatttacattgtgtgcacaccaagtaaccagtgggaaaactttagagggtacttaaaccccagaaaattctgaaaccgggctcttgagcgctatcctcgggcctgctcccaccctgtgagtgcactttcgttttcaataaatctctgcttttgttgcttcattctttccttgctttgtttgtgtgtttgtccagttctttgttcaacacgccaagaacctggacactcttcactggtaacatattttggcaagccaaccaggagaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaaactgagaaaaaagcagaatgaaagtgtctcacgagctatgtgtgctctgctca

SEQ ID NO: 9272 - DNA, 471 bp, Homo sapiens
ttgtttattcttaatttagaccgttctctttaatgtcagtaggctgccaaggattaggtttttctctctttttcagagggttccagatttttttttttctctctaagtgttcctagtgaatttcaaggtcagattagtttttgtgaatttataagttagtctaaagagtttttaaaaatttatccataaaaatgtttttttatattacaagttaatgttaaattgtaatcaggataaatttgctaggaatataactaattgttgcaacttcatatgcaaatgttgggaaagatctgttaaaactcttgcattaaacttatttgtctctaaccatgcatttaggttggataagaaaaatacttaagttagtgggtgcagcgcsagscakggcacatgtatacatatgtaactaacctgcacaatgtgcacatgtaccctaaaacttaaagtataataaaaaaaaaaaaaaaa

SEQ ID NO: 9273 - DNA, 449 bp, Homo sapiens
tattcaaaagactaatgaatgacagtctgctttgttaaatagttgtgccataagtatctcatttttatcagttaactatttagtatttacctatgcattcttctagcagtttttgggaagatgggaaatggagaaggtcattgctcagaaaaactggagacatttcgttggcgtggtggctcacgcctgttatcacagcgttttgggaggctgaggcaggcagatcacttgaggccaggagttggagaccagcctggccatcgtagcaaaaccctgtctctgccgaaaatacacagaattagccaggtgttgtggctcatgcctgtagtcccagctactggggaggctgaggcaggagaattgcttgaacccgggaggcggaggttgcagtgagccgagattgtgccacggsactccagcctgggtgacagagggagactctgtctcaa

SEQ ID NO: 9274 - DNA, 305 bp, Homo sapiens
  misc_feature 126: n=a, g, c or t
caaagagagacaggcttaaatgttctcttttaacttgagcgtgaggtgggggtcacactttgcagcaacttcaagaggattttaaagtttccattactactactattaggttatagttgattcctnhctcactcaatgttctgtgaaggtgctctgtagataggattaacatttgtggccaggcgcagtggctcatgtctttaatcacagcactttgggaggccaaggcaggtggattacttgaggttaggagtttgagacaagcctggccaacatgatgaaaccccgttcttttttttttttty

SEQ ID NO: 9275 - DNA, 450 bp, Homo sapiens
ttgacctcccaggaccagcaggagcacctcagagactggttcaggggtgggaaccagtgaagcgtagaatatttcctgccagtccaaggaacagctgctatcagagttcccacgtttgcagaaaatgctttgccctaagcagtgaggtgagagctggacacctgcatggtgagcaccgtggaagaagagacccctggttggccacgtgctgtgtccacatcagggtttttcatgttttattcttctcacccaggagaaaaaaagtaagttgcctgtagccaaccaattatttatttctcctttcaaatctagtatcttaaccagtgagttaattctgtagkdctagattttactgcagtttttgatcagtaattcataatctggaatccataacctacttgtgctacacccaacagtaataaaattggaaggttgggaaaaaaaaaaaam

SEQ ID NO: 9276 - DNA, 419 bp, Homo sapiens
cataaataaccctcatcacatggcattttttcttcttcaaaaaccttgatttgtagccgggaaaaagtgattttgtgaagatatggagctctccatctaagcagcacctgtatgaaaacttacgaaaaagaactatgcttccaaacacgatttaattaaaaccatgtaaggccataaatctagtaatatgatacctgctcagagccttccttagcttgcacggaaaatgcatagacgttgccaacatctcctacgtgcatttctaaaataatacagttggccattgaacaacacaggtttgaacttctcaagtccaatgttatgcagagttttaaaaataaatatattggaaaattttttggaggtatgtgacaatttgaaaaaaacagatgaacctcatagccaaaaaaaaaaaaaaa

SEQ ID NO: 9277 - DNA, 398 bp, Homo sapiens
aggcaagggaattgcttgaaccagggaggtagaggttgcagtgaactgagatcacacactgtacaccagcctgggcgacagagtgagactctgcctctaaataaataaatactggttccaagattaaaagcacttaactaatgtgtttattattatgttgtagctttttttaatgtaggagtaaatgttcaaaggaaatatctattttaaacttaaaagctgatatttgtgggttaacctttctgtggtactacagataactgtgttccctcattgaggaatggagtcacaacaggttggtgtgtgcagtatgtgtagcagacaaggaaggcacatggggaggagttgaatcagttgtgtaagtttcaaaattgaaccacactgaatttcccttgtag

SEQ ID NO: 9278 - DNA, 447 bp, Homo sapiens
  misc_feature 200: n=a, g, c or t
aggccagttctgcagcaccctctgtggcagctgagagcaggccctctgcagaagagagccaggggcatggagagttcaggcctccagcagagggagtgcagatatggggaaagctgacccctggagtcagcaggcccagccctaggagggggcagtcccacagcaggctcacaccctgcccttcagagttgcagcagctnatgctgatgccaggaccthgtcctgccaggaagcctctgattagggctgtgaaccaacttccttttcacatctgcaaggacacttggaggcaactgcccaaggccactctgaggagggttgaatgttctttattaaaaggactgaggatcatgtgtgttggtgggccttggactctgctctaagctcaaattttgcagtttctgctgtcatcacagctgggaatgagaaagggaaggggctccagtt

SEQ ID NO: 9279 - DNA, 512 bp, Homo sapiens
aacaaaacggttccatctttggctaggcctttggtatttcaaggcgctgccggtggggagagatgccgcgtgcctgagaggctctgggagagagctaatgctggcagctgttgggatgtcctcttccaggaatggtgatgagtttccctggatccagccctggcttggctgaggtttttctcactgtaagaagaggacaatagcctatgatctacagtgcccattccaactcagagaatctttacatctggagatctatagcagggctatccctagtgacatgcgtgaagaagcttggaaatggtgctgggtaggagctgagtgcagaatgtggaaaggcattctaaaccaaaggaagaacacgagtaaagatgatgaagcagggataaggctaaaatgaaatttgtgatctgatccacatacaagcacagtgtagtacagctggaatatagagaagagcttgaagacttatgagcactatcccggtactcttggaggctctgcamcacagt

SEQ ID NO: 9280 - DNA, 409 bp, Homo sapiens
attcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaaaaaaaaaaaaaa

SEQ ID NO: 9281 - DNA, 368 bp, Homo sapiens
ctttcatatcgttattgtacaaaaagtaaagagtatcctaaagattgtattcattgtaatcaagtaatgcaatcatctctcctctcttgaaatcttgctggacctcttaggctasaataaactgtacsagactaaactgacagtccttcgataatatgaaacattaatttacaaggacccgttaggcsktcaatgatgctgagtctggaaaaggaggagacccttgggaggactccaggcagctgtgctcccagggctcatgttctctactggattagggataggcacctctgaaatckccaccctgatgattggaatgaaacggagtrracatgagcccagctgagagaggagcaggaatgtgtgaa

SEQ ID NO: 9282 - DNA, 457 bp, Homo sapiens
tttatgggctcagaataggggaggggcaggctgcaggtagtattggaaaaggcaacatttgattcattaaaaggcattgttcagaaagaatcaatcaggaaagggtgggcagacaggaacagaagttctcgctctggttcgtgggtttcatccgggaccagcagtccagtctttcagccttcaggctgtttttggctcgaaggtggggtttcaccggggacccgcccctatctgcccaggcgtttggctgcttcctatcactatcaatagtccctccccttcaatgacttgtaggaaggttgtttcgcttaccacattccatcgtgtcctggtggcatcatcaatgaatgaacatgttcttttccccatgtttcttgtacgtactgtgtattagaagttggactaaaggcttgatcaaatttgaggcaggaatgggtgargctacgtgcgactggag

SEQ ID NO: 9283 - DNA, 208 bp, Homo sapiens
gactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccagaraaaaaaaaaaaaaaaaaaaaaaaaaaaaaaaaaaaaaaaaaa

SEQ ID NO: 9284 - DNA, 417 bp, Homo sapiens
gtacactcaagatttaaaaagaactacaattccataagaaaaaggcaggccacagaataggaaaaagaataaaagacttgtttaggcatttcacaaaagaaagtatacaaatttaagtagttatttaaaccacaatgccattctactatatgggcaaccagaagggccaaaacaaaacgaacaaaagactaccaagtgttaacaaggatttaaggcaactgaaacttccagtcattgctggtgggggtatgaattggtacagtcgctttggaaagctactgagcagtatgtactaaagccagacatatgcgtatttctgaaccaggagtttcactcctaggtatgtactcaaaagaactgtgtacactatgttcaccaaaaaacaagaatgtttatagcaascctctttgcattagk

SEQ ID NO: 9285 - DNA, 347 bp, Homo sapiens
agtttcgctcttgttgcccaggctggagtgcaatggcgcgatctcggctcaccgcagcctccgcctcccaggttcaagcggttctcctgccgcagcctcccgagtagctgggrttacaggcatacaccaccacgcccggctaattttgtatttttagtagagacgggggtttctccatgttgaggctggtctcgaactccggacctcaggtgatccgcccacctcgaccttccaaaatgctgggrttacaggcgtgacaccgctcccggccaatcccaccattttcttccgcagcttctgcttacaggaaaatagcagctaccttgtcaccaaaaaaaaaaaaaaaa

SEQ ID NO: 9286 - DNA, 438 bp, Homo sapiens
ttatatgaaataaagacattccaggaaagacacaaactactagaacttactcaagaaatacaacttctgaatagacaagtaaagaaattgaactattgctactgttaccaccaccaccaccactacccacaggcctggtacggtggctcatgcctgcaatcccagcacttgggggggctgaggcagctggatcacttgaggtcaggagttcaggaacagcctggctaacatggtgaaacctcctgtctactaaagatacaaaaattagctgggcctggtgatgggcgcctgtaagcccagctacttgggatgctgaggcgggagaatcacttgaacccgggaggcggaggtttcagggagctgagatcatgccactgcactccagtctgggtgacagagggagactttctctcaaacaaaacaaaaaaaaaaaaaaaa

SEQ ID NO: 9287 - DNA, 126 bp, Homo sapiens
tttactaaakwaagattacttagaggaaataagamaaatcatgtttsctctcccggttcttccagtggtttsasacactggtttacactttatgccgsatgtgcttttctccaatatcagtgctcg

SEQ ID NO: 9288 - DNA, 495 bp, Homo sapiens
cattaaagggaataagtacgctgtgtgtaacaacagtgggatctcaaaattatgcttctgagagtgatggaagccagacacacaagaccatgaaccgcggttccctttctagaaagttctggaaaatgcacactaacctactaatgtgaagccaaccagtggtagcctggaagctgggatggcaagaagaatcgattgcaaagagacaatagaaaacttttgtgggtggtggaagtattccatattttaattgtgatcatttcactcatgtattacatatttcaaaattatcgggccaggcgcggtggctcacgcctgtaatcccaaaactttgggaggccgaggcaggtggatcacaaggtcaggagatcaagaccatcctggctaacacagtgaaaccccgtccttactaaaaatacaaaaaattagccaggagtggtggcgggcgcttgtagtcccagctactcgggaggctgaggtagaagaatggcgtga

SEQ ID NO: 9289 - DNA, 485 bp, Homo sapiens
gacttaggatttgagcatctttctgttatgctgttgccccactcctattgcaatactccccttcttaagaaagtttttctagactaatgtctagattaaacttcttttctttgacaataatgatgccatgacttggacaaaatgcccattgcctctgggtcctgctttcttcacccagtgctgccttattggactccttgtgcctctccttggctggggaaatcagaatacacagtggtaagtcatgatttctaatccagtgctccagacgtctgtctgttgtagcacagtgagaagttgacttatatttctctcatttttgtcattttcttctgtttttccatctttcccttctgccttttttgagtgtggtgaaagcccctcattctctcctgagaatcatacctgagttgaaatcccaaagcctctagcaccagcaggtgtcccttccattatcatgagaaaccgtcaatttggctgttgtt

SEQ ID NO: 9290 - DNA, 239 bp, Homo sapiens
tgaacttgagakakaggatttagggtatctggtggaggaaatttctaagtagcawaccattcaaaaggtgacagggccatgcgcagtggctcaygcctataatcctagcactttgggaggccgakgcaggtgaaccacttgaggtcaggagtttgagaccagcctggccaacatggcaaaaccctatctctactaaaaatacaataaaaattagccagacatggtggtgggcccctgta

SEQ ID NO: 9291 - DNA, 431 bp, Homo sapiens
cagatgtcttttatctttatgatggggccatcttgtcatatgcttasctgacttccaatttgcggaatattggcatgtwtcatagctctaaagatarrassaaatattctagaaaattcacatgaaatgaattatactgtgactttktcaaaatagcttsrttattgtkykrtaaaagggatgtatgctcaatgaatgaaaagaaagtcagttaataaaagtataaacaagctgggcatagtggctcacacctctaatcccagcactttgggaagccaaggcaggcagatcacctgaggtcacgagttcgagagcagcctggccaacatgacaaaactccgwttctacaamratacaaaaattagccaggcatgatggcacatgcctgtagtcctacctactctggaggctgaggcaagagaatcgcctga

SEQ ID NO: 9292 - DNA, 463 bp, Homo sapiens
tagcatatacataaaccagtaacacagtcgtttgttatcagtattatgtattgtacataatgagtatatgtgcaagactttatgctactggcagtgcagtaggtttgttttataccaacatcactgcaaacacatttgtaaagcattgcattacagtggttacaaagtcactgggtaatatgaatttttcagctccattataatcttatgggaccactgttgtatatgtaatctgtcgttgaccaaagttttactgtgtagcacatgactatgcttagaaggaaggatcaactatgtaaataatgaaggaggaggccgggtgcattggctcgcgcctgtaatcctagcactttggggggctgaggcgggcggatcgcttgaggccaggagtttgagaccggctgggccaacatggtgaaacctgtctctactggaaatgcaaaaaaaaaaaaaaaaaagytta

SEQ ID NO: 9293 - DNA, 426 bp, Homo sapiens
caaatatgctttaccttccatttaaggaggaccagggagttaggaacttcttgaggaaagtaaggcaccactactccacaggatttagctacaagtagtgtcctttttgggtctttgtgactcacctcttsccakcactgtggtaaatgttcggctkctgcatgtgttggtccgacatgatgtgtgaatgccgtarcaccagttagtatcacttgccttggctctttatctggcctcttgatcatactagaaagaatgtggagaagctgatttttcttkttagattcaagatgtaggcacgttgtatacaatctgagggcatcagtgtctctgtctttgccagcagcacgtcaagtsaatgtatagcaagcaatatccaagcatcagcagaaggtgtttttcactgcagtcagagacacttctgat

SEQ ID NO: 9294 - DNA, 444 bp, Homo sapiens
tactctgattcacagaaaagcagtgtaagtagtaaaacaaaaatattgctttcacttagtgcgtaggttttaccggggatttaatcctcgtgtgaagatttaatttgtcatgtgacccattaacatatatgtatgtaagcgctgaactgtgtatttagaaagcaattttagtaaattgaactattttttagacctggaaacttggcaaaattgagacttctagttcagcatgaaataaacactctaagagcccaggaaaaacatggccttcaacctgctctgcttgtacattgggcaaaataccttcagaaaacggtgagttttaaagtataagcatttttaatgaacattaccttaattttttaaaatcatgaactttttattgaaagtttttttgttctgaaaacagcagtttggtcatattatgacagatgtgttttttaw

SEQ ID NO: 9295 - DNA, 463 bp, Homo sapiens
  misc_feature 127,267..268: n=a, g, c or t
atgggtatatacccagcaatgggatggctgggtcaaatggtatttctagttctagatccctgaggaatcaccabwctgacttccacagtggttgaattagttttcagtcccaccaacactgtaaarnkgttcctatttctccacatcctctctagcacctgttgtttcctgactttttaatgattgccattctaactggtgtgagatggtatctcattgtggttttgatttgcatttctctgatggccagtgatgatgagcattttnncatgtgtcttttggctgcatagatgtcttcttttgagaagtgtctgttcatatccttcacccactttttgttggggttgtttttttcttgtgaatttgagttcattgtagattctggatattagccctttgtcagatgagtagattgcaaaaatttttcccgttctgtaggttgcctcttcactctggtggtagt

SEQ ID NO: 9296 - DNA, 342 bp, Homo sapiens
atgccaactgtatgcctttgagagtgaaatcagaataatgtctctccactaaagcaggacttagagcactagttttccaaatgttgtctacagatggaaacactagcatcacctgggtactcgttagaaagtgcagattctctggcggtaccttagacctcctgaattagaaactctgggggtagggttagacatttgtgttttaaacaagccctccaagtggtttcaatgcacattcaaagttgagramcavtcactgatagagaaaaagcagcttgggtagaaacagttgattatttgcaaatttatattttaaaaagataggattcttaacagtaagct

SEQ ID NO: 9297 - DNA, 448 bp, Homo sapiens
ctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcacgagacggggtgtcccctgcagggggctaaactgcaggggccygagattagctgtgaacatgtgggagcccgatgcatgtgggtcagggatctgggggcccccccagctkgcgggaaccccaaatggacacaaactgtacatttgccaatgggtttttttcagaccatggtttttacttgcaaataaacctgagttcttttctgca

SEQ ID NO: 9298 - DNA, 271 bp, Homo sapiens
ttgcscgggcgctgggttcaggggctttccgccccwctggywtcacagctggacgtcgggagtgctagtttggagtacgccatttgagagtaggcgtgagaagttgctctgtgtgctgagcgttctaaaggaagccgtccgttggccttcgtacccgtcttgattgagctctcacacttkggatacgctcctctaatcctgtctgaaagagctaagctgacccccaccaccgttggaggaaactcctggagcastgctggggttttcactg

SEQ ID NO: 9299 - DNA, 299 bp, Homo sapiens
agcatttccctgatgatgttcagcatctattcataaaccgattggccaatgtcaagaagaatttcccttgcagtcatcaagactccttgtccccaaatacttcagcaggcatctcctaagaacagtggtaatataccattactatatcccaaatatttattactgatatggtattataatattacctaatgtataagtacataatcaagttttcctaattgtacccaagatgtccttcatagctttttttcaaatctagagaccaattaaaaatcatatatggtaaaaaaaaaaaaaaa

SEQ ID NO: 9300 - DNA, 85 bp, Homo sapiens
caatactctccagctccaccgttaccgcwaatataagtvaagtttgtamaattcayacttaataaacaatttaggacagtcaaar

SEQ ID NO: 9301 - DNA, 433 bp, Homo sapiens
tcactcctggaatgcaccatctattagtagcaaaagacttctcatatattctaattgtatgagggtggagttagcattctccaccagctgcagctttctttctgttttgctttcgaggtagggtcttactctgtcccccaggctggagtgcagtggtgtgatcatagctcaatacagtctcgaagtcccaggctcaagcaattctcctgcatcagtctcccgagtagcatagtgtgccactatacccagctaattttttgtagagatggggtctctctatgctgcccaggctggcactggcaactttcttctttttagaataattaccgtacttaggatccaatattcttcccatctcacttgttttagaatgtgtgtcctcaggtttggattttaatcatgtcccaagggatcttgccttctaaataaagga

SEQ ID NO: 9302 - DNA, 293 bp, Homo sapiens
ctggctcgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccac

SEQ ID NO: 9303 - DNA, 385 bp, Homo sapiens
  misc_feature 229: n=a, g, c or t
agttctcaggtcggcgggctgtggaggtgatcagagtgggagtcaggcgggctaggccggacccggaggaggggctcgggctccgggaggcagctgcggctccgactgctcaggaacctcctcctgggcccggcagagagagaccccgagtcccccggagtccgactcgctacgcgggtcttgcgagatatctggccgcctctgccgcagctggaggtaggggaccagntcctggacgcctttcggggatggggtgaagtgtgacctccvtcttcgctgagactttgttttctaatctgtaaaatgggaatagtagtatccacttcatagggagagcctgacatctagccctgagaggagatgaactgggtaggagtcagtgttg

SEQ ID NO: 9304 - DNA, 451 bp, Homo sapiens
tcaagacttacactagaactgtgagaacagggtaataaataagcatatgtattaatatcacctttggtcaactcttgggtagccccaacggtagtgtaggaattaacgtaatttttcctactaaaagtattggatttgttttgagagaccacagttgaaaatcattgacatacaaagtttaaaaattgttaggttaaaaaattttaaatgcatttgaagtggttttatagaaaaataattatctaacttggtttatattgacaggttgttttcttggataagaactagacgaagagaaagggagattagtgataaatgtccaggttttcaagttgaaaagtaacaatcagtgtattacaacagatggatgtgatgtcaaattacaaatgctgaaaacgttatatgtaatcatgtagccagagtaatcatacaaggcaaagaacggaaaggc

SEQ ID NO: 9305 - DNA, 444 bp, Homo sapiens
atgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaattttgtattagatgaacagactcagcaagcacctcatcttatgcctcccccttttttggttgatgttgatggtaaccctcatccatcaagatatcaaagattagttcctggccgtgaaaattgcagggaggagcaactcatccctcagatgggagtaacttcctcaggactgaatcaagttttaagtcagcaagcaaaccaggagatcagcccactggacagcatgattcaaagactacaacaggagcaagac

SEQ ID NO: 9306 - DNA, 510 bp, Homo sapiens
tattgtcattatgaatgttactccccatttagtccaaaatagtgagcttttaagttgtgccaggtacttaacaatagtaaaagctattgtatagattttwattcamygtgacctataatacatttctgattccttctgtatwgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgakatcagcctggccaacatggcrraatcacatskctactraaaatacaaaaattagccaggcgtggtggtgcatgcctgtagtcccagctamtcaggaggctgaggcaggagaatcgcttgaacccaggaggcggasgttgcagtgagccgagatcatgccattgcactccagcctgggagwcagagcaagactctatcgcaaaaaaaaaaaaaaa

SEQ ID NO: 9307 - DNA, 420 bp, Homo sapiens
aacaattaaatagaacaaccaagggctctgcattatagagtcatcctagaacccaaggctcattctgtcttcaacctgtggccttgggtcatcccagcatcatccagccagcaaatgaaaaaaagctggaatgcgggctgggtgcggtggctcacgcctgtaatcccagcactttgggaggctgaagcgggcggatcacagggtcagtagatcgagaccatcctggctgaaataatagaaacccggtctctactaaaaaatacaaaggattggctgggtgtggtggcgggtgcctgtagtcccagctactcgggaggctgaggcgggagaatggcgtgaacctgggaggcggaggagaccgcgccactgtactccagcctgggtgacagagagaccctgtctccaaaaaaaaaaaaaaaa

SEQ ID NO: 9308 - DNA, 414 bp, Homo sapiens
awaaaaawtcataactgggattagascttgagattccctattttcttacagtgaactgtcttgagctgtcacttaatgcattgaaaacataatagagcacaggccataggcattttcagaacatgaaacttgactgaaacaaaaactgactgtttgattgctttggtgttttaaatgtatccccaaatctcctttgctattgatagtcatttggtgccagtgacagggaagagcaraggggcttaggaggtttttgtagatcycagtatcactgkgtcttataacaccgacaagctcatctttgggactgggaccagattacaagtctttccaagtaagtactagaaaccaaggagccattttgaaaaggkgttttcttttkcttttycttttttttttaaatgaagttttgca

SEQ ID NO: 9309 - DNA, 535 bp, Homo sapiens
  misc_feature 128: n=a, g, c or t
cttggtgtccaggtggcaggttcataagacacctgtgatttgatgtgagccagtcacagaggaagccatttccagagaggaacaaccgtttagactgctttcctgggagtcaagttaaaacttctctnctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcaagtaacactcgggagagtcccgtattctcagagtaaaagttgtttctggaattgatctcgccaaaaaggacatctttggagccagattggataaccgagccgtgactccacttgaacatctgagcagttggcccgcgtgggaaacagcaatggcagagaaagatgcttccctttggatcataccttgaggacaaaaaagggcagtcatataatctgtcatctaaactgggacgcttttgtctggr

SEQ ID NO: 9310 - DNA, 534 bp, Homo sapiens
tcaacatatttttattttgaaataattttgtatttttccctatatcctacattggatcagaatattactgttatgtatagccatgaggacatggtctcaaaagaatgagaaactttcttagacagtaaaattgttaacttgagatgtttgcttccatcttctagagccaagtaggatctaactttaatttgacttagccaataatctgaaactattatagtatctgtctttcacagatacatgcaatattcacttctaaatatttaatgataaatttgtaatcatacatgatagtcaattttaatgattatgttgtcaaaattcaggcgttttgtgtgaattgaagacttaaagaagaatttgtaaatatgactgtataagaaacaacagaaagatgaagatgaaccgaaatagaaatatcaagaggctacaaagtcttagcaaattataattgctaatggtacattatgtggtgtttagtatcacatttagaatgtagtcawttgttaagtttttcatggggtaaaagaaaga

SEQ ID NO: 9311 - DNA, 370 bp, Homo sapiens
  misc_feature 49..50,54: n=a, g, c or t
aactgcattgggtccatctgtacaactctctccgtttctccgtctctmnncctnsctccctccctccacccccccaatctttttstccccatctctccatctctctcttatctcttcaggaagagcctaraaggcggcrrsaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaasaatgtctgrsagatattkktaccagcgtttacaccacctgcgacatccctgr

SEQ ID NO: 9312 - DNA, 484 bp, Homo sapiens
tgggagttcctggctgcagagagctatgattgtgcctgtgaatagccaatgcactccagcctgagcaagatagggagaccctgtctctaaaaaatacctaaataattttaaaagtcagcctctctgactgcctatagagaatgctaactaactgaatgacagaagacctaatgtaatccaggtgcaaaatcagaactttccggccgggcgtggtggctcacacctgtaatcccaacactttgggaggcccaggcgggtggatcacgaggtcaggagttcaagaccggcctgcccaacatggcaaaaccccgtctctactaaaaatacaaaaaattagctgggcatggtggtggccacctataatctcagctactcaggaggctgaggcaggagaattgcttggacccgggaggcagaggttgcagtgagctgagatcgcgccactgcactccagcgtgggggacaaaagcgaaactctgtctca

SEQ ID NO: 9313 - DNA, 538 bp, Homo sapiens
acaatttggaggcttctggaaacccacactatgcacctctcgctgactgggtagatggggtgagcttactttggggtgagctcagagtcctcacactcctttatttcctgggtcctacaccctcctaagcgcctgcagaactgtgagtccctgtgtcttggtaccacacacagaaagacaggtggtggtgcccttctcccctgaatctatcactccccaagggbaccgcaaacagccatgttaggagaraaatggtgagttgaaaagggggaacttggtgagcaagcccccagcttttatatcttacagcttttataaagacagcatttttttttcctttttagtcacttacaggattatagctgcctggtgggtttgggaaagaggtagggagggaatgagagagattttattcaactaaaaataagcaagcttcctaggttgtatttatccaaagtggactttaattaaattttgtctttgggttttcagatgactaaatagttctacctggggagttcacactgtcttctaatag

SEQ ID NO: 9314 - DNA, 81 bp, Homo sapiens
taaattttgagcccattgttacaattaagtctttctgagagtattttttataccctgtatttttctttctttttttttttt

SEQ ID NO: 9315 - DNA, 443 bp, Homo sapiens
ctaaaagatctaatttgaaaaactacaaaagcattaactaaaaaagtttattttccttttgtctgggcagtagtgaaaataactactcacaacattcactatgtttgcaaggaattaacacaaataaaagatgcctttttacttaaacaccaagacagaaaacttgcccaatactgagaagcaacttgcattagagagggaactgttaaatgttttcaacccagttcatctggtggatgtttttgcaggttactctgagaattttgcttatgaaaaatcattatttttagtgtagttcacaataatgtattgaacatacttctaatcaaaggtgctatgtccttgtgtatggtactaaatgtgtcctgtgtacttttgcacaactgagaatcctgcagcttggtttaatgagtgtgttcatgaaataaataatggaggaattt

SEQ ID NO: 9316 - DNA, 440 bp, Homo sapiens
cattactgattagtgcacagttttaacccaccaggtatataaaagtagctcagtcattgttttttctgtgttactcagattaatacacttgacatatataatttattatatactatattctgtaaaatgaatgaagattaattataaggtgtttgttttcagctgtacaagaataagttttatgagagcagcataaaagtaatgaaattaagtaatgaaattgttacatattaagaagtattaagtattaaattattaagtattaagtaatgaaattattacatcgtgacccatatttttgtaaaattttagcgtttatatattataaacaatctgttgtaatttatgataatatgtattagtacttgtcatcctaaaaaggtattttattattatatcatttgtataatatacttaaaatttgggagatcctttgtagt

SEQ ID NO: 9317 - DNA, 441 bp, Homo sapiens
  misc_feature 112,279..280: n=a, g, c or t
atttctccaaagaaccatccagaacctgagcagcctgtcttcagacagagagaggcccacggctgtttcttgaaatctggcgctgggaatggccatgtggaacaggccatgncagaggctgcctcagcagcctctggtdkctgagcccactgcagagggggagccacacctgcccacgggccgggagctgactgaggccaaccgcttcgcctatgctgccctctgtggcatctccctgtcccagttatttcctgaacccgaacacagataaggaaactnnggcccagagaggtgaagtcacttgtccaagatcacacagctcatggtagagctgggatttgaaccagtctgtgctctttgcccctgcactctcgttaagagttgcttctccatatccaaaactttcttcgtggacagcaggaccaggccatgctgtagtcc

SEQ ID NO: 9318 - DNA, 51 bp, Homo sapiens
aattcaattgtgttcgcagccgccgccgcgccgccgtcgctctccaacgcc

SEQ ID NO: 9319 - DNA, 424 bp, Homo sapiens
ccataagaaaaatgcatgcataccaaatatccatcataaaatagggaactaagaattttgtgtgcactggattttctttttttaaaattattgtttgaaatctgttaaacaagggcttgaactcaaatgdaaagaactggcttttactttaagcttaagctcaccaatgcactcttagagttacttttgttcagggctctgtataaccaaatggaattagcctgaggaaggtacggttttttccacagcattttgtttgtgatgaggaggctaagatagtttaaactgtgtgagctggcactgttgtaaccataaagatttgaggtatttgggttttggttgtagccaagcctagcttgggarctgcgtgtgcaggagtacaggtgtctgaacagagtgtggctgctcagtgctggatgargct

SEQ ID NO: 9320 - DNA, 446 bp, Homo sapiens
agttgacttttgtataaggtgagagaagaggatccagtttcgttctcctacatgtggctagccaattagcccagcaccacttgttgaaagggttgtcctttctccactttatgtttttgtttgctttgttgaagatcagttggctgaatggggcttggccccagctagacgcgagatggctcgttttcagagaacaaaggagagggaagaagataggtgttccttgaacatctactatgtgagaaacaccacccagggcactgcacctgcctgtgttggaaagaggatgcaaccatccccaacagggaagggtggaaaatgctgcactgtgcatgggctcacaaggaagatacataatgtacagccgaatctacagtctcctattttgtcagctgcttgtgttgattaaaacttcaataaagatcctgtgataaaacagaaaaaaa

SEQ ID NO: 9321 - DNA, 445 bp, Homo sapiens
tacttatttttgtgtggtgtttggtaagagttctggttcagtttttatcccatgtgtttagttccagcaccatttgttgaacagactatcccttccccattaaattaccttgatacttttgttttgtargttctgttttgtattctagtctgtttcaccaatctctatgtctatccttatgccaataccacaatgtcttcactactgtacttttatgataaggtctgaaatcaggtaatgtaagttctccaaatttgttcttttcatattttggggtctcctcttcgcccccgcctccttctttgaatttctatataaattttacagttaccttggcaatttgtacaagtaaaactcctggagttttgaatgggattgtatttaatctataggtcatttttgggaaaaatgatgtcttaacagtattcagtgttctgataagtga

SEQ ID NO: 9322 - DNA, 390 bp, Homo sapiens
cttcatgatttagtcatcatgtattcatgggttgtaagacttaatattcttaaaatgcccatattacccaaagtgatctatagattcatgcaatccccatcaaaaatcccagtggcatttttatttbcagaaatagaacaattctaaaattcatctgaagccacaaaagacaatgaataaacaaatcaatcttgaaaaagaagaacaaagctggaggcattatacttcctgatttcaaaatatcctgcaaaggtacagtaatcaaaacagtatgttaccagcataaagacaaacacacagaccaaaagaacagaatagagagctcagcaacaaatccgtgaatatacagtcaactgacatttggcaatggtgccaagcatactcagtggg

SEQ ID NO: 9323 - DNA, 217 bp, Homo sapiens
aggaggagctcgctgttacctgaagggatggactggtcggtggaatgtccggtgccgtsvagttacctgctcagccctgcagcaggggwcaaagctgrgcggastkgacagccrgtctcagcccksaggtactccagtgacaagcagcagcaccagtgctgatgagggtagcagggaaaactggtgaaatgtgccgaggtctctccagaggtggtar

SEQ ID NO: 9324 - DNA, 258 bp, Homo sapiens
tggtcttctagacagtaagatggccttcagtcaaaaggaaagtttaagatctcggttaagcatatgaaacaagtcaagatccttacaaaaagttaattaacaggaaaaacagcctttatcctacattttaagggctggcaatgaagaaaaaaaacagtggttggattaatccaaaactaacttctggttgcttttgaagtgttttctgcttttataattgattagagggctccctctatgtcattcacatcatttttt

SEQ ID NO: 9325 - DNA, 464 bp, Homo sapiens
agaaatatattgtatctctatcacgcaaatacaaatataagccactgtcatctcttaacactcttgctccattataatccattctccagactgcaaccagagtacatttttaaaaatgtgaatcagattatatcatgttcattgcacataatagaaaatctggactcctttcaatgttttatatatgtccctaaatgtagcaccctacccacttctctgaagagcctgtatcaggttaccagtgtgtatcatgtaactatttctacaaaaatgtcttgtaacaaactatccccaaatttgctggcttaaaatggagcagcaaactccacctgttttttgtgtgggctgtaatttaataatggcttttacgttttcaagtggtttttaaaaattaatgtttcacaacaacatgaaaattatatgaaattcatactctagtttcccttcggattgcataaatcttt

SEQ ID NO: 9326 - DNA, 369 bp, Homo sapiens
accagatgctttccaactaacagggaccaaatgggaccgttctaagatatcctaaaagatttgggagttagaggaggtaaactaagataattatattacaaagggtacaagaccacaagacaacaaccgactccggaattcttggacctccgccttccgtacaaggcccagccgccccgtccactgccaccaccaacgccgccgccatcttacactggccagcggcgccaccaccaccgcctccgctctctgcgcttgcscctgcgctgccacgctttccggccccgtttgcgacgatgtgctcgagaagactgagggaagagtggtcgcgcgastcacgctcgcaaccctcctcgaatgacgcacaag

SEQ ID NO: 9327 - DNA, 452 bp, Homo sapiens
caaaggaaaaatatatatacaattttgttagatattggcaaattccttcttcataggtatcatgccatttttgttatcccctcagaggtattttgaggactagatgagttcatgtatgtagagtgcctaacaaaatgaccactcaggctgggcgcagtggctcacacctgtaattccagcactttgggaggccaaggtgggcggatcacttgcggtcaggagttggaccagcctggccaatatggtgaagacccgtctctaccaagaatacaaaacttagcccgacttagtggtgcgcacctgtggtcccagctacttgggaggctgaggcaggagaatcgctcaaacccaggaagcaaagcggaggttgcagtgagccgatgtcgcgccattgcactccagcctgggtgtcacaacaagacttcgtcccaaaaaaaaaaaaaaaaagcttt

SEQ ID NO: 9328 - DNA, 336 bp, Homo sapiens
ctaattgggttgtaataaatcatgcattaaatgtagcaattgccacatttaatagcagtctaaaggcctggcgtggtggctcatgcctgtaatcccagcactttgggaggcctaggtgagaagatcacttgaggccaggagttcaagaccagccttggcaacaksgtgagtccccatctctacaaaaaaattttaaaattatgtaattagggcggggcacggtggcttatgcctgtaatcccagcactttgagaggccgaggcaggtggattacctgaggtcaggagtttgagactaacctggscaaatggtgaaacttcatctctactaaaaatw

SEQ ID NO: 9329 - DNA, 428 bp, Homo sapiens
  misc_feature 191..192: n=a, g, c or t
taaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttnnttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattckaattgctaactgtttatacttttctgaataaaatagttgtttctaattaaaaaaaaaaaaaaaa

SEQ ID NO: 9330 - DNA, 90 bp, Homo sapiens
cagatttgatgatttcctagcaggacttacagaaataaagagctatcatgctgtgaaaaaaaaaaaaaaaaaaaaaaaaaaaaaaaammm

SEQ ID NO: 9331 - DNA, 437 bp, Homo sapiens
aaggtaattaaaatacagtattttttaaaaaacttttgaaaaggttcagcttttaaattcttcaatgatatgtaaaagtttctacctatgaatttattttttgttactgataaatttgtattaaataattgatgcctaaaatatatatttagtagaataaagaaattagctataaaacaaaattagaagagccacaaactagacagggcactgtggctcatgtgtgtaattccagcactttgagaagccgaggcaggtggatcacctgaggtcaggagttcgaggccagcctggccaacatggcgaaaccctttctctactgaaaatacaaaaattacccaggcatggtggcaggcatctgtaattccagctacttgggaggctgaggcaggagaatcactagaacccgagargtggaggttgcagtgagctgagat

SEQ ID NO: 9332 - DNA, 425 bp, Homo sapiens
ttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccgtttgtagtaggagctgaaatccatgctgagctgtaccaggaacttgcatatctagagacagagactgagtcactggcccatctctttgctcttgtgccccaggccagaataaagaatagagtgtaaaaaaaaaaar

SEQ ID NO: 9333 - DNA, 234 bp, Homo sapiens
cagttaagaaccttgaaaagatctaagaaactatgcaaccttaaaataaacacctgacaaatttcaggatgtgaaaaagggcagagaacgcttttttttttctaaaggctaaaattttcrggatwawartatcagtaaacttsaggaatattggattggatcgtaagcaaggcttcaaggwmggaagaagctgaaggtattaaggatatgatatagaaggcatatacttcttca

SEQ ID NO: 9334 - DNA, 472 bp, Homo sapiens
  misc_feature 16: n=a, g, c or t
tttccgcggcaacggnstggaccctggcctgcgctggctggggaggaagcggttctaggggagcgtgcgggcgccggaggtccggcggcgaggaggccaccttctggccttgcgatgaatcctcggtttccccttctcagatgggggttttcgtgagggtacaacgtcggcattagacattccaggkgvcgcccgtacgcggtgggcggttcggggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcaactcggcccagacgcaattttcttctctgcaaaatcgtcataagaataatcacttgtcagggtagctgcgggcatcccattcgttcctttcatcagsgccgggcatatggggcgtcag

SEQ ID NO: 9335 - DNA, 166 bp, Homo sapiens
acagttggtggtaagtatttggctttatttctgggttctctattctgttccattctatgtgcctgtttttatgccagtaccatgctgttttggtaattacaggcttgtagtataattagaagtcaggtaatgtgatgcctacagatttggtttttttttttttttk

SEQ ID NO: 9336 - DNA, 381 bp, Homo sapiens
  misc_feature 191: n=a, g, c or t
aagttgtgtaaggaatctacactgtcaggcagaaccaggattcctgggtctccctctggcccaggctggagtgtagtagcacaattgccactcactgcaacctctacctcctggactcaagaggtcctccacctcagcttcccgagtagctgggaccacaggaagtagaactgggctgcttcataagtctnccttcatatgacagctagattcaaaaggatgaaatcagtagaggtgagacctcttgatgccttggcttggaagtcacatattctattgggaggctgaggcgggagaatcccttgagcaacagtgagccatgattactacactccagtctgggtgacatagtgagatcttgtcccaraaaaaaaaaaaaaa

SEQ ID NO: 9337 - DNA, 425 bp, Homo sapiens
cattagaaattcaagtcctctggggccctgttcccttgtgggcttgtgcaactgactttgtttcttgtctgcctttctggaaccaaatccaaggaaattcatgggtttggggagacagcgatgggaaccagcagggcacaggatgctaggataaagctgtggcgccccaaaagtggcctgctctgccaacatacataaatacatacagtctgagcttgacactgtataatttggcccagaacaatatgtattttgagctcatttaggtgaatgactttggcattccatgtacccactaggggaagctttatcaggctgcatttgccttatgcagaagtatgcctttgttctgagaaatggcctcagaacacactgttgagctgtctcctttagtgagtgtcatcctctcatccatttcaaaagat

SEQ ID NO: 9338 - DNA, 447 bp, Homo sapiens
ttcccggctgctttgtttacctaagcaagcctgggcaatggcgggcgcccctcccccagcctcgctgccgccttgcagtttgatctcagactgctgtgctagcaatcagcgagattccgtgggcgtaggasccctccgagccaggtgtgggatatagtcgcgtggtgcgccgttttttaagccggtctgaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcgcatggtgcsscacccactggcctgcgcccactgtctggcactccctagtgagatgaasccggtacctcagatggaaatggagaaatcaccggtcttctgcgtcgctcamtctgggagctgta

SEQ ID NO: 9339 - DNA, 483 bp, Homo sapiens
atcgaaataggcagatgctgcaaatcagggcttcccttgacccagagagccagttgttaaaacatttaccagcacaccactgtctgtattttccttttttcatttacattattattgtttgaatgactgtatatttggtaatttggatgtaccataatttatttaaacaatcccctattgttgacctgttatttctttagaatgttatttctcgaaatagaattgctaggttataccaatttaccaacagtgagggtgtttcccaatgccccacccagcacttatttttatatttagaatcttcatacgtatatttttttaaattctgggattttttattcttagaagtttttaatggttcgaggctgggcgcagtggctcacgcctgtaatcccagcactttgggaggctgaggcaggcggataacaaggtcaggagatcgagaccatcctggctaacacagtgaaaccccgtctctactaa

SEQ ID NO: 9340 - DNA, 446 bp, Homo sapiens
ctggagtttacctttggcatctttgcttgactgtgagctccctaagggtggggatcatgtctcttatttatgactatccttaggaccattatagtgtgcaatatatagtaggtgatatttgttggataaacaaaagaatttaaaacaaccgatcagttacaagtcaatgcactcctacttgtagcattggacacccatttccttaactctggatttctttaggtgaggacagtcagaggtggaggataatccccatgagctacgctatactcatctcccaatttatttctgtagcatcatctgagtcactctggtggggctgcctggaacttagcagcctgttactcagtgttcacattttcagagcatatttattcatttaactcagctaatttggatcattgccactaaatttttctagatggcttaaagaggaacatgctgac

SEQ ID NO: 9341 - DNA, 447 bp, Homo sapiens
  misc_feature 282: n=a, g, c or t
tagactgtaaatgtattctttcttgtgatttcttactttaactaatttttttcacccttcaactgaagcagtactcatagtgtcaaataagagagctctggagctccttatttcaatgatctctaatgggactcagtctaagaaaggaggggcatcagattttctgctgcacgaggctgttctgaagtcattattctagggtttgaagatacttacttttctggcccttacttgactcctccggccatagctccaaactgtctagccagattaccagggttngcttcagatgaacactttagtattttgatgctaaataccagtgataactataaatatttctcaacttatgatgtgtgttttgttttaataaatccactgtaagttggaaatactgtaagttgacaatgcatttaatatgcctaacctactgaacatcagcttggc

SEQ ID NO: 9342 - DNA, 399 bp, Homo sapiens
tctgttttttttctcacaaagtaaatggtgggcatccatgtttacattgcaccttcccgtgctgtaattggcttgacaaagacaagcaggcttctctgttgagacttattgtgtttttagttttcatagacacttatttaatctttttaaattgtacagcaaggkgctctaagtaatattcgataaaatatatttmatagaaatttgcgtttgatattcatgaacatgaatacatgtatttttttaagaaataagtattgtgtaacactatggcattgcttctatagccaaagtataaaaatttctggaatactgacatgtaaagactacagttaattctgacactgtatcttattaaaataggatgatttgcattttgtaaaattatcctgcacatca

SEQ ID NO: 9343 - DNA, 202 bp, Homo sapiens
ttgaagaggagctggctgcccttcagaaggaacgcagcgagagaataaagaacctattggaaaggcaagagcgagagattgaaacttttgacatggagagcctcagaatgggatttgggaatttggttacattagattttcctaaaggaggacctacagatgagattaaattttttgcatttacaaaaaaaaaaaaaaaaar

SEQ ID NO: 9344 - DNA, 432 bp, Homo sapiens
tattttctaagcatttaaagctacacacaagcaaaaggctatgaatttttctctgtgtggctttagccacattatcttttaaatcattcttaattctcattttaacttcatatttaaagcaaggatgatttataaggtttgtagtcagcagtgtgatcagcaaaagagaaggtgctatgaaagcaaatattgggaacatcaatccagatgtatgggatcagaaaactaggtgtggaggaaatgacttctaaactgaaaactagggagagagtatatatattagaaaatgatttcactggttaggctgggggattgaggtagcattccaagctgagaatacagcatgtgcaaagatgtggaggtaggacaaacatggcaagtttggggaactgaaattaggtcagtctgactagataacacagtgtaaggcaa

SEQ ID NO: 9345 - DNA, 138 bp, Homo sapiens
  misc_feature 33,41..42: n=a, g, c or t
acagttggtggtaagtatttggctttatttctnggttctcnnttctgttccattctatgtgcctgtttttatgccagtaccatgctgttttggtaattacaggcttgtagtataattagaagtcaggtaatgtgatgc

SEQ ID NO: 9346 - DNA, 420 bp, Homo sapiens
cttaagatttgtacacacgagtttgttttatctgtgtgactctaattaaagttaatcaaagtcacatggcttagcaaatcactgaagtttctttttggaggtttttattcattttagtaatttgatttgttgatttgctattaatcttttaaaagtaaaacatcaataacctaattttataaagtatcaggtgtcttttttttggcctactttacgttacttactctgtactttcaagcaggcacataaaggctcagtctgtttcagctctgtgcactgctgagcagtgtcttaccatgactgacctcctgattaagaggaagttagcacgtgagagccacattgagtctgctggccttagcttcatgtgctatgtgagagatgtgctcattttgtacacaggatgttataatgggatat

SEQ ID NO: 9347 - DNA, 422 bp, Homo sapiens
tcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaatgatagctatattcaaaatgtctatatgtttatttggacttttgaggttaaagacagtcatataaacgtcctgtttctgttttaattttatcatagaattttttaatgaaactaaattcaattgaaataaatgatagttttcatctccaaaaaaaaaaaaaaaa

SEQ ID NO: 9348 - DNA, 209 bp, Homo sapiens
tactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaataaaaaaaaaaaaaaaa

SEQ ID NO: 9349 - DNA, 430 bp, Homo sapiens
tgwtastttgcttkktgtyktttgtttttttctagagrsagagtctcgttgcccaggctggtctccaattcctgrgtkcaagcaatcctcctgactcagcctcctaaatgctgggattacaggcatgaaccactgtgcccagtctatatakratagattttagaagaaatttctgccactcagtgactgctttaaattctagagacagaggctgagakdracttagtagcctgcctgcgcatactgcaagtacagactatataacaagttgaaagrgaatcaccckggtatataatattttaaaacatgrwaaaggcattactattgttctggtctaagtactctaacaggacgatgatttctaaccctagcatcatgacatgtatatagtgtgttgtaagacatttgscaactaatagttacagtactg

SEQ ID NO: 9350 - DNA, 513 bp, Homo sapiens
aacctgctcgggtcacgttccacacagtggaagctttgttctttcactctttgcaataaatcttgctaccgctcactctttaggtccatactgcttttatgagctgtaacactcacctcgaagatctgcagcttcactcctgagcccagcaagaccacgagcccaccgggaggaacgaacaactccagacgcgctaccttaagagctgtaacactcactgtgaaggtctgcggcttcactcctgagccagcgagaccacgaacccaccagaaggaagaaactccgaacacatctgaacatcagaagggacagactccagacgcgccaccttaagagctgtaacactcaccgcgagggtccgcggcttcattcttgaagtcagtgagaccaagaacccactaattccggacacagtattatacaaattctgtcagatttattcctaggtaccttatatttttgttgttgctattgcaaattataacattttaaaaatcaaaaaaaaaaaaaaaa

SEQ ID NO: 9351 - DNA, 470 bp, Homo sapiens
atttagaaattaaatcgaaataaaaccacaaataaaaagtccaaaccaccaaacttcacataatttaatgaaagaagggctttttctgaaaataaagagctaggtgcaatgcgaccccggagtgcgttgcttctttgtagagtttgggatgcctgttttttgtgtgtcgtgatgtgactcaattctttcactcctgtactcccagcactctgagaggctgaggcagcaggatggcttgagctcaggagtttgagacaggcctggacaacttagcaagaccttgtctttactaaaaataaaaaaattagccaggtgtggtagtgcatgcctgtggctccagtgacttggaagggtgagctgggaggatcatttcagctggagagtttgaggctgcagtgagctgtgatcatgccaccacactctagcctgggtgacagagtgagattctacctcaaaaataaataaacaaa

SEQ ID NO: 9352 - DNA, 477 bp, Homo sapiens
tttaaaggcccaaaatgctgaccactctaccactgatcctcagtagttcacacaagtaaaaaatatggcaagaccttgactcttatttcatataaggagaaagtgcagtatggaaagtgtaaatgacttaagtatgaaatcactgacaggtctgtgaatgtctgttagaacaagattgtgagaatggtgaaagattgaagagtttgattagatctatttaattctgttagtagaccacaatttttgtgaaaattttaagaactattacagagcttccgtgttttatttaaaacgattaataaaaatggaaagtggtacatgagaaaatttaaagccctttgcattttaagaaggttgtgtgcttgtagtaataacttacacttctgttgttgaattgatggcagttaaatgcttatttggatacattaagcagacataaagaaatacagacttttagcctggcatgttggcttgtgc

SEQ ID NO: 9353 - DNA, 490 bp, Homo sapiens
tgtacttcagtgtgttttgtagtggctggcagcggaaaggaaagtttttcctttccatatttagtgcttcttttgggagctctttcaagacaatgatgaataccctcagcatttgcttgtttgaaaagaatcttatttctcctttgcttattaagcttagtttggctggatasgaaattctgggttggaaattctttaagaatgttgaggccaggtgcggtggctcacgtctgtgatcccatcacttttggaggctgaggtgggtagatacctgaagtcaggagttcgagaccagcctagccaacatggcaaaaccccatctctactaaaaatacaaaaatcggctgggtgtggtggcatacacctgtagtcctggctacttgggaggctgaggcaggagaatcacttgaacccgggaggtggaggttgcaatgagctgggatcgcaccattgtactctatcctgggcaggaagagtgaaatgaagctcc

SEQ ID NO: 9354 - DNA, 475 bp, Homo sapiens
tatataacttatacacatatacataacttcaatgtacgagtggtaaaaagtacggcattagtcagtttgagttgctgtacaagatacccattcattaattcattgactcaagatgtatttactgagtgttcactaagcatcataggcattgaggatatcatgattgaggcagactggtttctactatcagagctttggttggtggagacaaaagacaaacaagcactttcaatatggtttgggatgttctaagggaacatgtaggggcaacaggctaagattcagaggcatttctctccgggtgggaggttttctaacacaaacacccaacttaagaacggggaggcaacctctcatccgggaacatctgcccctcacattgctttcaatatgcaataccttaagattccacagtgggtgttttcccaaaacaaagaatagaccctccacaggaaaactcaagtctcttccttag

SEQ ID NO: 9355 - DNA, 415 bp, Homo sapiens
tagaataattaggaatatgttaaattaagaataacaagaaaaaaagcaagccgtaaggaagtaactgattattttttcccttgggtcttcaaatctttgccttctttacaatgtccttaatttgcagaatgatactgtaaaatatattattgaaatagtataatagtgacttaagatcatgtgtgtggtatataacctaggattttgaaccaaaaagttgaatttctgctattctgagacaaagtgtcttcaaaagacttcaatatggcctggcccagtggctcacacctgcaatcccagcagtttgggaggtcaagcatgaggatcccccagcccaggagtttgcggctgcagtgagctatgattgtgcaatggcactccagcctgggtgacagagtgagaccctttctcagad

SEQ ID NO: 9356 - DNA, 443 bp, Homo sapiens
  misc_feature 246: n=a, g, c or t
gaaggcgggggacccgggacttccaagtgtgccccacacattgattttaattttcaacacttagcacctgacttagtgatctaagatcactgactcagaaaacaggaaaggtcagtctgcctaacacctcacccagcgtcctgggattagcatccaaaacaaacagatcagagatgggatgcagactcccaagagatgattcccacatgtgagaaagcccaggagaagcggatggcggatggcgtntctcaagctcgctgacgtcactcaagttcatgatccaaggcttcaccctactggggttggggggttgggttctactggaagagtgaagctggtggattaagaaaagtggtggtagggagagggagggaaaggagttctttctgctagtcaaaggagaaaccaaataaaatgaatgaagtccaaaaaaaaaaaaaaaa

SEQ ID NO: 9357 - DNA, 389 bp, Homo sapiens
gcctagcatcatagggaaaaacagctggagcaattgaagttagggttaaggatctcaagggcttggacttctcagaratgaagatctggatcactccatcaggcaagcaacgaagaccagatgaaatgctgcttgaagggctggcatatctagaattggtggtagaaatagaccatgaagactaagtaactgagaagatttaatgcagggtgcatatggattgarttcagggtgcgcttttmatccttttattactaatatcccagctgtccatcctccatccctcccccatgatttccgccaaggacaaagcaggaagggcccacagaaagtgcaactcaaaaagacaggaataaacactctgaagaagcgaaaaaaaaaaaaaaatg

SEQ ID NO: 9358 - DNA, 475 bp, Homo sapiens
ccacaccaagatgcataattggaaaatttcaaaataacagtaataaatagatgataatagaaagttcccgagagaaatataggcctcatacattggctcaagaaccagaatggtatctgatttcttaatgacaacattcaaagctagaagatgtggctttaaaattcagagagaaggccgggcacggtggctcacgcctgtaagtaatcccaacactttgggaggctgaggcaggtggatcacctgaggtcaggagctcgagaccagcctgaccaacatggtgaaacctcatctctaaaaaatttaaaactagctgggtgtgttggcacatgcctgtaatcctagctacttgggaggctgaggcaggagaatcacttgaacccgggaggcggaggttgcagtgagccaagattttgccattgcactccagcctgggaaacgagagcgaaattccgtctcaaaaaaaaaaaaaaaa

SEQ ID NO: 9359 - DNA, 385 bp, Homo sapiens
tttaagagtggtccaaggctgcacgcggtggctcatgcctgtaatctcagcactttgggaggccaagccgagtggattgcttgagttcaggagttcaagaccagcctggccaacatggtgaaaccccctctctactaaaaatacaaaaattagccaggcgtggtgatacgcacctgtaatcccagctgctcgggaggctgaggcaggagaatcgctcgaacccgggaagcagcggttacagtgagctgagattgtgccactacactccagcctgggcaacagagcaagactccatctcaaaaaaaaagagtggtccaaaagtgggaataaactagcaatggagatggcaacttagaagattaagtgggcgggtaccatggctcam

SEQ ID NO: 9360 - DNA, 538 bp, Homo sapiens
taaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaactttataagtgggctattgaaagaaaagttacaagcttaagatacagaagcatttgttcaaaggatagaaagcatctaaaagtttaggctcaagatcaakctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctga

SEQ ID NO: 9361 - DNA, 447 bp, Homo sapiens
tatatttttagtagagacgggctttcaccatgttggctggggtggtcacaaactcctgacctcaagtgatccgcctgccttagcctcccaaagtgctgggattacaggtgtgagccatcgcacccggcctgtaacaagggacttcttatgagtgtggggatgtgtggctggggtgtttgcaggggtttaggaggaggatctgcttcaggacatgaatgggcttgtccccagcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgccgcgacattgtgcagtttgtac

SEQ ID NO: 9362 - DNA, 64 bp, Homo sapiens
cagacactgtgctaggagaatggaaaacaattttgaacaaaactgtctacctacatgatttttt

SEQ ID NO: 9363 - DNA, 415 bp, Homo sapiens
actttctttgctgcgtctactgcgagaatgaagaccatcctggctaacacggtgaaaccccgtctctactaaaaataaaaaataaaaaaaaaaagtagccgggaktggtggcgggcgcctgtggtcccagctgctcgggaggctgaggcaggaraatggtgtgaacccaggaggcggasttgcagtgasccgagttcgcgccactgcactccagcctggaccacagagcgagactccgtctcaaaaaacaaacaaacaaaaaaaactgtcaaccaagaatcttatatctggcaaattgtccttcaaaagtwtgggaaaggctgggcgggatggctcatgcctgtaatcccagcacttagggaggccgaggtgggtggatcacttgaggtcaggadttggagaccagtctggccgg

SEQ ID NO: 9364 - DNA, 413 bp, Homo sapiens
ctcttaaactaatgaaatgagtggcaggcagcgtgtgcagagcmcagcaaaggctcagagggatgcccacagagttccaccgcaaccgtgcacagaggaggaggagaatgctccctacaggtgaaaactaggctaatacacaatgattgaagactaaaggatgagaagagccaccagtggggcgcattcacagagaaacggtcacatgatgaggcagcaagaaggcaaaaattgcgagccaacaagagaggcctcagaagaatccaaccctggtgccgccttcattttaaacttccaacaaccccagaactgtggaaaaaaattctattttttgtctgtggtattttgttatggcaaccctagcaaactaatacactgagcaaactaatacattaaacagaatattaaaacga

SEQ ID NO: 9365 - DNA, 425 bp, Homo sapiens
tattttatggataaagtgactggggaatttagttaatgaatttgttctcatcaaacctaagaaaacttccctttagagagagtagatggcatctttcagaatataatctttgaagactgacttgaagcagtttgagtgttgtaagacattggttcaacaggtttgctttcagtgaacagaaaatctaatgcatagcctcagcttctcatatcaagcctttccatttttagaactgctttctgttgactgttgtagccagtagagagaaaatgttggtcaggggattacatttcttttaaaattcagtgtacttaatgaggagatagaaactgattaataaatatcaagttgaaaagggtaaatgatgaaaaggtagacaaaatatatagttcatttacatgcggataaaattttctggtatatgt

SEQ ID NO: 9366 - DNA, 456 bp, Homo sapiens
tgcaagatttaatagagtgaaaacagagctcccatacaaagggaggggacccagagagggcagccgttgccaggtttatatccctatcattgtccctcctgctgtgctctgaggagatagatgattggctattgtttacctcctgttttagcctaattagcattttagtgagctcgctttactacctgactggtcgggtgtgagctaagttgcaagccccctgcttaaaggtggatgtggtcaccttcccagctaggcttagggattcttagtcggcctaggaaatccagctagtcctgtctctcagatggacatttggatagtggacgtatgtcatggatatttggatagcagacgtgcgtgggtggacatttggagagtggacacacgtggttgtgtggctgcaggtactcactgtagtgtatttatccggaagatgtgcacgttgctcctgac

SEQ ID NO: 9367 - DNA, 498 bp, Homo sapiens
  misc_feature 264: n=a, g, c or t
tttggattgtttcttgctattaatactatgagcaaccctgcaattaataaactgaaatgtatctcctaggttacacgtgctagarattctctcagatttctagaagtagagctggcttgtaaagtgtacaagattttaagctatagtaagtactgctgaaatagctttcaagcatttatgttctcacaagcaatgggtaaaagtgccgcttggccaggtgcagtggtttcacgcctgtaatcccaacactttgggaggccaagntgggtggatcacgaggtcaggagtttgagaccattctggccaacatagtgaaaccctgtctctactaaaattacaaaaaattagccgggcgtggtgtcaggcacctgtaatcccagctactcgggaggctgaggcaggagaatcacgtgaacttgggaggcggaggttgcagtgagccgagatggcaccattgcactccagcctgggtgacagtgcgagactccatctcaaaaa

SEQ ID NO: 9368 - DNA, 373 bp, Homo sapiens
gtctctgccgcggcttcctcggctgccagctctccggcgagccgagtcctagtgccgtaccgtcagtccccggccgcgcggascggratgcactgttcctgctgtgggtcctcatcatggagaccaaacgggtggagattcccggcagcgtcctggacgatctctgcaggatatgtgaggattacttcatgaaaacaaggaagtgaattaaggaggatgaaaacaaaaagacaagacacatgacctctgtgggataaaggcacagggaactataggatgcttgtgaaagggcagtgtagagttgacagatgtgtaccaggtgtagaggacagctgatccagactagaacagatcagaagactagaagtcttaa

SEQ ID NO: 9369 - DNA, 390 bp, Homo sapiens
ctctcatttcctttataagaaatctttacatatatatatatatatatgactgttttgctttgttttgagtttcataaaaatagtatcatgggggccggtcacgtggctcacgcctgtagttccggcactttgggaggctgagacgggcagatcacamdgtgaggagatcgagaccatcctggctaacacgggggagccctgtctctactaaaaatacaaaaaaattagctgggcatggtggcaggcacctgtggccccggctgctggggaggctgaggcaggagaatgacgtgaacccgggaggcggacttgcagtgagccgagatcgcgccactgcactccagcctgggcgacagagggagactctgtctctcaaaaaaaaaaaaaaaa

SEQ ID NO: 9370 - DNA, 544 bp, Homo sapiens
acttagcatgttaggtgtattamctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatcvttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcag

SEQ ID NO: 9371 - DNA, 451 bp, Homo sapiens
gatattattagaagtgtatgacaaagggtctgtggagaatcattatctaagtgccgttaaagccgagacctgaaggagtggcaaagagtgagggaaagctgaccatagaagcagtagaaatgatgtgtgcagaggtttaagtgggaaggaatgtgacatatttagggtactcaaaaaaaggcaaatgttgctagagcagagggatggaatatgagtggtgaggaataaggcctgagaggtaaagaggaaacaaaatttatgaattaaacaaatatttaatgactctactctgtactaagcactgttctaagttttggggattcagtatgaacaaaccaggcataactttctgttctaatggaatgtacactctattgggaaaaacgtgataaacaaagtaaataaatcatatatgctatgttagtgataagtgccaaaaaaaaaaaaaaaa

SEQ ID NO: 9372 - DNA, 272 bp, Homo sapiens
taatattgttttatgattgatattaataggggaatctgcaggatgtgtaactttctaatcactggagagcacaagaaatagcaaaatgtggaaagtgctcattttttataaagactcatttttttcactaacaaattttagtgatttttttcccacatgtgtaaatattctttctgatgataccacagaacagaacatttatttatataactaccccctagggttttttcttttttctttttttttcttttctttttttttttttttttttt

SEQ ID NO: 9373 - DNA, 420 bp, Homo sapiens
taaaagcaaaaacagtatattttttaaatgacctgttttgtaaaggtatatgaaaaagatgtcggggtcacagtggataaaaagaggatacctctaaagcaaactctgcaggtaagaaaacaagtcagagggcctgaaaactagaaatattcatgatgattttggctttccaaaggagacaagattgttgcaagtagggtaataaagcgaagagctattttctcatttcaaaaaaacactgagggccgggcatgctggctcatgcctgtaatcccagcactttgggaggctgaagtgggcggatcacgaggtcaagagatcgagatcatcctggccaacagggtgaaacccgtctcgctaaaaacacaaaaaattatctgggcatggtggcgtctgcctgtaatcccagctactcgggar

SEQ ID NO: 9374 - DNA, 426 bp, Homo sapiens
tctgttaagatttcatatttattatgtagctaaagggaaaaaagtagttgcaaaacagtatgatctcatttctagactcatcagcatttggcacagttgcgtccttcctgaaactttcttcagttggactckcttggtttttctcccctctcattggactctgctccatctctttacctccttggtccctggttggagggccccagtgatgagcactcagctttgtggatgtcttcttctatagctacactccctaggcctaaatgagcttctgtcagtcttgtagcttgcacagtctacaaccaaagattcctggatttccatctccagcctggacctctttcctaaattctcaatttggttatccagctgtttactcaacaagtccatctacatggctgagtatctcaaaattaacatgtctaa

SEQ ID NO: 9375 - DNA, 237 bp, Homo sapiens
tttatagttgmaattraccttttgaagaaaaggtasattaaacgttcctaggtctaacccctgkttcttaagtttgactttgcaaccaractgaaatagaggaggaattkaksaacatggatgagttggwaagcatactctcaagtcattggatgttttaaaagwwraagatatctgaatttatttaaagggaagatttttctctatagcatgtarctagctagcatgtcttttagt

SEQ ID NO: 9376 - DNA, 438 bp, Homo sapiens
aatgataacaagtgtttgtgagggtgtagarwagagggtgcccttgtacactgttggtaggaatataaattggtatagccattttggaagagtgtggaggtccctcaacaattaaaaatagarstatcatatgatccaggacccctatttccgggtgtatatccaaaggaattgraatcaatacctcaaagaggtagctacacttccatattcattgcagcattatgaaccacctaagtgtctgtgatggataaatggattaaaaacatgtagtatatatatacaagggcatattattcagccataaaaataaggaactaggctgggcacggtggctcatgcctgtaattccagcactttgggaggccgargcgggcggatcacgaggtcaggagatcgagaccatcttggctaacatggtgaaacccgtctctactw

SEQ ID NO: 9377 - DNA, 480 bp, Homo sapiens
ttgagatggagtctcactctgtcgcccaggctggagtgcagtggcgcaatctcggcttactgcaagctcagcctcccgggttcacaccattcttctgcctcagcctccctagtagctgggactacaggcaccccgctaccatgcctggctaattttttgtatttttagtagagacagggtttcaccttgttggccaggatggtctcgatctcttgacctcgtgatccatccgcctcggcctcccaaagtgctgggattacaggtgtgaaccactgtgcccggcctgttggagacatttctaattgtcaataagaaaggcaaaaaaagaagagtgaaaaagtttagagtaagactatcatctatgcatgtgactgttaggagtagagtttaaggccacattccttgccacagagtctaattccagcttgttctttgtctccttttacctgtctttaagctttttttttkcctttggaggga

SEQ ID NO: 9378 - DNA, 444 bp, Homo sapiens
cattaaaatataagaataggtgaatttgtaataggtttatatttttcagcctttcaggtgccctttcaagcttgtgggtttaagtttgattatattgggaaaaccttgctaactagcacatcagggttagggagaggcttgctgaagtaacttcaggcacttgattgaactgagaatttattaagtaataagtctagcataattttatgggagctggagggtagagagttattcaagtgaaacaaatttcatgttaagaaatttggggccaggtatggtggctcacgcctgtaatttcagcacttcgggaggttgaggtggatggatcacttgagccaaggagttccagaccaacctgcgtaacacagtgagaatctgcctctacaaaaaataaaaaacttagccaggcatggtggtacgtgcctatagtccactacttgggar

SEQ ID NO: 9379 - DNA, 482 bp, Homo sapiens
cactttgagttaaccatatcctaaattgcactcacatgtaatttgcaagaggattagttagatttttgtgacatttctggtatgtgaccatctttttagaagtcaaaaacttaagcaagactttttgtcagtgttgcgacttagggacataaattattagtatctgaaaaaatactattcgtgtttgctgataattcataatcatatttttaaacacacacaacttaaaattatttttcataaaagcaactttttgttatttgacattcatcctgaaaattaggcttttataatcagtaccattaatgaaagtggaaaaactgaccattaagctaatttttgacaggagtgaataggagacagatgatctatcagagtgatacaatgctatgcaactgctgaagtagccatgcacatgcaggaaaaaaaatatgcaaaggttatttgcagtttaatattaagtgaaaaaagcagaatacagg

SEQ ID NO: 9380 - DNA, 250 bp, Homo sapiens
taatattgttttatgattgatattaataggggaatctgcaggatgtgtaactttctaatcactggagagcacaagaaatagcaaaatgtggaaagtgctcattttttataaagactcatttttttcactaacaaattttagtgatttttttcccacatgtgtdaatattctttctgatgataccacagaacagaacatttatttatataactaccccctagggttttttcttttttctttttttttcttt

SEQ ID NO: 9381 - DNA, 305 bp, Homo sapiens
  misc_feature 99..100: n=a, g, c or t
taactgtattcaccatgctgtacaatagatctccagaatgtattcattctgtctaactgaaacttaggatcctttgaccactatmhmcccatttatmannccctcccacttccccactaccagcccctcctgggaactgmcctctactctctgcttctgtgagtttgactgctttaaattccacacaaaaagtgagatcatagagtatttgtctttctgcgcctggcttattttacgataaattgattgcwtctcttcccattgtttatagatacccattctcgtaatgatggcactgtgtctgw

SEQ ID NO: 9382 - DNA, 325 bp, Homo sapiens
aacaagagttgcaaagtagaaaactgtcagtgaatgtcagctctctctattatccctcagcctcccgagtagctgggactacaggcgatggggccgatttttaatccactaacaggtaccttgagactagggctcactatactttggtcagagatgctctaggbatgaagattatatttgcatgaagctaacattttttcaagactacgtgattgcactgctcaaacttacattatggtttccagagacagctagagcttccttgttcattaactttgaaaggaagcattttccctgggaagaggtgcccaagcctcttttgtaa

SEQ ID NO: 9383 - DNA, 381 bp, Homo sapiens
cctcaatatccatcctttttcatagtaatagaaatttctataacagaagtaaagactatacatttaagggatagtcatatgactaggttctgtctactgggatgggagcagaactttatgtgatgttttgggccatgactttwaaaaggaaaagagcatgccttccttcttttcttctcttctttcttctggctggaaaataaatacaatggtatgggctggacctgccatttcagatcctgagattaaagctgcatgctgaggatgacagagtagcaagataaaaagcacctaggtcctcagtactgtgatggcaccatgtccgccctggatcctttagactcagattgtttcatgaaaaagaaataaggactgagcatg

SEQ ID NO: 9384 - DNA, 362 bp, Homo sapiens
tgtaccctcagtggagcccttctggtcttttcttccacttctgcagaatttcctctagcaaatacttctttctccttgcttgcctccaccatgatatttgaataagagatggccagaggataacacttgtctcttaaaaactaaagctaaaaagaacctagaaccttcaattgagcagttgtgaaaattgctaatggtgccaaggccaagcaaagagtttcagaaaatgactgagaaggagcgataacccccagaatgcaaaatcaggggcatcattatccggtgcttgaacaaggagctccgctctacaactggtttttttaggacttgtgaggaacacagcaacggaaatccatccacaa

SEQ ID NO: 9385 - DNA, 436 bp, Homo sapiens
tatagtgctatcaagcaatccctggtactttggacttccatggcttgttatataaaattacatttttacatgtaaaaataaactaaacaaatctaatgataaaatataatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgah

SEQ ID NO: 9386 - DNA, 127 bp, Homo sapiens
gccgccgcggtggcrcgtgcctgtaatcccagctactcgggaggctgagacaggagaattgcctgaacccgggargcagasgttgcagtgagctgagatctcaccattgcagtccaacatggacaac

SEQ ID NO: 9387 - DNA, 336 bp, Homo sapiens
catagacttttcaagacttggattatatrarcccattgttcagctagatgtttgttttaaatgttttttagccaccagaaaaaaagtgattatctagtctagacttgttcttctaccattcttcagccaagctgttcagaggcagttttgctgagatagggagtgagataatatgtttcagtgaaaaartaggcagtccactccttgctggcaggctatgaggttgattacttaakgcctgagccagagrgtgastccaaattacagtttcctckggaatgatgcaggcttcaaawttcastgggagtggggagtagagggtggagagaggagaaa

SEQ ID NO: 9388 - DNA, 88 bp, Homo sapiens
agtgtgtggcagcggcggcggcggcgcggcgaggctggggctcttgtttaccagcattaactccgctgagccaaaaaaaaaaaaaaaa

SEQ ID NO: 9389 - DNA, 510 bp, Homo sapiens
  misc_feature 439: n=a, g, c or t
agcaacctgctctggtccctttccacactgtggaagctttgttctttcactctttgcaataaatcttgctgctgctcactctttgggtccacactgcctttatgagctgtaacactcactgcgaaggtctgcagcttcactcctgaagccagcgagaccacaaacccaccgggaggaaggaacaactccagacgaacaactccagacgtgccgccttaagagctgtaacactcaccgcagaggtctgcagcttcgctcctgagccagcgagaccacaaacccaccagaaggaagaaactccaaacacatccgaacatcagagggaacaaactccagacacgctgcatttaagcactgtaacaccgcgarggtccgtcgcttcattcttgaagtcagtgagaccaagaacccaccaattccggacacactaggattgcanhgctacactcagtgtgggcaacagagtgagacctcctctcaaaaaataaataaataggcatggtggctcac

SEQ ID NO: 9390 - DNA, 447 bp, Homo sapiens
ctaattggtttccaagcactcacagctttatttcctaagtacctcaagcttatgtattcatcattcaggcttttaatataaatgcataatgagaatctaccttttgtatcagcaggatccaagacatgattcctgctctgaaggacctatgtcttactcatttttgagtcctttgcctgaaacacagtaggctttccataaatgatgaatgcacttctgtaacctagtactcttttttgattgtcttgattaggattaggtattgttctaggaaacactgtcatcttgtacacatttatttcatactgactttgatttgacagcgaagtatctagtaagtctcttgttcagaagatgtgaccatcatattgtatggtaagtttgtaggatcaagcacatataagaatagcatcccaaatataacagtgctgattctatgcagtatct

SEQ ID NO: 9391 - DNA, 433 bp, Homo sapiens
tgtgagacaaaaacttattaaggttaaatagaattgtttcttctgaataatctaacaaaggaaaatataagtsattgamtcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattat

SEQ ID NO: 9392 - DNA, 104 bp, Homo sapiens
attcgcctccaagtcgccgaagagcgaacaccccaaacaatcccgaagcgccaccaaaaaaaaaaaaaaaaaaaaaaaaaaaaaaaaaaaaaaaaaaaaaaaam

SEQ ID NO: 9393 - DNA, 435 bp, Homo sapiens
cccatatagtgtgcctggcacatagtaagaattattgaataaatacgaagcccttctagttagaaaattttgtctccgacattgaggatagtaatttagagctgcaaaagtttcactctgttgttagtcctacttctcctctacagataaggtatgactgactctttttgttccatattaatgcctattcccttttggcccaaagtctgtacctgtacatacaggtagatacaggtacctgtctgtacctatacagatttacataatttatcagatgttcccttctattcctatcctggttcatagaatgattatctttaggtttttgggtacaaatgtagaaatcaaaacattagttgtatctcctacctttggcagtagactaaaacccatactccaaaggactgtttactgctttcccagacttttctcttg

SEQ ID NO: 9394 - DNA, 414 bp, Homo sapiens
catccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatatdcatgtttatttaagaaatggaaaaaaaaatcaaaaatcttaaaaaaacaagcaaacagtccagcttcctgtcctcctaaagtggcccctgttcccatctcccgggccagamagctgtccccccgtcctcctccccagcccagcctgctcagagaagctggcaggactgggaggcgacar

SEQ ID NO: 9395 - DNA, 423 bp, Homo sapiens
  misc_feature 412: n=a, g, c or t
gcaccaaacttttctaaagagctttttactttcattctaaaatatctctgtacatataagcacattcctagcttttaaaaaatattttacttggccgggaatggtgactcacgcctgtggtcccagtactttgggaggcccaggcgggcagatcacttgaggtcgggagttcgagaccagcctggccagcatggtgaagccctgtctctactaaaaatacaaaaaattggctgggcgtggtggcgggcacctttaatcccagctactcgggaggctgagacaggagaattgcttgaatccgggaggctgagacaggagaattgcttgaatccgggaggcagaggttgcagcgagccgagatcgcgccactgcactccagcctgagcgacagagcaagactctgtctcaaaanaaaaaaaaaaa

SEQ ID NO: 9396 - DNA, 485 bp, Homo sapiens
agagctgaaagggatcatctagtccaacccattcatttcatgggtagagaactgaaacccagaakaaaatagaaatgccaccacctcggtgccagatctcctagatgcccacctacagawwccyttkakaawtgaaatgtgtcaacctttctggcaatacgaccagcccacaataagttactgtgggggtgcatcatgaacttctctcccataaagtcctttgaaacgaaatgcacaggaagatacgatggaaacacaccttagaagacttgagcttggacctgagcacaatcacaacagctgggccgaatcasgtgaccataaacaggcagctagcttaactgagatcattggtagccagggggttgctaccaaactttggtaacctcaaggacaaaatgaggaagatgtgttcattgtggactctaaaaacaaaaacaaaacacaaaatcccctgttcaaataaacaaaaaatccaagattga

SEQ ID NO: 9397 - DNA, 471 bp, Homo sapiens
ttccggcgccgtaactgctgccatcttctccgcgctatggctgcgttcggccgtcagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggaagtaccaccaaga

SEQ ID NO: 9398 - DNA, 445 bp, Homo sapiens
actctccaaaagtgaaatgttgtcactgtccattcaactgatgaaaatcttccttttcaacagaaaaactatcatgatgttgtctgttgggcttcagtttcttacagcagtcatcttaagaattaaactggtatggataatctgactatgaactccttgagggcagggaccatattatataatacttctgtgtcctctgctatttcttagcagaattttgaaaatgtgccaagtgttgacttggttcgatcacttgtgagaatggagggacccataatgttaataatcaatgaaggttgttggagttacttacccaaaaccttatgaacttagccttccctagcagattgattttcctaatttgtccggtataagcaaacactaaagagggattggggaaagttgtgagttgagtagttgggaaaaaggtagtttgcagttttaw

SEQ ID NO: 9399 - DNA, 420 bp, Homo sapiens
  misc_feature 420: n=a, g, c or t
ttccattgtgtgtgttttcatgccagtattataaccgtaataggtccgttgccccatgagcacagcatgtcaatacagcaggttgcagcaaagaaagacggtttactgtaaggctgcagaacaaggaggtaggatgaaaatgaaaatccgtcctcccagggagtttggagctagggtttttaagggttttaaagtgtggaaatcactgcttaaagagtgcagtgtggagtcatgagacaggaagatgaagaaactattctcatgctgattctgttcctctgtggttgtcttcagactgcttggcatcagctatttcactggaatttgggacctgagaaacatcttgtgcaattcttaaaagcctcatgattctaacattagaaatcctatgtatgggaacagtggggactctgtccaaan

SEQ ID NO: 9400 - DNA, 411 bp, Homo sapiens
gattattaaggacaatttttttttttaactaaaaaagttggtggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgtkgttttttttctcaactagttaagtcaactgcttctgaaa

SEQ ID NO: 9401 - DNA, 407 bp, Homo sapiens
atttctgtagtgtctagcacagtacctggtgtaaagtaagtactccgtaaatatttgtccaagcagtgattgaatcacaacagaaattctaacacacagtaaagaaactgaatggaaaaggggaatggaatgatgtcattgtttactaagaagaccaattcaagcaaggactatttatgagagaattagttagcacagccttccaggacaatggcagcttatgtcaagagctttaaaaatattgtttggttcaggagtccgagcttgtagtcatcgtaaggaaatcaacagtcaaagatgtacataataaggacactcatcaaagcatctgttgcagcaaaaaattattgaaacaaactggcaatatgggaatgattaaataatagtacatctatacagtcaaatat

SEQ ID NO: 9402 - DNA, 263 bp, Homo sapiens
ccaagagaataacaacagaaaacccagacaaaaagaattgagtaaaacggcagaataaraaaattagcaacaaaacccaatactttttatatatacaataatttagtttgaaaatatagtggaagagggctgggcgtggtggctcatgcctgtatcccagcactttgggaggctgaggtgggcggatcacgaggtcaggagatcaagaccatcctggctaacacggtggggccctgtctctactaaaaatacaaaaaaaaaar

SEQ ID NO: 9403 - DNA, 176 bp, Homo sapiens
agagctgaaagggatcatctagtccaacccattcatttcatgggtagagaactgaaacccagagaaaatagaaatgccaccacctcggtgccagatctcctagatgcccacctacaggtaaggcatctttaccagttctttatgcacttgcaaatggccacttagagataaatgaa

SEQ ID NO: 9404 - DNA, 317 bp, Homo sapiens
  misc_feature 288: n=a, g, c or t
gcacaacatttggctcattttatttttctcattgttattttttgtttttattttttgagatggattctcacactgttactcgggctggagtgcagtggcgtgatctcggctcactgcaacctccacctcctgggtttacacaattctcctgcctcagcctcccgagtagctgggattacaggcgcccgtcaccacacctggctaatttttgtatttttggtagagatgcagcttcaccatgttggccaggctggtcttgaaatcctgacctcaggtgatctgcctgcnttggcctcccaaagtgctgggattacagg

SEQ ID NO: 9405 - DNA, 455 bp, Homo sapiens
aaatgtaagaccccaaattataaaactactagaagaaaatgaggggaggatgcttctcgactttagtctaggcaaagatcttatggctaagacttcaaaagcataggcaacaaaacaaaaatagacaaatggggctagattaaactgttaggttggtgcaaaagtaattgtggcttttgcctwwttttcttttaaacagcaaaaatctctcttttgcaccaatctaataaaaggcttctacacagcaaaggaaacaagcagcagagtgaagagacaacctgtagaatgggaggaaatatttatggatattttacctgtatgttttgcaactatttaacctgtacaaggggagagaatatttgcaaatattgcaaattcagttagragacaatacagtagaaaaatggvcagragaaaaataatttcaccagcctgggcaacgtaagtgagactct

SEQ ID NO: 9406 - DNA, 255 bp, Homo sapiens
tagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaaaaaaaaaaaaaaaaaaaaaaaaaaaaaaaaaaaaaaaaaaaaaaaaaaaaaah

SEQ ID NO: 9407 - DNA, 276 bp, Homo sapiens
aaatcattcttaaatttagtttaaaaaggaatatgatctgtttactatatgaaagcacctaatgtacaacctataatgcttttctgaagtgactgtagtacaaataccaaccatatttgcagcaacactgagagacagaaaaactgatgacaatgtcttgttttgattaaacatccagagccatataagtaatactgttttttaagcacccttgttctgggcatgtcagtatctgtatttcgtagacccccttttttttttttttttttttttttd

SEQ ID NO: 9408 - DNA, 454 bp, Homo sapiens
cagccagatatgtgaataattgcaggaaaaacattccaggtagaagaacagaaagtgtaaaggctaggaggtaagaaagagctcgatatttcacaggatcggaaaggagcttgttgtggctcgaatgttgtgamctaggaagagagatgcacaacaaggggttagacaggcaggcaggagccaaatcatttggggatttgtaggccatagtaaagatgaagtttgaattttattttgagaaaataagaaatactttagaaagagtttaagcagagtaatttcataatctaattttcatttttcaaagaccactctggtttatcggtagagaagaattagaggggaggcataggaaaaacaagaagactggttaggcagatgtgctagtcaagatggccaagggtagtggcaggttggattttttcctctagtactgtcaagtagcattttggga

SEQ ID NO: 9409 - DNA, 444 bp, Homo sapiens
aaaaatatgtatacttccaaatctcattcagttgaacatttccaaaacgtctggtacataatgtctgagaatgcccaggtcctcctggaggctgggtatagctatggtgaggtgttgcagtcatgaagarggaktkgggtccttgcctgcctgccctacagtgagcaatccctagaagcgctgttattcaggttgtcttgctttttgtcttttgaaatgtttggatttgggatgttttggaaatttccccatccaaaatttttggaagatagggatggggatgggaatgatccctgttccttattttyyatttkyatttttttgatacagggtctcgctttgttgcctagactggagtgcagtggtgctatcatggcttactgcagtctccacctcccaggctcaagcaatcctcccacctcagctactcgggagactgagaca

SEQ ID NO: 9410 - DNA, 137 bp, Homo sapiens
atttttactggttcttctgaattgacagtaaacctgtccattatgaatggcctactgttctattatttgttttgacttgaatttatccaccaaagacttcatttgtgtatcatcaataaagttgtatgtttcaactg

SEQ ID NO: 9411 - DNA, 553 bp, Homo sapiens
agagctgaaagggatcatctagtccaacccattcatttcatgggtagagaactgaaacccagagaaaatatgaaatgccaccagcctcggtgccagatctcctagatgcccacctacagatamcttttataaatgaaatgtgtcaacctcttctggcaatacgaccagccccacaataagttactgtgggggtgcatcatgaacttctctscccataagtccytttgaaacgaaatgcacagggaagatacgatggaaacacaccttagaagacttgagcttggacctgagcacaatcacaacagctggcccgaatcasgtgaccataaacaggcagctagcttwamctgagattcattggtagcccaggggtttgctaccaaactttggtaacctcaagggacaaaatgaggaakgatgtgttcattgtggactctaaaaaacaaaacaaaaacacaaaatccccctgtttcaaataaacaaaaaattccaagattgattcatgaaaataaagaagacatgaattgtcaaaaaaaaaaaaaattgcgaaagc

SEQ ID NO: 9412 - DNA, 451 bp, Homo sapiens
ttttatttttatttgttttattattattgttgttgtttcttttgtgttttggggttttgtttttgttctttttaagaaacgagatcttgctgtttgctaaggctggttctccaactcccttggcctcccacattgctkagattacaggtgtgagccactgtctcctcaagtcctgtttaactacccatggttcccttcatgtgtaccccacagaatttttgcctcttatgtatggctcaggcttcatcccagcccctgacatgtatacacacaagtacacatacacacacgcaacacacctggctgatttgattgtccttattgagatgtaactagttgtgacttcgktttagtaatcytctgatcagggatagcttgcyamccccaaaattccctaaagccatasccacatctccactgtgtkattaatagcctttgtatactcgacttc

SEQ ID NO: 9413 - DNA, 407 bp, Homo sapiens
tcagacttccagaaggaaatcaggtatttggcataaaccatgttatttgcacagtctagcataggaractacccttatcagtcagggaaaggtaagctcacttccaaaaccctagttcccaaatgctastccaaggccaaccttgcagacaggcccttcttaagatagcagcctcagactgcacaaagataagtacttggcttcaaggatttcagtggataggcaacatgtaaaaataggctcaggagcctggacagttgctgcctgttttcatacatgagagataaatacttttgtgcttgcattcgtacatataactcactattagtaatctaagggaacttcattacttggaaattaaattcaggagattttggkgccctgctcttttgtttgagaatcactgc

SEQ ID NO: 9414 - DNA, 308 bp, Homo sapiens
ggggcaagctggcaacgcggtttgtcttgacggctgcttagggcggtaataakggatcgaagaggatagcattcttgaatgggaaacattggtggcgccacagctggctggtggcgacttcaagacccactggaaggctgggattggmagccatgactcataagggcggaataccacggggatcggtttgtctggcgaacttgagtgaagggtcaagatctcggatttcacctttcctctgagcttcctgataacccggacgttccgtaaacccggrtccggagccgaaagtggtgcccagatcccgk

SEQ ID NO: 9415 - DNA, 408 bp, Homo sapiens
tcatctatgtttatcacattttaataccacagcacttataatgatgtcactacatatagaagctcaaagttaagggatttgctgaagactgtaaagttaatggaagaattgagacaaaaatccagtgtagctggccacttatcccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctct

SEQ ID NO: 9416 - DNA, 305 bp, Homo sapiens
caaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaatttttttttttccctgrgtaaaagcaagaaatttcttcctttggaaaaaatatatatattaaaaaaccacttttagatggttttttttaaaaaaaar

SEQ ID NO: 9417 - DNA, 439 bp, Homo sapiens
cacaacaatttggcttaaacagcactttggttgaaaatgaatatcccctagttatgtgtttttcaagtattggtcattttggtatatcatgagttgttttgcaaacttttgtgccaaagttttcaggaaaactttctaatatttgcttttgtgtttctaactgattttcagagaagttgtaattttgatgttttttccttttagtgagcatgctttaacaaaaaacaataacagaaactgtgtcaaagaaaaggacctgtaatcttcagggtttgtagtctttttcctcttaaaaaacccttttcctaattaatggcagttacatctgcatggctggtttgggtaagtcttcattttgttgtattgctgagtaacagtcaacaaaggtttatcaactcttggttaagggttcctttcatgttgtgagtaacatgaacaa

SEQ ID NO: 9418 - DNA, 464 bp, Homo sapiens
ccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaa

SEQ ID NO: 9419 - DNA, 430 bp, Homo sapiens
tacatttcagtctttaatccatcttgagttaatttttgtttatggtaaaacataggggtccagtttcattcttctgcatatggctagccagttatcctagcaccatttattgaatagagagtcctttccccattgcttatttttgtcagctttgttgaagatcagatgcctgtaggtgtgcggctttatttctaggttctctgttctattccattggtctatttgtctgtttttataccacaaccatgctgtcttggttactgtagccttatagtatagtttgaagtcaggtaatgtgattcctcaggctttgttcttttgcttagtattgctttggctattcagtctcttttttgtttctttatgaattttagaatagttttttctaattctgtgaaaaatgacattggtagtttgatagaaatagcat

SEQ ID NO: 9420 - DNA, 368 bp, Homo sapiens
agagctgaaagggatcatctagtccaacccattcatttcatgggtagagaactgaaacccagagaaaatagaaatgccaccacctcggtgccagatctcctagatgcccacctacaggtaaggcatcttaccagttcttatgcactgcaatggccactagagataatgaagctgaggtagaagagataatttaatccagaatatcagaaaagtaccggtcagatgcggtggctcacgcctgtgatcccagcactttgggaggccgagcacaccatggaatctgaagtgattcagaatggctggcttttgaaattcctttgaactaaataaagcaccttcatttttacttgaaaaaaaaaaaaaaaaaa

SEQ ID NO: 9421 - DNA, 413 bp, Homo sapiens
tacataaacatgttcataaagttamatgaagtaggatataaaattssscctartstttatmmaagyvratatatttacatgmmaggagaaaactcacctcccactcttacagcctctgccagtttaccatagctagtttcttgagcagmtaatctatatgtcttcagcttttttcattgaattcattataatctggattctgccttcatcattgcactaaaatttatctcctagttgccaaatccagtgtctcctctcttagtccccaaattgacccctctgcagtattttgatactgttgaywgtkcccttgttgaaacattcctccattctgaatgtccaccaataaacagttggttaaataaaaattatagtgtatagttttayaatagagtattctgttgtagaccaar

SEQ ID NO: 9422 - DNA, 422 bp, Homo sapiens
  misc_feature 409: n=a, g, c or t
ccattataatctatatacattwaaagaccgtgttacataatctcttctgggtagaaaatggaaaatacttaacctttgcattggtcctttcaggcttgaacaacagtggctgtatctgcatcgtggggttgctggtggtagaacactttggtgttaggaaagtttggaaaagaggatatcctgtattaggccattatgattagagataagcagcctgggagaaacatacaagacctgtggctactggtagagaattggaataagcttccaacaatggactgtagagattaatggagattgtttagtgggcccatggctaggtggggtattaatacagttgaagttatgttgcccttggcacagatctttgagaatctcatacatctgtgaaaaagataatgtgaaatanaaaaaaaaaaaaa

SEQ ID NO: 9423 - DNA, 454 bp, Homo sapiens
  misc_feature 20,386: n=a, g, c or t
ttagaaagtaaagtacggangaataagggctcaggaatcacagcctcactaattactgtatgtcctttcgtaatattcttaacctaagtttcttttgttttgttttgttttgagacagtctcatcctgttgctcacgttggagtgcagtggtgtgatcatggcccactgcagtcttgacctcctgggctcaagtgatcctcccacctcagcctcctgagtagctgggactacaggtgcatgctaccatgcctggcaaaaaattttttgtagagacgggtcttcctgtgttgcccaggctggtgtcaatctcctgggctcaagtgatccaatcaccttgacctcccaaagtgctgggattacaggtgtgagccaccatgcctaggbncaagttttatcttcataaacgtggatattttctaccttgtagaactgttgtgaaaaaaaaaaaaaaaa

SEQ ID NO: 9424 - DNA, 435 bp, Homo sapiens
atagttccctgcggsctctgccttggggagtatgtttgtaccgagatccgcgctaccagattgcaccggggctgatttgggggctgggaatttgccattctgctgtacagacactgatttttttttcttctttttaaaaagcaagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcaggtaagaaatggtttttacgtgtaatagttatacaactgatgtataatatttaaaattaaatgctaatcaaaaaaaaaaaaaaaa

SEQ ID NO: 9425 - DNA, 426 bp, Homo sapiens
tttttcaacaaaacaaggtcctagaagagawaaacataaagaccttttacctatgcctacaacttggatatctacttttaattaagctgagtgttctttaagaaaatccttttaaatcccctattacctgactttagccatcccaagtggccaatatttctggctttcaaactttactaaaggctcaaagaaagtaaaatccaaggcatttcgtggaggggaagagaatcaacaaatagcaaaggttgcacaggtatcaaaccaaaaaggactcattccctaagccaggatcgaaccccgggccacaaatgtaaaatggcagaggctagaacaaaacattgtcatgtggttacaggtctggctctgaaggacgtaaaacaagatggaggcctgcagcaaagtttgctacttaccatacagaaagtt

SEQ ID NO: 9426 - DNA, 490 bp, Homo sapiens
aaactgtaagacttttcaaaataagagtagttcttataaatgcttacttagtgcctggttgcgctaagcagtcactaggtattatctcatctaattcctgtaacaaccctctagggtagatactagcatttatcaccagatctgagatatcttgtaagatactccattttcttgcatacctctaagcaagaaaagvatgcgtctaggcgcagtggctcactcctgtaaacccagcactttgggaggctgaggcgggtggatcacctgaggtcaggagttcgagactaccctggccaacatggtgaaaccccgtctctactaaaaatacaaaaattatccaggtgtgatggtgcacacctgtaatcctagctactcgggaggctgatggaggagaatcgcttgaacccgggaggcaggggttgcagtgagcttbaaatcacgtcactgaactccagtctgggtgacagagcaagactctgtctcaaaaaac

SEQ ID NO: 9427 - DNA, 302 bp, Homo sapiens
  misc_feature 151: n=a, g, c or t
cgraaaaatctaatatcagagctgtttattctctagccataatggattaaactagaaatcagtaacagaggtatccagaaaatcctcaaatgttcagaaattaaataacttcatacttacaaataatccacaggtcagagaggaagtttcnmgggaaataaaaacattttgggccgggcgcagtggctcacgcctgtaatcccagcactttagggggccgaggtgggcagatcacaagataaggagatcgagaccatcctggctaacacggtgaaactctgtctcgactaaaaatgcaaaaw

SEQ ID NO: 9428 - DNA, 234 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataaagtcctttgaaacgaatgcacaggaagatacgatggaaacacacctagagactga

SEQ ID NO: 9429 - DNA, 440 bp, Homo sapiens
atatctcgcgataractgtttaaaatggcggcttcaaggcgtttcacgggtgtcccggacaggcgtggaggtggggcgcaggcgaggatgaagcttgagttggccaggagtcggaaaacgattgcaggcgggaccgcgtccgtcggggctgaggaaacttagcgtggcagaccctaaactgggataactttagggatatggccttcttttcccagttgcctcaaacttagagcagcgtcgtctttagccgaagattcattttcccagcattttccttctccaggcggagtagttggagacagagggcaagccagaaactgaccttcccatctcctcattcccttccatcaagaacttttcatcgttctttccccaccctggattgtaaatggtatttggcttcataaaaacgtttgtccacagcaaaaaaaaaaaaaaaa

SEQ ID NO: 9430 - DNA, 560 bp, Homo sapiens
  misc_feature 154: n=a, g, c or t
ctattctggaatcagaatcgtgtagcagaatgcagtcacatactgctagtctgccccaaatgcattaacagggagtcatgaattaaaaggcagccatgaaaaaacattgaaaggaaaaaagtgtgggttagcattgtctaaaatgaatgtccanaagcaaataaatttggccatatagagagtcttccgaagagtcagatgaaaagaatatattttataaccaaatttaactttagaaatgttatatcagcatttcccatggtgtgttaatgaagctctgcaagatgtttaataggtgtcagatgaataaaatggctccacagtcaaatacacttcgaaaaaaaatttttttttaagtttcatcactgcagaatttcttagatgctaaagtgcattaggaaatcaactggaagagaacttgcattctgaaggtttttctcatatttttgaccatagaaatatttttttccatgtgaaccccttggaaccagtgtttcatagattgcattctcagatacagagttctagataaatcatctttaactaaaaaaaaaaaaaaa

SEQ ID NO: 9431 - DNA, 442 bp, Homo sapiens
attgagacgtacagtaagagawataaagatatctctgattgattggctcagtagtcaagtggagatgacaagatagaatcagtgaccttaacagatcaatagtacgattggtgaacaggacagaacaagagaatttacccaatctgtgccgagtgtgatggctcacgcatgtagtcctagcactttaggaggccgaggcgggtggatcacctgaggtcaggagttcaagacgagcctggccaacatggtgaaacccatctccactaaaaatacaaaaatcagctgggtgtgctgacgcacactgtgatcccagctacttgggaggctgaggtaggagaattgcttgaacccaggaggtggaggttgcagtgaaccaagatcataccaccgcacttcagcctgggtgacagagctagactctgtttcaaaaaaaaaaaaaaaa

SEQ ID NO: 9432 - DNA, 61 bp, Homo sapiens
catcctggatcatggcatttaaataaaagattgaaagattaaaaaaaaaaaaaaaaaaaad

SEQ ID NO: 9433 - DNA, 398 bp, Homo sapiens
acacacacagacacacacacgcacacgcacacacgggcgcgcacacacacgcgcgtacacactgggtctccaggcagcggccgtcgccgatccccggcagcagctccaggcaaagtgacagaggacagtgctgctgtgagtttgacgaakggacatcacctgcagtcagtccagagctgcccagtgggaaagggcagcttgctgaggactgaagactaaaataaaccctcccaggagaggaaccggccggtgaccttggctgcaaccaccttgcagatcagctgcttcattcctttccatattttgtggcctgtggggggaatcaagtgtcacaaaagcaggaagagagcagtttgaggaagactccagaggcactgctggtaaaagtgctgacgtga

SEQ ID NO: 9434 - DNA, 119 bp, Homo sapiens
ctttcggagggtggtgagagtctgcggacgctgtataccctcctccacttcccgctgcagccaataaaggccgttcctaccataaaaaaaaaaaaaaaaaaaaaaaaaaaaaaaaaaav

SEQ ID NO: 9435 - DNA, 436 bp, Homo sapiens
  misc_feature 436: n=a, g, c or t
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatcaagattn

SEQ ID NO: 9436 - DNA, 147 bp, Homo sapiens
tgaccaaggaagagctttgaaggcctgaggtctgcggaaggtgggaggaggcagacgccctgcgtggcccatggtcggggcgtccacgccgaggccggcaacaaacgacagtatctcggattcctttttttttttttwaaatttttw

SEQ ID NO: 9437 - DNA, 212 bp, Homo sapiens
agaggcagccagggcgccggaagaggcctggaaatccacgcggcttccbaaagacggcgcctctgttctgcgggttcgtgacgaggatttatttccacccactgcgcctgggcggktyctgcgggtccgcgcccactgcgtgcggcscacggaccatgtcggtgactgatcaggcttttgtcacactggccacagatgacatctactgccag

SEQ ID NO: 9438 - DNA, 253 bp, Homo sapiens
tcagatctcatagatgaccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcct

SEQ ID NO: 9439 - DNA, 263 bp, Homo sapiens
ttctttgtgctgctgtgctatcctttcttaagcctttgattttgatttttcgtyaatattttttaaagaggcacaacttagccaraattcttaggaggacaagattcaaaactcatgtgttagtattttgatagctgtgtctttagaaacctactcaacacttttattttatagaagaagcaactggcctacagaggttaaaagatttgattgggcatattgctgagaagagtcctagaatcccagcacttttggaggctgag

SEQ ID NO: 9440 - DNA, 299 bp, Homo sapiens
tttctgagagaaaaagtgtaaagcaaaataatatcttttaacaaatgtttgtatttgactaaaaaggaagcaagcacttaatttatgaatttgctaatkgctcttctgagctgagaatatctgtgttgaatattagtcattatccgtatttggcacagaataatcccgagggktaaatgacattgktcctacagtgggcacctgaagactggctataaaagcaatcctggccargggcggtggctcacgcctgtaatcccagcactttgggaggccarggtkggtggatcacgaggtca

SEQ ID NO: 9441 - DNA, 444 bp, Homo sapiens
ctcttctcgtctgcacatgtgaggcatgactttctttcaccttctgccatgattgtkagacctgccccagccacatgcaactwagaacagtaaaacagacttgttattggcagcccattagtgctcaggagaggcggtctccagcatgacatcagccggcggtcgacccaaatctagtatttcaccagagagcctaacgctgctggctttccaactgtgtggaagacgatacaggcgtaacaaagacaaggatgaaataagtcctgtgatggagagacaagcaaaattctacctgacttcacaggaggaagaagtgtgctgtgccagggggawcaggagaaagcttcatggaagagcttccaacggagccattttacttttaccaactcgaatttgatgaccaaccaaagagagaaagaagtaaatgactactactaggaatct

SEQ ID NO: 9442 - DNA, 418 bp, Homo sapiens
attttggaactattatgakactatgtaaaggataggtttaaggggcagaacgtcccaggcagataccagtgaagaaactgttgcaggagtttaattaagagataaatagaggcttttggcaccagctatgacagaatgactggtgcaabwtgggccctcccactgtaaacaacawwaaaataggacaccaccccctcactatctgtctatctgtctgtccatctatcgatcaatcgaaagagagcatgggtgtgcaacacaactattttcaggcattggacaataggcagccactgtgttggtcaccattgcccaggtgtctgctgcatactattttccaactgtggtgctgtaatctggaggccaggcctgccagagtacaatagactcactgagctgaggaggcacagaacagaat

SEQ ID NO: 9443 - DNA, 448 bp, Homo sapiens
atagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagatcccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcacaaaaaaaaaaaaaaaa

SEQ ID NO: 9444 - DNA, 238 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctgg

SEQ ID NO: 9445 - DNA, 467 bp, Homo sapiens
  misc_feature 257: n=a, g, c or t
ttaamctttatcctccaattcttacagtgcccagttctcctgtgctatctttgctttvvwacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaatacarntttttaaatatatcttaacagtctgactaacttaaaataatttattcttcccttaaaacatttttctgkgtttttgtgcatcaaatattgtagagttgaaatcttagagattgcttatcgaaatataaatttaggggaagttaaaaatcgattggcaaatttgtagcatttattcactgattaaatcttttccacttttgtgaaaaccaw

SEQ ID NO: 9446 - DNA, 295 bp, Homo sapiens
  misc_feature 295: n=a, g, c or t
agtttcttgattcagcagcttcctgactagagatagagccagagcagaagatgggcagagtctgcatgtggctgcaggacctctgtcagagaatgaaacactcatcgcatggtaaggctggtctgagagcaaggtcaagataaagagccatatcctaaaaaaaaagagaagcagccaaaagctgtttgggtgtacgggaggtgagcttgggaatacctcagtggcgaagggatgtcagaggtagtatgaggtgaaaasvagctgttggaatacataacagtgctaaattgctggn

SEQ ID NO: 9447 - DNA, 405 bp, Homo sapiens
cacgaatggtctcaatttagtttttcaaattgtcaagtataatggtatggcatttcgtctttgcagctagaagctaagcatttaactttggtgccttttgtgtgacctaaatgtacaacttgcagattttaaaagtagtagatattgtctggattttaaggcttgttttccctagtattgaaataagaagtgggcagaagggtatatttcggggtgctttgctaacaatacatatgtctgtgaatgagctcgtgtgttgtcttgcagtcactttattttgaacataaaaatgtatgtttccaagagggatctgtggattaattgctatatttctaaaaatgctctacccttaaaatttttgccacttaataaaacagctatgtgaaatcaaaaaaaaaaaaaaaa

SEQ ID NO: 9448 - DNA, 191 bp, Homo sapiens
cctaacatactatgtaatttgcttgtttattatatcgtttctgtctttccctatatggtttcctttgttcactgatgtgcccaagtgccctgttcctgacacatagtaggcactcaataaatattcattaaaggaatgaatgaatgaaaaaaaaaaaaaaaaaaaaaaaaaaaaaaaaaaaaaaaaaaaar

SEQ ID NO: 9449 - DNA, 416 bp, Homo sapiens
ttttattttggtaaaaatatataacattagatttgccattttcaccattttttaagtgtacagttcagtgtcattaagcatattcacattgttgcacagtcattatcactatccatcctcagagcttttttgttaccccaagctggaagtttctacctattaagtagtaattccctattcccccctccttctgacccctggcaaccactttgttactttctgtctctattaatgtgacttaattaatttgtttctgtaatctttacctcaaaagcacttatccttcaaggaagatttggtttatgggtatcagatttaatttatttaatttattgcacctaaggcacaataaaaaggtaagtaaccttacctgccttgtgtacttttgattatttttaatgtgcaggatttgaaca

SEQ ID NO: 9450 - DNA, 415 bp, Homo sapiens
agaaaaaaagtaagcagaaagataaaggaatccaattaaattgggtttgacttttatctttgtttttactgttctcaaatgaagaattgatttgcatgtctttcttgcctgtagaagcatttgatttccttctgtgaactaatctgtagtcttcatttctcttgaaatatatgcccactggtataaaaaaggctaatgtaaacatgttggccatttaaaaaattttctgctaaaaaacctatcagtgtagtttgcagatgcagttagaaagagcagaagtaggctgggcacggtggctcatgcatgtaatcccagcactttgggaggccgaggcggatggatcgcctgagtccaggagttcgagaccagcctgggcaacatggtgaaacctgtctctacaaaaaaaaaaaaaaaa

SEQ ID NO: 9451 - DNA, 427 bp, Homo sapiens
tcaacattcacatatacctagtgttacataggagagacgcattttaatttatattctaggtaaacttcatctcctaagaaactagactcacaacgctatttgctatgaggaactcttcatctagttctccatatgcattcaagagaatttcatcctgaatgtgaacatgatgtcaacaaattttcagagaatcgtttaggttaaaaattgaactagttttttttccamgaaattaccagattaactgtggatctttctcatgctaagaccaaagaaatgttagcattaggtgtttataaaggtagcatcaggcacctgtagtcccagctattcgagcagctgaggcaggcggattgcttgtgaccaggagtttgaggctgtagtgtgctatgattgcacctgtggctagccactgcactcaacctgg

SEQ ID NO: 9452 - DNA, 279 bp, Homo sapiens
catatatctatgctgtattttgtgtgtttgttttgtgtgtttcttgacaattccacctgttcttaaaggaaggtgtggcaattttatttttatagtttttagttttatagtttttttagttttaatttttatagtatgctgaaagtggttaagcacctcagctgtaggtcttttacagctttctaaaatagcatcaagttggtaatgagggatgtcagctagtcctgttttcaaaacttgggagcagtggtaataaggcccaccaaaatcttttttttk

SEQ ID NO: 9453 - DNA, 328 bp, Homo sapiens
  misc_feature 317: n=a, g, c or t
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccangggttgctacc

SEQ ID NO: 9454 - DNA, 392 bp, Homo sapiens
tatttattttgtgttcttttaaaatttatttttccatataatctctgtgagggcagggatcatacagctctcaaggtacacatcacagtatgcagataggcccaaaataaacaaacatctttatttttaaagttttttaattataaaaagtaatacgaggccaggcacagtggctcatacctgatacctgtaatcccagcactttgggaggctgaggcgggtggatcacctgaggtcgggagtttgaggccaatctggccaacatggtgataccccatctctatgaaaaatacarcawgcaaysaacagsaactracwwcatcaacacatymscywkgccatgghggtgtgtgcctgtagttccagctactcggaagggtgaggcaggagar

SEQ ID NO: 9455 - DNA, 235 bp, Homo sapiens
agtccctccaagcttccttccttatccctttagagccctgcagccctcaggcagtgtagcccagaggttcaagggcattcgctctggtatcagaagggtctgggttcaaatcccttgtgcactgcttgctggctgtgtgactttgggcaagttgcctaatctctctggtcctcagtttttgaaaaaaaaaaaaaaaaaaaaaaaaaaaaaaaaaaaaaaaaaaaaaaaaaaaaah

SEQ ID NO: 9456 - DNA, 537 bp, Homo sapiens
ttgaccacagacttgttggctccacccttgaattcctgacgccctaggtctgggatggggcttgacaatttgcatttgtaaaaagttcctgaatgctgctctgctgctggtcagggaaccctgctttaagacctcctggtttatgcaatttcaaacattgtaagaaatagtcactcatgtgattggtttgtgtgcttggtgtagactgtacgaggatttttcaaaagtaagtatcttcattctaaaggaaggaaatgtatgttatgagatagaattatataataaacagaaccattaaatgccatctgaaaagtggtgttttcaatggcaggaagtagcattgctgcgtattttgtgtgtgtgcgcaactcagctttgtgtcattgtgtaactttaatttgaaagaacatcacgtgactgctgttttcatttctgccttttaaaaagcagacagctattcagaacagcaagaagcagacccaaactttgtttgtatgcccctagtcataggcaaaaatggaaagggtaatttaccaa

SEQ ID NO: 9457 - DNA, 375 bp, Homo sapiens
agataggttggagacaattgattgctcgatgatataaaatgttaagtaccatgaatgatgctgttaggctggaatgcgccaagcataaaggtggggcatggcatcaaaaggtaggtcaacatattaaataattccatgtattgaaatatccagaaaatatatagacagatctatagagatagaaactggtctgcccaggactaggggttgtctaaggataaggagcttcttttttggatggtgaaataacctaaaatatattgtgccattgtttgcacaactttgtgaatatattaaaaacctgttaattgtactcactaaatgtcctccttctaaattaagctgttcttgacaagaaaaggaaagaaacaaaaw

SEQ ID NO: 9458 - DNA, 103 bp, Homo sapiens; identical to SEQ ID NO: 8028

SEQ ID NO: 9459 - DNA, 76 bp, Homo sapiens
tttttcgcaacgggtttgccgccagaacacaggtgtcgtgaaaactacccctaaaagccaaaaaaaaaaaaaaaaa

SEQ ID NO: 9460 - DNA, 71 bp, Homo sapiens; identical to SEQ ID NO: 8867

SEQ ID NO: 9461 - DNA, 59 bp, Homo sapiens
cttttgcgttctctttccctctcccaacatggcggcctcagcaaaaaaaaaaaaaaaaa

SEQ ID NO: 9462 - DNA, 441 bp, Homo sapiens
ctcatctagccccgccccagggagggcgccgcacccacaccgcgctgcgcagttttgttctgctccagctgttcgaaggtgatccagacgcaagatggctgtcctctctaaggaatatggttttgtgcttctaactggtgctgcctatcatgtacagcacggaccctgaaaatgggcacatcttcaactgcattcagcvagcccaccagaacacgttggctagctgttggaggtgtttaccacccgcgtatagcttctggcctgggcttggctggattgttggacgagttctttatgcttatggctattacacgggagaacccagcaagcgtagtcgaggagccctggggtccatcgccctcmtgggcttggtgggcacaactgtgtgctctgctttccagcatcttggttgggttaaaagtggcttgggcagtggaccca

SEQ ID NO: 9463 - DNA, 328 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctacc

SEQ ID NO: 9464 - DNA, 91 bp, Homo sapiens
gaggttgagacaagagaatcacttgaacctgagaggcagaggttgcagtgcagcctgggtgacagagggagactccggccccctcccaaaa

SEQ ID NO: 9465 - DNA, 50 bp, Homo sapiens
acagttaactttaggaccatagccaaaagatagaaacagcataaacgcca

SEQ ID NO: 9466 - DNA, 341 bp, Homo sapiens
cacacctacaaataccacaccacacctacacacaaagccttcataaaaataagagccgggccgggcgtggtggctcacacctgtaattccagcactttgggaggccgaggsgggcggatcacctgaggttggcagttcaagaccagcctgatcaacatggagaaaccccgtctctactaaaaatacaaaattggccaggcatggtggcgcatgctgtagtcccagctactcgggaggctgaggcaggagaatggcatggactcgggaggcggasttgcagtgagccgagattgtgccactgcactccagcctgggtgacagagcgagactccgtcccaaaa

SEQ ID NO: 9467 - DNA, 165 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaaaaaaaaaaaaaaaa

SEQ ID NO: 9468 - DNA, 104 bp, Homo sapiens; identical to SEQ ID NO: 8046

SEQ ID NO: 9469 - DNA, 107 bp, Homo sapiens
  misc_feature 102,105: n=a, g, c or t
gaggttgagacaagagaatcacttgaacctgagaggcagaggttgcagtgcagcctgggtgacagagggagactccggccccctcccaaaaaaaaaaaaaanaangc

SEQ ID NO: 9470 - DNA, 358 bp, Homo sapiens
tgtctgatttctttcactggtattttgtagttctcctcatagagatagttcacaaccttggttagacatactcctagtcattttttggggggtgtggctatttttaataggattgcattcttgatgatgtgtttctcagcttgaacattattggcgtttaagagtactgctgactgggccgggcacggtggctcacgcctgtaatcccagcgctttgggaggccaaggcgggcggatcacctgaggtcgggagttcgggagcagcctgaccaacatggagaaacccagtctctattaaaaatgcaaaattagccgggcgtggtggtgcgtgcctgtagtccggctacttaggagggct

SEQ ID NO: 9471 - DNA, 308 bp, Homo sapiens
  misc_feature 192,265: n=a, g, c or t
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaanagaattaagtggccgggcacagtggctcatgcctgtaatcccagstacgtgggaggctgaggcaggagaatcncttgaacctgggaggtggaggttgcagtgaactgmgattgcgc

SEQ ID NO: 9472 - DNA, 104 bp, Homo sapiens; identical to SEQ ID NO: 8046

SEQ ID NO: 9473 - DNA, 101 bp, Homo sapiens
gaggttgagacaagagaatcacttgaacctgagaggcagaggttgcagtgcagcctgggtgacagagggagactccggccccctcccaaaaaaaaaaaaaa

SEQ ID NO: 9474 - DNA, 381 bp, Homo sapiens
agagctgaaagggatcatctagtccaacccattcatttcatgggtagagaactgaaacccagagaaaatagaaatgccaccacctcggtgccagatctcctagatgcccacctacaggtaaggcatcdtaccagttcttatgcactgcaatggccactagagataatgaagctgaggtagaagagataatttaatccagaatatcagaaaagtaccggtcagatgcggtggctcacgcctgtgatcccagcactttgggaggccgagcacaccatggaatctgaagtgattcagaatggctggcttttgaaattcctttgaactaaataaagcaccttcatttttacttgaaaaaaaaaaaraaaaaaaaaaaaaaaaaar

SEQ ID NO: 9475 - DNA, 107 bp, Homo sapiens
  misc_feature 105: n=a, g, c or t
gaggttgagacaagagaatcacttgaacctgagaggcagaggttgcagtgcagcctgggtgacagagggagactccggccccctcccaaaawaaaaaaaaaaaangs

SEQ ID NO: 9476 - DNA, 104 bp, Homo sapiens; identical to SEQ ID NO: 8046

SEQ ID NO: 9477 - DNA, 97 bp, Homo sapiens
acagttaactttaggaccatagccaaaagatagaaacagcataaacgccaaaataaaaagaagccaataaagataaacacaaaaaaaaaaaaaaaaa

SEQ ID NO: 9478 - DNA, 60 bp, Homo sapiens
cttttgcgttctctttccctctcccaacatggcggcctcagcaaaaaaaaaaaaaaaaaa

SEQ ID NO: 9479 - DNA, 84 bp, Homo sapiens
acagttaactttaggaccatagccaaaagatagaaacagcataaacgccaaaataaaaagaagccaataaagataaacacaaaa

SEQ ID NO: 9480 - DNA, 52 bp, Homo sapiens
gaggttgagacaagagaatcacttgaacctgagaggcagaggttgcagtgca

SEQ ID NO: 9481 - DNA, 323 bp, Homo sapiens
aacctaatcaagcctgggcaatggcgggcgcccctcccgcagcctcgctscgccttgcaggttgatctcagactgctgtgctagcaatcagtgagactccgtgggcgtaggactctccaagccagtgagatgaactcggtacctcagatggaaatgcagaaatcaccgtcttctccatcgctcacgctgggagctgtagacsggagctgttcctattcggccatctttgctcctccctgcaactaastccattsttaattgggtctsactctgtsacctaggstggagtgcagtggcgtgatgggcgtgatctcggctcattg

SEQ ID NO: 9482 - DNA, 96 bp, Homo sapiens
gaggttgagacaagagaatcacttgaacctgagaggcagaggttgcagtgcagcctgggtgacagagggagactccggccccctcccaaaaaaaaa

SEQ ID NO: 9483 - DNA, 59 bp, Homo sapiens; identical to SEQ ID NO: 9461

SEQ ID NO: 9484 - DNA, 399 bp, Homo sapiens
agagctgaaagggatcatctagtccaacccattcatttcatgggtagagaactgaaacccagagaaaatagaaatgccaccacctcggtgccagatctcctagatgcccacctacaggtaaggcatcttaccagttcttatgcactgcaatggccactagagataatgaagctgaggtagaagagataatttaatccagaatatcagaaaagtaccggtcagatgcggtggctcacgcctgtgatcccagcactttgggaggccgagcacaccatggaatctgaagtgattcagaatggctggcttttgaaattcctttgaactaaataaagcaccttcatttttacttgaaaaaaaaaaaaaaaaaaaaaaaaaaaaaaaaaaaaaaaaaaaaaaaar

SEQ ID NO: 9485 - DNA, 103 bp, Homo sapiens; identical to SEQ ID NO: 8028

SEQ ID NO: 9486 - DNA, 61 bp, Homo sapiens
caaatataaaaaattagccgggcgtggtggcgggcacctgtagtcaaaaaaaaaaaaaaaa

SEQ ID NO: 9487 - DNA, 107 bp, Homo sapiens
gaggttgagacaagagaatcacttgaacctgagaggcagaggttgcagtgcagcctgggtgacagagggagactccggccccctcccaaaaaaaaaaaaaaaaaagc

SEQ ID NO: 9488 - DNA, 76 bp, Homo sapiens; identical to SEQ ID NO: 9459

SEQ ID NO: 9489 - DNA, 96 bp, Homo sapiens; identical to SEQ ID NO: 9482

SEQ ID NO: 9490 - DNA, 80 bp, Homo sapiens
  misc_feature 78: n=a, g, c or t
ctttttcgcaacgggtttgccgccagaacacaggtgtcgtgaaaactacccctaaaagccaaaaaaaaaaaaaaaaangc

SEQ ID NO: 9491 - DNA, 88 bp, Homo sapiens
cattggtagcttgatggggatggcattgaatctgtaaattaccttgggcagtatggccattttcacgatattgattcttcctacccgc

SEQ ID NO: 9492 - DNA, 107 bp, Homo sapiens
gaggttgagacaagagaatcacttgaacctgagaggcagaggttgcagtgcagcctgggtgacagagggagactccggccccctcccacaaaaaaaaaaaaaaaagc

SEQ ID NO: 9493 - DNA, 240 bp, Homo sapiens
attgaaaaaaatcaaagatcatctaaataagttgaaagacaatgttcatggatcagaatacttaatattgttaagatggcaatactctcaaactgctctacagattcaatatgatttccatcaaaatctcadctagctttttagtagaaattgacagcagatcttacaatgtatatagaaatgcaagggatagccaaaaacctaaaatagccaaaaacaatctcaaaaaaaaaaaaaaaa

SEQ ID NO: 9494 - DNA, 83 bp, Homo sapiens
gaggttgagacaagagaatcacttgaacctgagaggcagaggttgcagtgcagcctgggtgacagagggagactccggccccc

SEQ ID NO: 9495 - DNA, 88 bp, Homo sapiens
  misc_feature 86: n=a, g, c or t
aataatagctactaaaaagtaacaaggttgagaccagcctgggcaacataaggagaccccttcttcacaaaaaaaaaaaaaaaaangy

SEQ ID NO: 9496 - DNA, 102 bp, Homo sapiens; identical to SEQ ID NO: 8082

SEQ ID NO: 9497 - DNA, 100 bp, Homo sapiens
  misc_feature 97..98: n=a, g, c or t
acagttaactttaggaccatagccaaaagatagaaacagcataaacgccaaaataaaaagaagccaataaagataaacacaaaaaaaaaaaaaaaanngc

SEQ ID NO: 9498 - DNA, 350 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcmaaaa

SEQ ID NO: 9499 - DNA, 107 bp, Homo sapiens; identical to SEQ ID NO: 9487

SEQ ID NO: 9500 - DNA, 58 bp, Homo sapiens
cttttgckttctctttccctctcccaacatggcggcctcagcaaaaaaaaaaaaaaaa

SEQ ID NO: 9501 - DNA, 96 bp, Homo sapiens
tttctttttacattgtgcctttatcagtttatggtatcagggtgatactagcttcatagtatgagttaggcaggagcccatcctcctccatttttt

SEQ ID NO: 9502 - DNA, 112 bp, Homo sapiens
tttctttttacattgtgcctttatcagtttatggtatcagggtgatactagcttcatagtatgagttaggcaggagcccatcctcctccattttttgaaatagtttcaatag

SEQ ID NO: 9503 - DNA, 54 bp, Homo sapiens
aaaaaaaactttaaacagattgaaataaaacagaaaagtaaatgtttttaaaaa

SEQ ID NO: 9504 - DNA, 105 bp, Homo sapiens
gaggttgagacaagagaatcacttgaacctgagaggcagaggttgcagtgcagcctgggtgacagagggagactccggccccctcccaaaaaaaaaaaaaaaaaa

SEQ ID NO: 9505 - DNA, 107 bp, Homo sapiens; identical to SEQ ID NO: 9487

SEQ ID NO: 9506 - DNA, 76 bp, Homo sapiens; identical to SEQ ID NO: 9459

SEQ ID NO: 9507 - DNA, 104 bp, Homo sapiens; identical to SEQ ID NO: 8046

SEQ ID NO: 9508 - DNA, 101 bp, Homo sapiens; identical to SEQ ID NO: 9473

SEQ ID NO: 9509 - DNA, 84 bp, Homo sapiens; identical to SEQ ID NO: 9479

SEQ ID NO: 9510 - DNA, 316 bp, Homo sapiens
caagaaatatttagatagatagatagactatacaaatgtattttcaatacttatkkrtataatatggcttctctaaaattgcaatagcatttcctttacaggacaggtcttgattctwcaacctctgaggaagatatcactaatatcttctaatctttggcgagtttaaaaggagcatatgttcaccaagggcacttgctgataaaaataataggaaaaaaaactcattccatcaccagagtcttaaatccaaactctataattwctgtccccagatatratgtaaccattttttcataraatataattacattgk

SEQ ID NO: 9511 - DNA, 421 bp, Homo sapiens
taaacattaatgttttcagggtactttaaattttagataattactcattgtattcatgtgaaatttgtttttactgcatgtgtgggttggaggacggttttcacttctgattcatctttactcttatctcatcagagctcatacctcttgtagttgggggattgcactttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgaw

SEQ ID NO: 9512 - DNA, 167 bp, Homo sapiens
acttcagaactagttctgsatctactatgcaaagatcatgattaactgtcaagacactggtagaacagaacaagcaaaagattaagagttcaaaagtagaatgcraccaatttaacatgtagtgktaktaaaaaattacaaaggcctagaccagcctgggcaacatd

SEQ ID NO: 9513 - DNA, 351 bp, Homo sapiens
tgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgktttttaa

SEQ ID NO: 9514 - DNA, 352 bp, Homo sapiens
agtgctagtgtgacaggtctgagcagaaaagtgtccccatgacttacttgtttttcctgaactgccaggtatttaccataaattttatcatattcaatggaacacaaatggcttcccggggggcagcattatgttaataactttggatcttgcaaaagttgcttatctgtatgagcttgaacttactcatttttaacacaaaataagagaatctaattcagagggctgttgtgagcattgaagtcattcacatgatatagtgatttagggcatggtagagtgactggtagataaatcttttcttggtggggtacttaggtcaatttttataataaaattttgtaagtttcts

SEQ ID NO: 9515 - DNA, 377 bp, Homo sapiens
caggacctgaactcaacattggatcaaatggatctgatagacctttacagaactctgcactcaaaaacaacagaatatgcattcctcacatcatcatatgccacatactctaaaatcaaccacataattggacataaagcaatcctcagcaaatgcaaaacaactgaaatcataccaaatacatactgagatcacagtgcagtaaaaatagaagactaagaaaattgctgaaaatcatgcaattacatggaaatcaatcaacatgctcctgaatgactttttaataaataatgaaattaaggcagaaatcaagaagctctttgaaaataatgagaacaaagttacaacatactagagcctctggacacagctaagac

SEQ ID NO: 9516 - DNA, 297 bp, Homo sapiens
tctccctttcccttgacctggatcaccgggggtgcaaatgagtagatacaagggtaatgcaagtcttaatgctaatttcacattattccaggagatgactacacactctaatcccttatctcttggccttcatctattttgcaggtggtgaaggcatttgtgatcctggcctcgsagttcctatcccatgacccagaacagctcamcaaggrgctgcagcagcatgtgaagtcagtgacagccccatacaagtacccaagaaagatagartttgtcttgaacctgcccaagamtgty

SEQ ID NO: 9517 - DNA, 361 bp, Homo sapiens
tggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccamtgs

SEQ ID NO: 9518 - DNA, 240 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggac

SEQ ID NO: 9519 - DNA, 521 bp, Homo sapiens
aagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggkattataccatgattgtatacagtttgtgaaattgttgcaagggcaaagataactcttaaaaaaccgtcgagattacaatgctctagaatcagcatakaagaaaataratgatatctgcatgttgaattggggtrgatggggggarcaagcataattkttwagtgtraagctttgcatcaagaaattattaaa

SEQ ID NO: 9520 - DNA, 295 bp, Homo sapiens
atccaacaggcagtcagagctctcccggtctgaaagttgcattgccactgctaactttgggattgcatcagagaggccctgagtggggttgagatgaggaatgctgatacctgattctagttatggatatrgaggcaaggagaagttgttaggttaaccagcrcagtcctccgtrcrtcccgcccgccgctgccctcactcccggccaggatggcatcctgtctrgmcctgcgcatggcgctgctgctggtctmmrgggttctrgcccctrcrgtgctcacagacgatgttccac

SEQ ID NO: 9521 - DNA, 579 bp, Homo sapiens
taaatgagaaggatatatctatctcttcctgtagattatttattatgtctgtcacagtttttaaaaagcctatctgctaattccaatatcaagattatctataagtctatttatattgatggatttttctcttgactctaggttacattttcctgtttattcacacatctggccagtcatttgtttgttgcagcatcactgattatcatgttatagagattatgaactcttaattttgtcagacgattgttgagttttgtctagcaggtagtcagattactggaggataactctgttgtatacagtgattttctagggagatagggttaggggagagggagaatgtagtttggaataaacgatgctgactccttccaaggaaaatcactggtaaaccagtgactactctgctaaattgcctctcttgacattgtcaacttgaagtaatcaaaaggatcagattctggaattaatgcaagcagaaagctgaccaatccgggagaacagacttcagaaaatggggtcagtgttccaaagttaaaagttcagttcttgcaggccaggcacagtagctcacac

SEQ ID NO: 9522 - DNA, 83 bp, Homo sapiens
atcaaactacttgcttccacttccccgcmcgggatgaggagtctccacgacggggaaaggtcgcactgacagagaaggaagtt

SEQ ID NO: 9523 - DNA, 383 bp, Homo sapiens
  misc_feature 84: n=a, g, c or t
cctgaagcagctgcccaaccaccgggtgctgatcatgaagggggcggggcacccctgttacctggacaaaccagaggagtggcntacagggctgstggamhttcskgcagggggctccagtgaagcccagcactgctgcagggggtgggctgcctgcctgctctgagctctctcttgcacgctctctcttctctcccaggctctggctcatgcacatgcaacaggtgcgtctgtctatatgtctgggtkcttgtctkttgtggtctgtttgtcttttctacctctktctcttgcagtgatagactgagggggtaaaatcaagagaaaaaactctcaggaatcaaggaacataatcctgtggagrrtaatccattacatgagct

SEQ ID NO: 9524 - DNA, 312 bp, Homo sapiens
  misc_feature 189: n=a, g, c or t
tgagaataaagtgtgcaatcgctatgagtttctgaatggaagagtccaatccaccgaactctgtgctgggcatttggccggagvactgacagttggcarggttgacaktggagggccttckggtttgcttcgagaaggacaratacatttkacaaggagtcacttcttggggtcttggctgtgcacgcnscaataagcctggtgtctatgttcgtgtttcaaggtttgtkacttggattgagggagtgatgagaaataattaatkggacgggagacagagtgacgcactgactcacctagaggctgggacgt

SEQ ID NO: 9525 - DNA, 328 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccatwaacagcagctagcttaactgagatcattggtagccaggggttgctacc

SEQ ID NO: 9526 - DNA, 160 bp, Homo sapiens
  misc_feature 118: n=a, g, c or t
aaaaggacttgaattctgatcgggctgcagacgctctgcaccccgcccaagcttctatggtactttggtgtcctctctagcactggcaagtcgccttcctcttcgcccggcgccagdntcccctctctatgatcgccgagttcccggcgccgtctcgttk

SEQ ID NO: 9527 - DNA, 245 bp, Homo sapiens
cagctaaggagagaagacttaaagatattgacagaagcccccagtgaaacagatagtggtacagagcccaatcaatgaacaggttccacctacatccctgaacaactcccaaatagccatttagtgcatcactcttaaatatgaacagaagtatttgctactgttaagaaaggaccaccagacgtgtgaggaaatctaacatgaaaggcagagaccaaaaaaaaaaaaaaaaaaaaaaaaaaaar

SEQ ID NO: 9528 - DNA, 505 bp, Homo sapiens
tacctggagaatatctagggttccagtagtgacagctggacaggaccctaaagataacattctttccataaatttgatacatttgtgtattcatttgacatcgtgtatcaggtgcatctgtgaaagaattagtgatatgttactctgggtttcgacgatggaaacgtgaatgcagtgtggtctctgcttgcaagaggtcacataaatcatcaagacagtatgtagaagtatatgcaaaaaatacctgaaggggctaggtgcagtagctcacattgtaatcccggtactttgggaggccgaggcaggaggatcacttgaggcccggagttcaagaccatcctgggtaatatagcaagatcccatctctaaaaaaataaaaataaaaaaattagccagtgtggtagtgcatgcctatagtcctagctgctcaagaggctgaggcgggaggatccsttgagctccagaatttgaggctgcagtgagctatgatcataccactgcactc

SEQ ID NO: 9529 - DNA, 55 bp, Homo sapiens
aagatgaagtgggtgtgggcgctcttgctgttggcggcgctgggcagcggccgcg

SEQ ID NO: 9530 - DNA, 335 bp, Homo sapiens
acttccggtcggcggcggctcagcaggtgttacctgttactcgcctcggacccgccgggtctctggaaggctgagtggccccccggccttgatattgggaggagtcaccttcatgtttcgtggcagatgaaagcttaaggcctccttaggagttgggtattgacctgtgctctttgaggcggtttttaacctttgatctttcttctggccgttcccccggaccggcctattccaacccagtttctgtttggaaagaggctgtcgcctctggtggagaggaagagaaaagcagccagcgtcgaggaatctctcagggctctcggttgtagcagagc

SEQ ID NO: 9531 - DNA, 453 bp, Homo sapiens
aagaaaaaaaagtggagacaggggtcttgctatgttgcccaggctggtcttgaacttctgggctcaggccatcctccctgcctcagcttcccaaggtgctgaggtcacaggtgtgagccactgagcccggcctgattttgggtgtttattgagtatctgcccagcaccaggcatggcagactctggggacaccgaggaccctgggctgacccaactgtattaaccggagtttgcgctcatggagggagggaggtggaagtgacaccagtgatcagttatcaagtgggtgcattgtcaccatgcatgcttggttgggggcaggagccaaactctgggggagcacccagccaagaaacctgacaaggggtcacgtatgctttgtccaaggaggaggtgaccctgaagggagagctgtcggatgtgcgggatgatggcaggcagccttccagacag

SEQ ID NO: 9532 - DNA, 434 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaaatccaag

SEQ ID NO: 9533 - DNA, 429 bp, Homo sapiens
atgtacctgactggggtcattgtgtaagacttwttattttatcctgaaaccttaaatatcaaacctctgcatctctgatcccttccttgttaaaagttaccacggttggccaggcgcggtggttcatgcctgtaatcccagcactatgggaggccgagacgggcggatcacgaggtcaggagactgagaccatcctggctaacacggtgaaaccccatctctactaaaaatacaaaaaccaaaaaaaattagccaggcgcattggctcgtgtctgtaatcccagcactttgggaggtcgggggggtgggggaggatcacggggtcaggagatcgagaccatcctggccaacatgatgaaaccctatctctactaaaaatacaaaaattagccgggcatggtggtgcacgcctatagtcccagctactcg

SEQ ID NO: 9534 - DNA, 427 bp, Homo sapiens
ttgtctcatagctgtcctttaaaagagatgttattaaattcccattttaggctggggcagtggctgacgcctgtaaccccagtactttgggaggctgaggtgggcggatcactgaggtcgggagttcgagaccagcctggacaacgtggtgaagccccatctctactcaaaaaatacaaaattcctatcagccgggcgtgatggttcatgcctgtaatcccagctactcgggaggctgaggcagaagaattgcttgaacctgggaggcggcacctgcagtgagccgagatcgcgacactgcactccagcctgggcaacatagtgagattctgtctcaaaaataaataaaaataaattcccattttagcaatgaggaaactgggattcagagaagttgagggccgagtgtggtggctgacgcctgtaa

SEQ ID NO: 9535 - DNA, 493 bp, Homo sapiens
gataattgttttattggccttattcttaacttagtgtgatttaggaaaagacaaggacatctagagtcatgttgtaatcacagttctgtgatatttcatgtttttctaactcataaaaatacagtgaggaaatcaacagcttggactgtgggaaaagaagtaaagctgaaactctgatacgcacaggcctgagtatgttgtttacagaatgaaaagcgagttccacataagctgagacttggcttcagtcatgcctgggaatctacaaactcaatgccctctcactggcagaacataaaagctaaagattacccctaatcccgtggcattttaaaatccatggaatgggctttggtgctcagcaattttcacttaaagtcacacactcttttggaggtacaaatgtttcagttcccccagtagtatctctggtaagacttaccagaatgaatattgatgcagatgaagacacgattgttctttccagaagtgg

SEQ ID NO: 9536 - DNA, 348 bp, Homo sapiens
cacaattcagaggctgctgcctgcttaggaggttgtagaaagctctgtaggttctctctgtgtgtcctacaggagtcttcaggccagctccctgtcggatggcttktatgaaaaaatatctcctccccattctggggctcttcatggcctactactactattctgcaaacgaggaattcagaccagagatgctccaatgaaagaaagtgattgtcacaggggccagcaaagggatcggaagagagatggcttatcatctggcgaagatgggagcccatgtsgtggtgacagcgaggtcaaaagaaactctacagaaggkggtatcccactgcctggagcttggagcag

SEQ ID NO: 9537 - DNA, 680 bp, Homo sapiens
attctgcactaatagcggcaaaaagccttctggttcctggggcgacgcgccggcggccgtactattcacttccccagaacgccacagcccaggctttcttcttagtgggcttcccagaccaagaagggaaacctttcatccgaagtactgaggggaggaaggtggcctgaagttatctcagtgccgctttgtttcccaccccagtcggtcagcccttcctcagcgccctttaacccttgcagatcggatggagaaagctgccagcacgttctagggatgggggcagattgaggagcgggagggagtagtctttgtctaactttataccagtaccaaactatgttaatttaatgtagttttataataaatctttaagtcctgtaacttattctcccaagattgttttggcttattctacggcctttgtattkctaggtgaattttggaattagcttgttaaaaaggggggggattttttattgggctcgcattgaatctatagrtctgtttgggaaaaactagtatcttaacaacaagtccttcaatccatgaatatcattctttcccccaccatttatttaagcggtcttwaawtttctcctgggcaatattttgwagattgcacatatatckatatttttaatgcagctgtgcttggatagatgcagtatagagatcag

SEQ ID NO: 9538 - DNA, 535 bp, Homo sapiens
ttgtttggcacattgagtcataagcatttgagtcttccacggtggcactgtcaccatacatgtgacccacagattagatacgagataggtggagtggagaaagcagagtagctgagagagtacttgatgaggctgtttgcttcattggggctcacagtgctaagaaaaaccatttgcagaatcatgggagcagaatgatcatttctcctataatctggggtcccagcctttaggatgtatccctattcaatgtaaaacactaggttttattcagtgaatggcagtctagcatggttatgctagctgaatggtcttatagggaaagattatagcagatatatgtatatatatgtatatctatctatctaactatatatctctatataattggtatagttggctaagtgacagctgaggagccagctggatcagagttcaaaataaggtgacagtctacaaatccctggaagactggagcaacaaaagagggaatcgttatttggacacagtggggaaagtaaaaaaaaaaaaaaag

SEQ ID NO: 9539 - DNA, 239 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagggggg

SEQ ID NO: 9540 - DNA, 438 bp, Homo sapiens
gtttttctccacgtctactccaacacagactcatcttcagaccacttcacattaagcaaaaaatagagattgaggaggaaaggcatgctattgatcacatggcctctctgaacttcggtgtttccaacataataaaaagagatggagtctccctgtattgcccaggctggagtgcagtggcaccatctcagctcactgcaagctctgcctcctgggttcacgccattttcctgcctcagcctcccaagtagctgggactacagagtgctggaagccaggtctgagattaatgtgccagcagggccaggctccctccagagggtctaagggagttctctgttcaccgtcacaggtcactaaactacactaaactgtagtccatgggccgaatccagtccaccasctatttttgtaaataaaggtgaattttgtaaataa

SEQ ID NO: 9541 - DNA, 498 bp, Homo sapiens
gaaaggtgctgtgaccgccctccgggttgtggctggtggccttcggtgtttcgggtttggcagttcactcaccaaggtgatctgatggagtgcacttcgcacgattccaagtacttgcctaatgttcatcctttcctctagacggggtagggctggttctggatctttttccgcggtastggagagacgtaggacctgatgatggctactagatgcctggtaaatgatccttcaagaagtgaatgaaccgggggccgtggctcacatgaagtcagcagttcgagagcagcctgaccaatatggtgaaacccgtttctactaaaagtacaaaaatttgttgggcgtggtggcgtgcgactgtagccccaactacttgggaggctgagacagaagaattgcctgaacccgggaggcggaggttgcagtgagtcgagatcgcccccgctgcactccagccagggcgacagagcgagactctctctcaaaaaaaaaaaaaar

SEQ ID NO: 9542 - DNA, 274 bp, Homo sapiens
amcgcccagcgacgccgcckyygccgccgccgccgcgtacctagccaggtccctgaggggcgggcagatgaggcctaggggtgccgatccctagtdtcgactatgcsagatctgattccggagctgccatgattgaagtggtagcagagctcagccggggtcstgtatttttggctggggaggcgctggagtgtgtagtgaccgtcaccaacccccttccccccacggccasttctgsatccagtgaggccctggctgggccagtgcccaaatc

SEQ ID NO: 9543 - DNA, 429 bp, Homo sapiens
ttttttcccttggtttctrsttatcttttaaaaaaaaaaatgaaaaaacactcatgagataactgcatttcacccaacaaaagcagggtatawtgcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagrcttcattgataa

SEQ ID NO: 9544 - DNA, 410 bp, Homo sapiens
tggtgggggcggtgttgctcggggctgcgatgccccttaggttgcgggcaaccagaggcctcactcgtgggcaggaagcaagggcggaccccgagagatgactgattgtgggggtggggaccgtctgctcctcctaatggctggggaccgtgcacgtctgcgcgggccggacctgctcttctcgggaacttgcgcgggaggaggcccggagctgcgccgctttaccctctgctccccggtgcctaaaacgcacacgcatcaaagtcacaggacgagttagaggagaaaggcagagggagatttgaaacacagaggaggtgatgagaagacacagcagaagatatctgaagactggaaagaatgctgcaaccaacaggagaaggaaaagacagaaatgtgttttccatttg

SEQ ID NO: 9545 - DNA, 371 bp, Homo sapiens
arattgaatgttccagataatcrctttcccagtcctgcctgacatctgggtaggrggtttgtccctggaattctgggacactggctggggtttraggagagaagccagtacctacctggctgcaggatgaagctggccagtggcttctwggtttawrtrgctcagccttgggggtggcctggctcagagcgacacgagccctgacacggaggagtcctattcagactggrgccttcgrmacctccggggaagctttgaatccgtcaatagctacwtcgattctdtwctggagctgctgggtagggaagaatggagtctgtmagtacaggtgccgatatggaaaggcaccaatgcccagacctggctacaag

SEQ ID NO: 9546 - DNA, 511 bp, Homo sapiens
agaagtccttagggtgaggcccacaaatgccccagaaatagcatatacattgcgccctaagtccagtctcgcccaggtgtggcaggagcttttacctgctcttyggcagtagccggctgccactcaaccccatgcctgactgagctgtggtagaaggattgaggccagcacagaggaggatcagcaggaaatgtaagggttgtcctcatctaatccgtcagtaccagacagtgaacatctctcccccaggatgctgagggagggtcctggagggaaggatgtggaactacagcctctgctctcaagaagctcagatctgggcagggaacatcacataccagggctgtctgtcgggggggtggagggctgggggagggatagcattaggggaaatacctaatgtaaatgacaagttgatgggtgcagcaaaccaacatggcacatgtatacctatgtaacaaatctgcatgttgtgcacgtgtaccctagaacttaaagtatawttaaaaaa

SEQ ID NO: 9547 - DNA, 297 bp, Homo sapiens
cacacacacacagggtaagagattgtggataaaaagagaaaatttggcgacagggtagatggaagagagtattgagattataggacagatttaaagttgaaaatccgctgcatactcaccagtctgatgaatgaacttcctttaccggccaatgcaccaaaatgataatggttctgatgagtgaaggaacaccagggttcttggtactcatgctggtttagataaaacgacatggacacacatggaggggttttaaggagcggagagttgaataggccaaaaaaaaaaaaaaagggb

SEQ ID NO: 9548 - DNA, 73 bp, Homo sapiens
attttttttgagctggtgactgtggccggctgggagtaggcggcagtgagtttccctgggagggcagcgcgck

SEQ ID NO: 9549 - DNA, 527 bp, Homo sapiens
  misc_feature 262..263,265: n=a, g, c or t
gtttaagaagcgtggactcttgtcctgagtgcaccgaggctttcagcctgcgggacagtggtgcgatttgcattagaggagatggaaggtgaaggtctctgcccccgattgtggatgttcagaaggagaaagcatcatgactcccagccttggccacctggcagcttacctgagatggagaagagataggaaagggagatgccatgtgctggcccagcactccaacaggggcctgacctctaggaacgggacactggavsmnnkntagacatttgaacaaatcaagtcatccagatccacggtcagctcctgccccgacttggccttcctcctgctgggctggccacggacctcgggaacctgccctggctgtggggacctgcaggtactggtcagcgctgctgttctgctggtcactgctggatgctgccgacacggagtcagattccgtgaggatggctcgaacctgggcttcctctggcttcagagggggctgtgggtattggaaattccgggatcgtggcttt

SEQ ID NO: 9550 - DNA, 487 bp, Homo sapiens
ccaaggcatcctggcctatgtaatgggttgttctgcctgccagcagcaggaacagcagcaggcacctttagaagaacccttgaaagaagtgtgggcagtgaagcactcccccagctactttgaacaaataaaatttaattaaaaatacggacagccttcagccactgctgccaaacttggaaggacatcagttgttctctttgacccttgacaaaatgggaactttacaaagggggaaaaattactttttgtggctgggcacagtggcttactcctataatcccagcactttgggaggcagaggcgggaagatcacttaaagccagcagtttgagaccagcctggggaacaaagcgagaccctgtatctacaaaaaagtttaaaaattagccaggcatggcatgtgcctatagtcagagctagtcagggggctgaggtgggaggatcacttgagcccagaggttgagggtgcagtgagcatgatcat

SEQ ID NO: 9551 - DNA, 401 bp, Homo sapiens
  misc_feature 231,350: n=a, g, c or t
atgctcggcgcgtcggcgaggtttccgcagctgagggggcagctccgcgwcggcgtccggggtctccagtagggctgacgctccggtgctcgcacaatcccccgcctcggctggcaacgggcgtccctccactccccgagtccccggcagccgccgcyaccccagcgcgccccgatctggccccctgccccgcgaagatggctgccgtacgccgggcccgcagttattgcngctgcctggtgcgcttctccgaccgagaactctgctaagctccgctgcagagacaggcaggagtagacacccggacacccagcacccctcctccggggggcggtgcagaagggggcacnragagcccctcgagcgcasaggccgccccgccagcatgatgtgtgctttas

SEQ ID NO: 9552 - DNA, 355 bp, Homo sapiens
  misc_feature 2,111: n=a, g, c or t
angttatcactaggcgccgaggaggggagcgggaagcscagtgccagcgccacagcccttcaatcattttggttgctatccagcttctccacatcaagtccaacttcaganaccccaagcctgtagagaaaagttgacctgtgctgactctggtgatgagtctccgggaccattatggcagtcaagtggacgggtgggcattcttctcctgtcctctgcctgaatgcaagtaaagmmgggctgctggcttctggagcagagggcggagatctcacggcttggggtgaagatggaactccattaggacacacgcggttccaaggggctgatgatgttaccagtgtcttattttctc

SEQ ID NO: 9553 - DNA, 409 bp, Homo sapiens
aattaaaaattaaaaactagcccagcgcagtggctcacgcctgtaatcctagcactttgggaggccaaggcgggcggatcacctgaggttgggagttcgagaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatatattaaaaaaaaaaaaaaaa

SEQ ID NO: 9554 - DNA, 227 bp, Homo sapiens
acaccggtacaaaaagctccagggtattatggtatgaaatgctgcctgcagaactttatggattcagggactaaagtcaaagcctgcttggtctacggcctcagaactctgacccatgggcacagtggtagaagtgcaacaagattaaaatcgatatgactcctgactctatggtttctaattctataatgctagtactctatactattaggcctttaaagtaaaaa

SEQ ID NO: 9555 - DNA, 380 bp, Homo sapiens
gaaaatactattatctgtgcttttgaggctatttctacatagtaactcttatggagacctaggggagacaccgcgcatctcttcctgattccccactcaatgacatcatgttagtctttggttgcttaactggctgtggggagtgtttttgtatcacaaagattagagaggactacacatcagggcttgatttattgtttgttgattttctagacttcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaaga

SEQ ID NO: 9556 - DNA, 405 bp, Homo sapiens
catttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaa

SEQ ID NO: 9557 - DNA, 372 bp, Homo sapiens
ttgattactctccctatcctctactcccagcctcctttttgtaggaagtaatttttattcagcagataaatgtatagtgtgtggctgggtgcgatggctcacgcttgtgatctcaacactttgggagtccagggcgggtggatcacttgaggtcaggaattcgagaccagcctgggcaacatgctgaaaccctgtctctattgaaaatgcaaaaattagcctggagtggtggtgcacacctataatctcagctattctggaggctgaggtagaaaaatcgcttgaacctgggaagcagaggttgcagcgagcctagatcatgccactgcactcccacctgggtgacagagcaagaccccgtctggaaaaaaa

SEQ ID NO: 9558 - DNA, 281 bp, Homo sapiens
aaaactgcccagacggttggacaggacgtagacacacagaagaaaagaagacaaagaacgggtaggaaaattaaaaaggtaggaggctgaggcgggtggatcacctgaggtcaggagcttgagaccagcctgaccaacatggtgaaaccaaatctctaccaaaaatacaaaaattagccaggcgtagtggtgcatgcctgtaatcccagctacttgggaggctgaggcaggagaatcgcttgaatctgggaggcagaggttgcagtgagccgagatcacac

SEQ ID NO: 9559 - DNA, 488 bp, Homo sapiens
catagtggtttttaaaatgtgatatttataacaagaaatcagaattggtatttagatgatttcctttaggtttaatcatgtttgttcctcctcatttatctggtagttgcacatatgttggtggcatcaaccctcagatgggtctttgcaatcagtggaagcccattaatcatgatgcttgccccagattttgaaaatttccagctctacctgccaatttgaaaattaccctgtggagtattggttgaatctacctttcatgttcaccatcttcatttatgtcgttcacatcctgaattgttaaaagaggtatcattgttaaatgttgctaggtgaacaaggaatgtacttcttttcatccgtaattgttgctatttcatgcattattatttaactcattgaatttttaatgtttacgaaataagttttagtgcaactgacttcctgacttaagatttatgtgtagggctggacacagtggctcacgc

SEQ ID NO: 9560 - DNA, 306 bp, Homo sapiens
gtagaggcagaaggcaaatcttgatgtacttgagttctctcagttgacatcctctaaaattacgtttcatttctgtgtttgtgtgattgctcagattttttctgttactagggcttagttactttgtagagaagttttttcaaggggtagttaacattaaaatagtttgttagtcaccataattttttggatattttgagaaataactcacattgcatatttattttacagctatccaggcagaattgctgaaagtcaaacaaaagataaaggcacagaaagataaagagaaggcagtatatgcaa

SEQ ID NO: 9561 - DNA, 369 bp, Homo sapiens
ttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagabgcacgatggaattgkgttttgcgttttttggtaaaaggrgcaaagcgaggacctggagataaacgct

SEQ ID NO: 9562 - DNA, 274 bp, Homo sapiens
catttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggatttt

SEQ ID NO: 9563 - DNA, 363 bp, Homo sapiens
  misc_feature 137,139,151..153: n=a, g, c or t
aacatccaggataattctcctttccaagcccgggagttccggggcaggcgaaaaaggggggatgggagacccacagtccctttaaccctccccccttggcytgccaaccttttccgaacccccatgtcacasaacdncntsatcatggmvnnntcsactgggttcggcgctgaggatgccaaactccatttcacaaggaacatgtcaacagctgggcttggggtttgaggaacagagccgctgcgattggaacagagcccggccaccctgttccaccactgtccactccgtagctcccagcctgccgccgsgcgktgcccgaacacgagagggcacctcctcccagatccggggcgcagaagc

SEQ ID NO: 9564 - DNA, 361 bp, Homo sapiens
ttggggttttgcacattgtcctgggagcaatgggaaattattgaggcatttttggcagaggcaggacagatcagttctgtctttttagaaggcttctgtgacagctgcatggagaatggatggsagggggctctkgtgagttggagaaaatggtagtgtgaaactgcgtggtggcagtgaagctggggagaagcagccagaacttagrggtcaaacaakaggattttgcactgaattggcagtgaggggttgggagaaagaggtcaagcattcattcatttaccagtcacaaaacagctcctgggtgcccaccacacgccakwgacagtcaggagctagywaagtcccatcctcctgaagt

SEQ ID NO: 9565 - DNA, 395 bp, Homo sapiens
  misc_feature 16: n=a, g, c or t
actcgcttaccggagncttcagtccccggcggcgcggcgacastagggttcacggccactggggcagaggagccgcgagaagatgtgggtttttggttacgggtcctgatctggaaggtggatttcccctatcaggacaagctggtcggatacatcaccaactacagcaggcgcttctggcagggcagcacggaccaccgcggggtccccggcaagcctggaagagttgtgactcttgttgaagatcctgcgggatgtgtatggggtgttgcttacagattgccagtaggaaaggaagaagaagtaaaagcataccttgacttcagagaaaaaggaggctacagaaccacaacagtcattttttatccaaaagatccacaacaaaaccattcagt

SEQ ID NO: 9566 - DNA, 444 bp, Homo sapiens
catcatttaccctaggtaagaactttgatcactgcttactaggtaaagaatgtttgtactgttccaaaacccaggcttctttattccttkaccactatccatgtgagcattgacaaatcatggcttagaggtgctcactgactcgctaagacgactttggccctgttgatgactggtgctgtgctccagccttatcggttaggrdacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggcagtgccggaggaggcatgctcctctttctatgccacagaacaaacactactctagcagagcctttcttgcactttaaagtgagattaat

SEQ ID NO: 9567 - DNA, 464 bp, Homo sapiens
gttatctawaggaactgrttcacaactttctcagagatggatakkgataactaaacttcatttcagtttactttgttatgccttaatattctgkgtchtttgcaadttaaatkgtcagtcacttcttcaaaaccttacagtccttcctaagttactcktcatgagaktkcatccatttactaatactgddttttggtggactaggcttgcctatgtgcttatgtgtagctttttactttttatggtgctgattaatggtgatcaaggtaggaaaagttgctgttctattttctgaactctttckatactttaagatactckatttttaaaacactatctgcaaactcaggacactttaacagggcagaatactctaaaaacttgataaaattaaatatagatttaatttatgaaccttccatcatgatgkttgtgtattgcttckttttggatctcattctcac

SEQ ID NO: 9568 - DNA, 485 bp, Homo sapiens
  misc_feature 331: n=a, g, c or t
aaggtcttggaagtttgaaattggcggttacgcaggatgctgcgtttgaggacgcgactgttaatctaggatccctgaggaggtcgccagggcgctgtcccctgctctcggccacctgcaaggaggaaggcagccaggctgctctgcctggtcttctttctctctcatgtgggctaaggaagaagtacttgttacctggggaagcccagtggtcctctgctacagctgaggcagcgaatgttttgagcttgacttcaacctaccttgattactctatctccgggctgactgccctgcaaggagttggtgacagtcattgagactgtctganaggacactttaaaataaattatagacgagatacttaaacaggcacttcaccaaaaaggaaatccagatgaccaacaaatgtgtgaaagttgtcaacctcgttcataatcagaaaatatgaaaaataaagtcacagtgagaaagaataacactca

SEQ ID NO: 9569 - DNA, 332 bp, Homo sapiens
atactctttccctcctccagctttgtgctgatgaacatggtcaccttgaaaggtgtgttgaatatggcagagcagaaaatgcaaggagcttcttctctggatcaccacttgaagaagagccacttgctcctcaggaaccctattttggactgacgttgcaagaaagctcaagtagcctatggrgaggatgcaaggcttccagctgatgccctcagccaggctcagtagcagccagaactagcctaccaacgaacctgctgatcatgtgcataagccaccttgaacgtcgatcctcctgcctggtggagccatcccagctgatgccacatgaa

SEQ ID NO: 9570 - DNA, 428 bp, Homo sapiens
  misc_feature 166,336: n=a, g, c or t
aattcctcattaagcgaggtttctatgaacagctgagttccgtccttaagatgaaggctggcaactaacagctttgatggcagagaggattggaagggagtgagaaatccaccttcactgtattttccaaatggctagccagtcatcctaacaacatgtattgaanggggtcttgctcggtcatccaggctggagaggagagcagttgcaacatcaggactcactgcaacgtcaacaccatctgtggttacaaaattcttttttattttgtagattgtagcaaaatttaagccatttcaggcaaaaaaaaaaaactgrrtttattttgaaaaatanwwagctgtatgycattgdattgaatacatatatccatttcyccaccyctkgdayctttccccaatttgaaaatctttgckgakgtataaaca

SEQ ID NO: 9571 - DNA, 501 bp, Homo sapiens
  misc_feature 480: n=a, g, c or t
aacatgtagatgttgtwattcttgagcctttgtctccataatggggtaagatgtcagahaagagtcagaaagcccaggtgatagaataagtgccaagaacatatacaccatggaatactgtgcagccataaaaaggaatgagttcatgtcctttgcagggacatggatgaagctggaaaccatcattctcagcaaactaacacagcaacagaaaaccaaacaccgcatgttctcactcataagtgggagttgaacaatgagaacacatggacacagattggtaaaacttcagcggttggatgacaccctcttttggtgatgccgtgggggaacgcaacatgattcaaccccaatgaaagagaagttgcaataaccgctaagactgcagatgcatttgactcagcaaacccccttcaagaaatgcatatgaaaaaaactcatgtttcaggttattcattacaacattgtttgtaatagcanaatgtggattagaaatagtcc

SEQ ID NO: 9572 - DNA, 511 bp, Homo sapiens
  misc_feature 278: n=a, g, c or t
aatacaaaggatcaaggttggggagcagggaggaggtaagggaggaggtggtagtaaagaaacctttagactgaaaaatgtaaagatacaatatgaaaggagaaaaaaaacaacaaaagaacccaccatggaagtttcaacccaccaccaccacatggtgccaaaamcttcaaaatggaacatttcttatattggcacatatttttgtgagaacaaacatatggttgtgagcatattcttaccttcattgtgatctgcatatttcctctctgcagganaatttaaatgcactgttgacatcgttttatagtcacataagaagaaagcaggcaaagaaatgttatgttatgattggacttattcatgagataccacagtctctaatatatgaagtttttcatatttacactactggtgaatctctagttgtatacctgcctctgtggtctcattgttggtccctaggatagcttataaatraaaacagatgatactgtctactggccagaac

SEQ ID NO: 9573 - DNA, 76 bp, Homo sapiens
aaaagatgagttcagcccctttcctttctctctcgcacacatatttgctcgcctttttgtctgccaacatgggata

SEQ ID NO: 9574 - DNA, 454 bp, Homo sapiens
cagtaaggaaatctagctaagcaagcaacatgtacaaataaaagattattataattggaccaaagttaagtttaaatccattcacatgtatataattaagatatataggaattataattacagaaaagaatgttacaaaccttcacaaagtaaaaatatttttatatcagatagattcttctgtttcaatccataaaaccagggtttggatcattttaaaaaaacaaacaaaaataatttattggaatcattagggaggacctgatagaataaaatgacaagctgaccaaataggccttagaagggagaggtgcctgggcagttacaaggacctaggtagcaggggtgacttggccacagtcattttctttacttgatttaaggaggtaaatttacagtgagagagttgcacttatttagtttgcataccgtactcaactcttagctagcatag

SEQ ID NO: 9575 - DNA, 179 bp, Homo sapiens
aatcagttcccaagttctaggcggaagaggcccaagagacaccactttctcgctttcagacgtgtctacataagaccacaaaagaaaccgaggcaaaaacaaaaaaaaaaaaaaaaaaaaaaaaaaaaaaaaaaaaaaaaaaaaaaaaaaaaaaaaaaaaaaaaaaaaaaaaaaaaaam

SEQ ID NO: 9576 - DNA, 318 bp, Homo sapiens
  misc_feature 177: n=a, g, c or t
ctccttacctgcgtcctcgggggcgtgcgcaccaccccccctcccgcctaggaggggggagggccccctcttggccaccgccttcgcggcctttaaactcccctggagactgcggctactgccaccgccttgcctccactgcctcttcgcgcagacacagatgcggacggtgggtgngaaaaagggcagacgctactcccagcgaaccgccgctgccgctcccgaggcctcaccaaaatggccgccgccgtctcggccgccaccaccaccactaccaccaccactcgctcggaatcgctatcgccggcgcgsccgtct

SEQ ID NO: 9577 - DNA, 264 bp, Homo sapiens
  misc_feature 114: n=a, g, c or t
ctcagcatctggagtagctgggattacaggcacatgccaccacgtctggataatttttgtatttttagtagagacggggtttcaccatgctggtcaagctggtctccaactccnhrcctcaagtcatctgcccgtgtcggtctccggaagtgctgggattacaggcctgagccaccacactccacccctaatcaccccttctaataaagacacagctcatgtaggatgagagctaaaaaaaaaaaaaaaaaaaaaaaaaaaaaa

SEQ ID NO: 9578 - DNA, 448 bp, Homo sapiens
atttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttcttcacttaaagtgctaacatcagaatcaaacttaaagcttccactatttatgtctttgagaagtatgtagtacctcggtattaacagacctgctgtgatgcagttacactttcacgtatttttgaagtatgtcaagctacacg

SEQ ID NO: 9579 - DNA, 455 bp, Homo sapiens
atcagcctatttctacatactttatatctgttttggattatttggattccagttgtaagcctccatttagaaagggagcatgagaagcactgaaaagtaaggcactgtgatctacacggaaaccatatattgggctcacagctactgaatgagaccgactggtgggagacagtttagtgaacctggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctac

SEQ ID NO: 9580 - DNA, 474 bp, Homo sapiens
tgactagaacatggttgtaggaagacttcaacagcattaacaaatggctttttaatgaatttaactttaaataaatagtttctaaaatgatttgctcgaagcacattattgaggcactggaggaaaataaggttgtgggttcacatggctgctgccggtcaacttcacacttttgtgtgaattacaaataagcttcccttcctgcaggcagatgcaactgcacaccaagtcttacagcttagtaagcagtgtatacctgccccagtcttcctcttgggaatagatttggtgtgagataaaacctgtacgcatttatgggatgtctctgagtgttcaaaaatgttttgctgatgagtaattattttctagccttgagcaaatattgacaattttcaaagtaattctggattactacaattbaaactgtataattctcctccaagactaaggatgttctctgacagcagctgcatc

SEQ ID NO: 9581 - DNA, 468 bp, Homo sapiens
  misc_feature 233,376..377: n=a, g, c or t
gatgggatgactccaggaagtctatgggggagtaccacaaaatgtggaggaagatggcactagacacctgaggagggaccacatgacctccatccaggtagaagaccttccctcggaacacccggtcatcagagagtgttcctgatttcgcttttgcagacsaagaggtagtccagcttggaagaacatccagcgccttccctgaaattcatctgttctccactttccactcntgactgtcataacaaaggacagttgtaggtggtgcccagtgacccaactcagtcagctttatctattggcaataaggaacattcaaatgattcccttctcgctattttgaaatgcacagtagatgagtgtatgctgcagccwnnctgctgatctatcgaacgctagtgtgcagctgagggtgagaaccgccgggtggagattggaggagacctgagtctttaataaccactgagc

SEQ ID NO: 9582 - DNA, 426 bp, Homo sapiens
  misc_feature 280: n=a, g, c or t
atttgttgaactaccatttatttagtaggtctttttatttttcatttatttatttatttttgagacggagtcttgctgtgtcgctcaggttggagtgcagtggcgtgatctcggctcactgcagactccgcctcctgggttcaagcaattctcctgtctcagscccctgagtagctgggattacaggcgcgtgccaccatgcccagctaatttttttttgtatttttagtagatacggggtttcaccatgttggccaggatggtctcgatctcttgaccntgtgatccacccacctcgdcctcccaaagtgctgggattacaggcgtgacaccgggccccgcctagtaggtctttttattaagattataacccaggcatccactggggtcccccaggcctttgaaatcaagataagacagtgtcat

SEQ ID NO: 9583 - DNA, 141 bp, Homo sapiens
aaccttctgggaatgcagcccgcaaaggccccatggaatatctgcaataccctgaagabcatgatgttcagcagcaacaaggaagtgccacaagaragcataaccattgatcattgacaaaatgacttggctctatctgga

SEQ ID NO: 9584 - DNA, 192 bp, Homo sapiens
actcaagactgctctgcctacagagaagccattcttttagtttcttctttkkaaaaaaattagagacagggtctctctatgttggccagtgtagtcttgaactcctggcctcaaccaatcctcccgccttggcctcccaaagtgctgggaggtatgaggccaccatacctgacattctttggaatcctttww

SEQ ID NO: 9585 - DNA, 359 bp, Homo sapiens
gccattcttgagggagtaaggtggtatcatattgtggttttaatttgcakskscctaatcattagtcatgttgagtactttwwcatgtttttrgccatcttctagacattggcttaggcaaagatttcatgaccaagaacccaaaagcaaatgcaacmaaaamcaaagataaataggtgagacttaattaaactaaagagcttttgcatggcaaaaggaatagtcagcagagtaaacagacaacccacagagtggaagaaaatcttcacaatccatacatccgtcaaaggactaatatccagaatctacaaggaacgcaaacaaattagcaagaaaaacaaacaarcaaacaaacagta

SEQ ID NO: 9586 - DNA, 115 bp, Homo sapiens
aatttttataaacttttgttctttcttgtaactttttatcagtcagctattccaatgaagcaaaatctgataatatattgcttttatactaaaaaaaaaaaaaaaaaaaaaaaaa

SEQ ID NO: 9587 - DNA, 138 bp, Homo sapiens
agggatgggtccctgagacttggcgaagtgggagccctgtgtgatcgtgcgtcagagtcggggctgagaccagccccggssbgggtagttaccgggrcgtctccggagccgggattcgcggagggtccaccagcaggr

SEQ ID NO: 9588 - DNA, 63 bp, Homo sapiens
agtgagcggagatcgcgccactgcactccagcctaggcgacagagggagactccgtctcaaab

SEQ ID NO: 9589 - DNA, 72 bp, Homo sapiens
attccttttagttattaggtattcgtagtatggtccagcaatttgacccctgatctctgcttttttttttty

SEQ ID NO: 9590 - DNA, 73 bp, Homo sapiens
attttccaaagccatggtgaaacatctctgtgctaatttcttttgttttgtttcctaattttttttttttttk

SEQ ID NO: 9591 - DNA, 135 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaaaaaaaaaaa

SEQ ID NO: 9592 - DNA, 78 bp, Homo sapiens
tttcctttatgccattttttgtttttgttatttgcaaaagatcttgtattcctttttttttttttttttttttttttt

SEQ ID NO: 9593 - DNA, 420 bp, Homo sapiens
aacgagcgacggcctgacgtcggcggagggaagccggcccaggctcggtgaggaggcaaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggccgaggagaggccctgggctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactam

SEQ ID NO: 9594 - DNA, 331 bp, Homo sapiens
  misc_feature 294..295: n=a, g, c or t
taataccaatctcttgacactgaaaaatactgttaagttttagactcaaatctcattcatatgtttaaagttagaaatctaaacattatgaactgtttgacatttaatgaaactggcttttaatatacatatcttataaaactaatgaaacctcacttcatcttgtaaaagaagatttttttttaagattctttttgctttacggacttacctttggctggatcacccagagtggtaacagcactgctgccaacacggagtccacactgacataccaattttgcctttaaacannbagattactttgcttcagtctttgaagcaatgaaat

SEQ ID NO: 9595 - DNA, 138 bp, Homo sapiens
aaaactgtgctgggtgtgcctatcagacaccaggtcttgcaaaaccatgattaaaagtctcattttcgctgttaaaaaaaaaaaaaaaaaaaaaaaaaaaaaaaaaaaaaaaaaaaaaaaaaaaaaaaaaaaaaaaav

SEQ ID NO: 9596 - DNA, 194 bp, Homo sapiens
aatttttataaacttttgttctttcttgtaactttttatcagtcagctattccaatgaagcaaaatctgataatatattgcttttatactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaam

SEQ ID NO: 9597 - DNA, 456 bp, Homo sapiens
cgtaggtttaagtgttcagatggacatgtgaattgctcccagaaggattcgcatagatccctggtatatacactgggaaatatgcattcagttaaccttaatgagaagggggacagatgatacttacttgttatagttttgagtactaccaaggtcatgtttttagggttttctttggtgcttttctaaatacacaatttaatgttaactttatggatgctgtggtttctcacccagataaaatattatgctgccatacactttgactccaagcatctccttcctccatcctcttccaagtgcaccacatcagtttgttcccaccctgtagtgtaggagctcagcatagtacatgtggctctgcagagcsggatatctactttgtatcataacattcaaaccagaccactttgtgaataattgaagcaagaactttgttactggacatctggattt

SEQ ID NO: 9598 - DNA, 403 bp, Homo sapiens
  misc_feature 287: n=a, g, c or t
caaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctamwttctaaagactgaacaaagtgctagctgcaaattatcttgaaatcatttggctcttttctagcatgtgtgtaatcatgttttcttcandttcctgaatgaccatggtagcattagtgtttagaaattgttcaggggaaaattgagctattttccatagtggctagcaattgctacacatccttagatactcctctctcccatag

SEQ ID NO: 9599 - DNA, 480 bp, Homo sapiens
taaaatatgctacaagaatggaattatccaataagaaaaaaattttttgttaaggaaattaacaaagcgataagggtaaaagtgaaagttgatgatgttatagtatttttattcaaatgtttgtagacggctcttcttgagattgtttatagtgaccactacttcaatcatcctaaaacctagctttctatgcatctgaacaatagagaggtccccatttgccacgttctctaagtctgtacagatcaacctaggtaagacccaatgggtattaatttacatcaccctcaagtggcttaaggaacagacatcaccatttggcagggtgtggtggctcacacctgtcatcctttcactttggaggccgaggcgggcggatggcctgacctcaggagtttgagaccagtctggccaacatggcaaaatccagtctgtactaaaaatacaaaaaaattagccaggtgtgtaggtgcgtggctg

SEQ ID NO: 9600 - DNA, 402 bp, Homo sapiens
atataaatcaaagctgttacacgggtctgccattccaaacaagtcaggaaagcctgcacaggactggataaataattaagaacagagtgttctgaacatcaacacaaagtggaagaaccttaagctgaaggtacagtatattatttacactgaaggggcttgtgtgtggacaagaaagcgctgacagctcaaatgtatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacac

SEQ ID NO: 9601 - DNA, 423 bp, Homo sapiens
atccggaggatgtggggacgcggastgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggaggaatccgacacgtgacggtctgtccgccgtctcagactagaggagcgctgtaaacgccatggctcccaagaagctgtcctgccttcgttccctgctgctgccgctcagcctgacgctactgctgccccaggcagacactcggtcgttcgtagtggataggggtcatgaccggtttctcctagacggggccccgttccgctatgtgtctggcagcctgcactactttcggg

SEQ ID NO: 9602 - DNA, 114 bp, Homo sapiens
tttaaattttccagattttatagcttgcctgtatggatgctcstcaatttatgatggggttacatcccaataaacttattttatttgcaaaaaaaaaaaaaaaaaaaaaaaaar

SEQ ID NO: 9603 - DNA, 366 bp, Homo sapiens
acatcaaccagtctaaggttgctcccaccagactaggaggactggagagtagggttggggtcaaagggtagcctcctgcaggtcgcctcctcctgtggctttcccggacgtcgcgctgggacttcctgccgacaccgcacttcttcccagactcccacctgcgccgctggggccttgggtccagtcttgctctgccacccaaccctggagtgcaatggcgcaatcttggctcactgcaacctctgcttcccaagttgaagtgattctcctacctcagcctcccgagtagctgggattacaggcatgtgccaccacacctggctgatctttcttttagtagagatggggtttcaccatgttgtccag

SEQ ID NO: 9604 - DNA, 78 bp, Homo sapiens; identical to SEQ ID NO: 9592

SEQ ID NO: 9605 - DNA, 423 bp, Homo sapiens
  misc_feature 12: n=a, g, c or t
agagcggcgcgnatggatccaacatggcggcgccgagcctgagccgagagaagagacctgggaaattaagtttcttgcggagtacggtggggattgcagctgctgagcagggattctggaaagcattgcgtacctgagcccccagcatggcsgggcctaaagcggcgggcaagccaggtgtggccagaagagcatggtgagcaggaacatgggctgtacagcctgcaccgcatgtttgacatcgtgggcactcatcacacacagagatgtgcgcgtgctttctttcctctttgttgatgtcattgatgaccacgagcgtggactcatccgaaatggacgtgacttcttattggcactggagcgccagggccgctgtgatgaaagtaactttcgccargtgctgcagctgctgcgcatcatcas

SEQ ID NO: 9606 - DNA, 435 bp, Homo sapiens
  misc_feature 348: n=a, g, c or t
aacacttaatggagacacaatggagagccattttctcttcaatttcttagtccctctgccctctgtaaatgtgttgagtgatatagctatcagatgtattgaaggcaaagttctcgcagaggtctctgttccagctctgtaaaggtcacaggaatcgtgaaggagctgagaaatcttcctctccggcccactgtctgtggcccattgtcattgtttcctcatgaaacattgcagagtttgaatcctcagtaactctcattvactggattagaggtgatggccacagcaaatgggagagcaaaatgttggcctacagagaatgacacaattttattcgcctttggtghnagttgccatagtgctgtatttgaaaatcgatgctttagccaaaagctgaatgaccamcgtttccgtagtttccactgttttgtctgs

SEQ ID NO: 9607 - DNA, 423 bp, Homo sapiens
  misc_feature 298,301..302: n=a, g, c or t
aggaaaagaatatccttgctgtgccaagawagahaagaccatggatctactagttgcagatttcagcagtaatgccahgggggcaagaagtgaccagcagaacaattaggccatggcaacagaagccaactacaacccatgttccaatctatgacctccctctcctgctggtacaaggatatgggcaagagctgataatcaactgactaatgaggattgacttctacaattgatgagcatggaattggatgtgcctaaatcaacagaagagggattttgatgtcatcacactgtagcnaynntagacagaacgctcaaaggtgtcaatgggcagaatttgtagatgacatwcagcatccaatggattactcctattcagtattccttagagcaaaggatgcaatgtcaagcaagttgtgatac

SEQ ID NO: 9608 - DNA, 163 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaaaaaaaaaaaaaaaaaaaaaaaaaaaaaaaaaaaaaaaaaaaaaad

SEQ ID NO: 9609 - DNA, 397 bp, Homo sapiens
  misc_feature 325: n=a, g, c or t
tgagtctctgtctctctctgtctcctcacagtctgttactacttaatacagtgcttattggcctgagattggacattatttaaaagcaatttggagagttttctccatttcaggcaagaaaacatgcactatttttctgatatggcatgggacatcgaaaaatagttttgaacaaaattttgaaatttttggcccaaagaaagcaaataccccctgcaacaaacaagatgtgtcacaataagtcatgatttacaatccctttcaagactgcctgttgcccttagcaatccctaaagcaaaaacaaacaawwabaatcktkksaknatatcttcatgaaactgtctgggatgtgacaaaactttgagaaacagttttgtgataatggttttgcacttt

SEQ ID NO: 9610 - DNA, 502 bp, Homo sapiens
  misc_feature 290: n=a, g, c or t
atttttggaagtggcccaccaccatcttgggagctctgggagcaaggaccacctggtaacaataggccaaatactgtgctgataagttattgctcaatgttcagactcttgcttcaagatcaactgaagtgctttcttgaaagcctgccctgaatcctcatctattgatggagatggtgtcatcttgccttgattgtatccagaagcttcatccccaagataaaggatggacatctctccgatgaccagcttcttttgctcgactctagagaaggttgctttctgcattnbrgcaactgccctctgtctacatgattagactcgttggttgcagtgctttctggagtaatgaagggatccagtgcacagggtttaacttactgggcacaatctctaagccaactctgcctgaatgggtcccctgttttttctcttctgctcttgttgaaccatatctctgttccttgtgctcctgggaatttcttgctctgtaagggtaaat

SEQ ID NO: 9611 - DNA, 431 bp, Homo sapiens
ctacttaatgtcttttatttgaaattacattgtaatacagccctctcttgaatgttagaattgggttttgatgctttgtcaaaaaggggagcagatgaccaccagaggctttgggtagctaaggcaccataaaaagcaggttaactatctatgagtacaggaagtggattattaatctgattattctggttgttactattaccaggaatactacagggtgttgtaattcttagcatattcatttattctaccacggaaaagcaatgtgaatcaaattttaaaatttactattttagaacaaagtgctaaaggagtatttcctaattgatatttttgtgcctaataaagggggttttcctgtaagtcgtattaataattctctaaggggacccatgtcattccccaataaagcaacaaaaacaaaaaaccaa

SEQ ID NO: 9612 - DNA, 420 bp, Homo sapiens
attcttgaagtcggtgagaccgagaaccctccaattgcagacacaatattacatgagatgccgtttgaagctttcacctggagttggcacatctctgaaactccaaacacataacaataatagactcctgacgagatgaggaagtgtgcactcaagtaacagtgctgtctgaaagacttagagcaacaaggtggatctgacaagcagttgaccatgaacaaagaagttttgcaacctccttggacccctgatgacagccagatgtctgtggcctccagtcacctccagaccttcaccccctgcatggtccctcttcctctaatatgaaagaagcctaaaaaaatctatcaatctaagttggttctggctgggcacggtggctcatgcccgtaatcccatcactttgggaggctaaggcag

SEQ ID NO: 9613 - DNA, 459 bp, Homo sapiens
  misc_feature 191..192: n=a, g, c or t
cactgacatgttctcattcaaactatgttataagagcaaggagaaagaagtaagaaaaatttgctatcatgtagaaaattctggggaacctcaaataactcactttatatttagcaggagtttatgcttcagagatcatctgtccctgcaatagacattttatcatggtaagggtgtggtcagcaatagannvctatgatctcagcagaagtccctctaccaccccatagcttagtaattttcttaccaacagctagctgaggtagtgtgcatcccagacgctccgcaattggggaaaggtcttttagcttgttttgctgttttctcccttcttcacttacaattctttctttcaaccactggtagcactggggaaaagcataacattgaaatgttaatgtctggtaaagatctgatgtcaaagaatggtaattcaataaaatatgtgaacctcaaaaa

SEQ ID NO: 9614 - DNA, 478 bp, Homo sapiens
aaggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagagagaaataacaaagaaaatattcagaaaacatagtagaggtgagctgacatcatcaaaccttgaagttcttgcacttaagttttccactgtgtcctgaatcaggtgatattggggaatcattaaccaatggcaacaggaatccaaggataaagtgatttccctcctgttaactcatctgccttttgctgaagccag

SEQ ID NO: 9615 - DNA, 336 bp, Homo sapiens
tgcactatagaacaactggacctaatagatatttacagaacatttcatccaacagctgcagaatacatattcttctcctctgcacatggattattctcaaagatagaccatgtgttaggtaacaaaacaagtcataaaatatccaaaaattggaaataatgtcaagaatattctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatatac

SEQ ID NO: 9616 - DNA, 386 bp, Homo sapiens
agaaatgtaattctgaggccaagccaagggcagagttcccagaatttgcttggggcactggcccgcagttctcatttagagagagtggcctgatgtggattctaaagacaggagggtccttggargtcaacgggacgbacatccctccttgtactgtattgttattctttgaaggaggttgctgacctgagcaactggattagggacagttgggagggcctcggactcaagtaaattaagttcctgagttctgtgatggtagggttcagtcctaggtgagttgggaagtagaaaaactttgttttcttttttaaattcctcattttgcacccccaaactcctttttactcagataaaatatctttccagctaaaaaaaaaaaaaaa

SEQ ID NO: 9617 - DNA, 86 bp, Homo sapiens
tagtagagacggggtttctccacgttggtcaggctggtcttgaactcctgacctcagttgatccgcctgccttggcctcccaaagt

SEQ ID NO: 9618 - DNA, 117 bp, Homo sapiens
taactcctagtgtatccccacccccaccccattgtctaatctgtagaagctaataaataatcatccctccttgcctagcaaaaaaaaaaaaaaaaaaaaaaaaaaaaaaaaaaaaaa

SEQ ID NO: 9619 - DNA, 357 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaaccccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcag

SEQ ID NO: 9620 - DNA, 422 bp, Homo sapiens
  misc_feature 286: n=a, g, c or t
amtgttcaaaaaaggawgscaatgaagaamcatttacagaggactgtgggtaaagcaaagtcttcaagggaagataacaaaggatgaaacaatggtgttgtgtgacttcctagtgtgaatcatggcaatacagtgaaagacagtgatttactgcttttgagggcgtgcatgtatatgattaacggatggaagtgcaggactccaagatttacttccttccctttccagcggaattacctgagacgagtaaaatctactggtggagtcactccattattcttatvvngtggagatctagatcttgatttgaaagtttctgagaaaatcttcagctcagacttgagggtcaactttaccagctgaagtgactacatcctgcctgctttcagctccagtggaaaatgcattaatcccagagtctc

SEQ ID NO: 9621 - DNA, 80 bp, Homo sapiens
agtgagcggagatcgcgccactgcactccagcctaggcgacagagggagactccgtctcaaaaaaaaaaaaaaaaaaaar

SEQ ID NO: 9622 - DNA, 511 bp, Homo sapiens
ggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagaggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatcagccacttcgttagaraccgtattcttta

SEQ ID NO: 9623 - DNA, 389 bp, Homo sapiens
  misc_feature 237,331,335..336: n=a, g, c or t
acagtgactcgtccccaaacattagtcctaacggtcaaccaactgccaactcaattcaactcgtgttctccagcgattctgctggaagtgaagacccagaaaccacccggcctgcacagggcttgtcctctagtccttaggcgtttgctttctcaatctctgtacccatatttccagctgtccttgggtttgaggccctggaggttttcctgtggcagcccgaggtccatgtcactntaaggaggggctcgagggaggcttttcaaggccagagaaggacgagggtaaaaggacaacctagccctccagcacaggcctgctctgggggcanavgnntttaggaaagagcgtacgtctgaagactgactccyttgactatctgtgtctam

SEQ ID NO: 9624 - DNA, 268 bp, Homo sapiens
agtgtgtaccttagtctagaaccttcaagtgggttgagtgccaattggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcaty

SEQ ID NO: 9625 - DNA, 327 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaar

SEQ ID NO: 9626 - DNA, 86 bp, Homo sapiens
  misc_feature 60: n=a, g, c or t
tagtagagacggggtttctccacgttggtcaggctggtcttgaactcctgacctcagttnatccgcctgccttggcctcccaaagt

SEQ ID NO: 9627 - DNA, 452 bp, Homo sapiens
  misc_feature 238,253: n=a, g, c or t
atttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctncctcaaccaatatanagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcat

SEQ ID NO: 9628 - DNA, 102 bp, Homo sapiens
aactaccaattaacgagcrasraaacagggccagagaattggaacaaaatacaaggctgcctctgaaaggtcatgttcaagctaaaaaaaaaaaaaaaaaaw

SEQ ID NO: 9629 - DNA, 233 bp, Homo sapiens
tttaattatttgttcatcagttgatggacattttggtgttttcacttttggctatttttgagtaatactgctgtgaacattcatgtacaagttttttgtgtggacataggtttttatgtttataaaacatgttttatgtttatgtttttatgttttatgtttatatttctcttgggtacattccacctagaagtggcactgctgggtcatatggtaacttttttttttttttk

SEQ ID NO: 9630 - DNA, 321 bp, Homo sapiens
actcacaggaggggctgcaccaccctggggcgttttcaggaacattggctcaccctctatcagtgtcagtgataacgctgggataaaacaccacaggttggtaacaaccatcttctttcgtattctcacttgctcttctcttttctcttcttctcctctcctccccatctccttctctgtctctgcatctctctctgtttttctctttatctctgtctcwgtgtctttgcctttttctctctctgactctgtctctttctgtctctgctctctctgtctctatgcctttctatgtctgcctctttctgtctttgtcyctga

SEQ ID NO: 9631 - DNA, 308 bp, Homo sapiens
taagaagtgcaaataaagaaggaaactaaaattttagattaaacaagttaatgtgtttgtagggaaatggagagtactaaatttctttttcttacatgttttagactcatgatagtaaagagcacctggcaatgatggaacgaatattaggacccataccacaacacatgattcagaaaacaaggtatgttttaagattcaagacttttgttggatatgtgcaatagcatatattcaaactacagaaaacccaacgttgttgtaatactgattccaaggactatagattttgactttttttttttttc

SEQ ID NO: 9632 - DNA, 391 bp, Homo sapiens
  misc_feature 298: n=a, g, c or t
atttttcagcttccttttgttcacattgctacagatcttcagaacataaaatcccatgaaggaataacggacaaagggaagaaggattttgtgacttggggatatttaatgttaaatggttttccaaaagagctgaaccagtttacacagctgctgaaacaggtgacatgagagcctttggaaatgaagacccaaagaaatgaagaaatctgtatatttgtaagcccctttcctcggaaaagcccagaagtgtttcaagtggtgaccagcagagggcagcagtatccaccgcttccbncagagcacggcgtgcggaggtagactgtcttccggtcccacccggagatggggaattctaggccagtggctccaagtgctccttacccccagc

SEQ ID NO: 9633 - DNA, 455 bp, Homo sapiens
agtttttggtgttttagagtcggtgaaggctttaaaggaagtaggcagctggaacccggctgtggcgggttgaaaagcccgggcgtttgagagctgagacttgccagttcccacaggccaagccaggcgtctgcaccccattctcttggctccgacgatggagtcttgctctgtcacccagactggagtacagtggtgtgatctcagctcactgcaacctccacttcccaggttcaagcgattttcctgccccagcttcccgagcagctgggactacagaatatgctctccatgagggtgttcttcagggcctaccacaatggctggcactagagaagggcacaaaattgaagaacagtgaagacaaaagcaataagatgattaaggccatgtgagacagcaacaatatcaggttcctgaacacacaacaacataaaagcagtaaagaagctgag

SEQ ID NO: 9634 - DNA, 433 bp, Homo sapiens
  misc_feature 141..142: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcnnggcaggccaacattcaaattcaggarrtacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagct

SEQ ID NO: 9635 - DNA, 292 bp, Homo sapiens
acaaaaaataaataaataaataaaaggraaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaaccccatctctactaaaaatacaaaatttagctgggcatggtggtggggagcctgtaatcccagttacttgggaggctaaggtagcagaattacttgaatctgggaggcagag

SEQ ID NO: 9636 - DNA, 274 bp, Homo sapiens
  misc_feature 132: n=a, g, c or t
arctctgtttgggtctcagccctttggatgttaatcgactgggtccgtgcacctaaataattaaataattcctcctcaatcccacggtctctctgattccttaattatcccactgcacactctgtcacccangctggtgtgcagtggcgtgatctcagctcactgcagcctcaacctccagggctcaagggatccttctacctcagcctcctkaatagctggactkcagatatgcatcactacacccagatgttgaagtgctgttttttaaagc

SEQ ID NO: 9637 - DNA, 297 bp, Homo sapiens
  misc_feature 216: n=a, g, c or t
agagtcgacggctggagagaagccgggagcgagcccaggcgcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatganggccgcgtgtctgtggaaaacatcaagcagctgttgcratctgcccacaaagaatccagctttgacattattttgtcaggt

SEQ ID NO: 9638 - DNA, 369 bp, Homo sapiens
attcactgcattctccctcccgcaagcacacagatcctctcttctctccatgtagtcactacttggggaaggggaatgggtggtatcagcaattcaagactgatttcttttccatcttcagcgcccctttccttgatatgatgttaaaaccaggtattaacaagaaacagatcgaggaagaggcagagtaacaacagccgggaagaagatacagttttagaaattgtggagactgggcaagatgtgggggacaaaagtcaagcaattatcaaaattttgtaagagaagggtgatgtctgcaaacaaaatgcccaattctgtcaatacttagccataattattgttcatcaatgggaaactctcctcccc

SEQ ID NO: 9639 - DNA, 473 bp, Homo sapiens
taagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctckcagtgagagcagtctttttggtgtaatagtgggatgtct

SEQ ID NO: 9640 - DNA, 292 bp, Homo sapiens
  misc_feature 291: n=a, g, c or t
agttgggactcagggccccaggctccggggctgcggggccgcctcttccaaacgcgccttaagcggttttgcagtggctttccgccggaggctgggaggcgccccggccctgagtcagtcaccctttggccggacaggcggttcccgggcgcggaggatggaaacctggcggtaacctctgcaggtcgtgccactcggtgtgcgcaaggtctccagaggcatcttttcatttttagggggcactttccacgaattcatttgagctacacagcagtcctgggcattggggant

SEQ ID NO: 9641 - DNA, 452 bp, Homo sapiens
tgtatgttgcagatgtaaatttcttcctattttctgtctaatctcatattatttaccatgcagctaatgccgtttaccaagtctagctcagagagataagatacaatataaatcagactgtttcagtagaaaccagtattaacgtatggtgatttcttaaaaaaattaatgtcaaccactcaccttttgcattgagaatgtttttaccttttcacaactgcaggggttactgaaaggtttttcattccaagttttatttatttattaattttaaatcatccacagtgactcagctcatggtctcgttgttggaaacactaggagttttcaggacagtctcttcatgtgggtgttttcattacagttcatttacactgttgtaaaataaggtactgaagcaaaaggaggactgatctcctttactgattggtctaaattcaaaagtgaattgg

SEQ ID NO: 9642 - DNA, 211 bp, Homo sapiens
acaaaccccgacgcggagacgttggcgacagtggccgctgggggagctgctgagtgccgcccagcactgggctccctttcccttcactctcggcagtttcttgcctccgtgggtggttggcgcgtctgcggascagagtcgttgtgtggatcgtgggactgcagccccagccaaagggctgtcacgtctggtcggttccgtcacccacggt

SEQ ID NO: 9643 - DNA, 468 bp, Homo sapiens
ctttgccctcgcgasgccgccacctccggaacaagccatggtggcggcgacggtggcagcggcgtggctgctcctgtgggctgcggcctgcgcgcmsaggagcaggacttctacgacttcaaggcggtcaacatccggggcaaactggtgtcgctggagaagtaccgcggatcggtgtccctggtggtgaatgtggccagcgagtgcggcttcacagaccagcactaccgagccctgcagcagctgcagcgagacctgggcccccaccacttcaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccaccttgaacttc

SEQ ID NO: 9644 - DNA, 93 bp, Homo sapiens
gagttgcattctggttccgtcgtgtgtctggcgtgtggagctagtgctcccgcttattcgccactgtcgccaccgctgtcatgaaccgcgaga

SEQ ID NO: 9645 - DNA, 501 bp, Homo sapiens
atatctgagatctttcttctaggagagtgagttatttttgagcagatttttctattgctaataaatatgtgttagtacgatggaaaaaaccttggatgaagactagtgactgtttctagccccactttcaccaagtggcctcttgaccttggctggtcactagaccctctggagccctagttcctcatctgtagagaagggactgatctctgtgagtcagccaaggaccaggagtcttgaattgtgaattttgatagatagatccaccaaacaaaattgtgatccatggagattaaattcaagtaagaacaagaggcagttctcttctggagaagaaattaggttcagataaaaagctatgcctctctctggttctggaagcttggctgggcctgacctgctgcsaacctcgggagactcctcaatctattcacacabcaggagagcaaaagctctctcctgggaagctgtttgcatgaagcaaagcagtgcaatcctcct

SEQ ID NO: 9646 - DNA, 134 bp, Homo sapiens
attcctgtaatcccaacactctgggaggctgaggtgggagggtcacttaaggtatttgttattttttgcgtacaaatatttaactaacttaaagtcaaaataaagattaaccgcacacaccaaaaaaaaaaaaa

SEQ ID NO: 9647 - DNA, 364 bp, Homo sapiens
aaaaatggaaaaataatcaccaacccccatcccgacacacacacacagtccaaagcaaaagtcagtgtgtattgaatttaacaagtaatgcagtttgggatgcttttgctacattttggtggcattttaactagttatctgaatatttattaatcgtacttcctcttgtaaagttaactacttacttttttgttgttgtktttttaacatcaggttctgtatctaataggagatgtaacactttatttcatggcaggtttttattgcagagacttgaagtcttagttttttaaactggcacataaaacactttttgctgttatttttatttatgtcaatactgcagagtatctttatgccttat

SEQ ID NO: 9648 - DNA, 347 bp, Homo sapiens
  misc_feature 281,329: n=a, g, c or t
ataaaaaaaataagccaagtatagaaggacaaatactgcatgatgtcatttgaatgtggaatctaggagctgaactcacagaagcagagagtacgatggtggctaggggtaaggggtcaggagtacagactgaagagatgttggtcaaaagatacaaaatttcagttagatgtgaagaataagttcaagagatctattgtacaacatagtgactatagttaataacaatgtattataatcctgaaaattgcccagagtagattttaagtattttcaccacnaaaatgataaatatgtgaggttatacatatgttattagcttgagttantcatttcacaatgtatac

SEQ ID NO: 9649 - DNA, 157 bp, Homo sapiens
cttaaaaaaacatctggtaaagactgggtgtggcagctcacgcctgtgatcccagcactttgggaggccgaggstggatggatgattgcttgagcgcaggagttctagaccagcctgggcaatacagggagaccctgtctctatttcaaaaataaat

SEQ ID NO: 9650 - DNA, 171 bp, Homo sapiens
  misc_feature 83: n=a, g, c or t
tcgtgtttcaaattktcatcatttcartgaacatacttccacgttacattaagtgtgcctagcagtctgttgcattttataanctcacaattttttgttttgagatggaatctcactctgtcacccaggctggagtgcagtagtgcaatcttggctcactgcaagctccac

SEQ ID NO: 9651 - DNA, 430 bp, Homo sapiens
  misc_feature 348,417: n=a, g, c or t
aaattctaaggaacactagcccaggaaagaagtgtctgacaaaacaaagaaacaaaacctcagtgaaaaatgtgcgcaagaaacatttcacaggatattctcatcttacagatgcacagtgctcattggcatatcaattaactgagtgcagtgcagctsagtttcatactatgtcggaaaaactctcctcaagccgtattttccgtctgctctcacaccaccacaacaatcatcaagaagacttctgcgasttctggaaaaactcccacacaccaagcagtggacaccagctgagagtcctccagttcaattccggcactatctatgcagagataacatcaaatcccncaggttgagggctcagtcccacaagaccactccccctaccagtgttactagtgccatgtacaataaganactttcagtctat

SEQ ID NO: 9652 - DNA, 569 bp, Homo sapiens
attgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatag

SEQ ID NO: 9653 - DNA, 306 bp, Homo sapiens
  misc_feature 27: n=a, g, c or t
tccatattctgtattaggagaaaattnscctcccagcaccagcccccctctcaaacccccaacccaaaaccaagcattttggaatgagtctcctttagtttcagagtgtggattgtataacccatatastcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttgaaaaaaaaaaaaaaa

SEQ ID NO: 9654 - DNA, 206 bp, Homo sapiens
ttcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctcc

SEQ ID NO: 9655 - DNA, 137 bp, Homo sapiens
attcctgtaatcccaacactctgggaggctgaggtgggagggtcacttaaggtatttgttattttttgcgtacaaatatttaactaacttaaaagtaaaataaagattaaccgcacacaccaaaaaaaaaaaaaatt

SEQ ID NO: 9656 - DNA, 111 bp, Homo sapiens
aatttttataaacttttgttctttcttgtaactttttatcagtcagctattccaatgaagcaaaatctgataatatattgcttttatactaaaaaaaaaaaaaaaaaaaaa

SEQ ID NO: 9657 - DNA, 244 bp, Homo sapiens
  misc_feature 96: n=a, g, c or t
ccttaattagactcaggaaacaatgggtttttgttgtcgttgttgttgttgatgttgtttttttatatgcagtcttgctctgtcacccaggctggngtgcaatggtgtcatctcgattcactgcaacctccgcctcccaggttcaggcgattctcctgccttagcctcccaagtatctgaactacaggcatgtgccaccaagcctggctaacttttgtattgttggccgggctggtctsaagst

SEQ ID NO: 9658 - DNA, 332 bp, Homo sapiens
  misc_feature 256: n=a, g, c or t
gccattcttgagggagtaaggtggtatcatattgtggttttaatttgcatctccctaatcattagtcatgttgagtactttttcatgtttttggccatcttctagacattggcttaggcaaagatttcatgaccaagaacccaaaagcaaatgcaacaaaaacaaagataaataggtgagacttaattaaactaaagagcttttgcatggcaaaaggaatagtcagcagagtaaacagacaacccacagagtgaanaaaatcttcacaatccatacatccgtcaaaggactaatatccagaatctacaaggaacgcaaacaaattagcaaga

SEQ ID NO: 9659 - DNA, 80 bp, Homo sapiens
aaaagatgagttcagcccctttcctttctctctcgcacacatatttgctcgcctttttgtctgccaacatgggataaagc

SEQ ID NO: 9660 - DNA, 389 bp, Homo sapiens
atgcataggacttgctgcttgtacttatatcacagcacttaacacagtaggttataatgatttgtttatttctctccctaactaggctttgtgtatctcaaggatagcaaccacattccagttttttgctgtaggcttagtactacctagtagagacttaatttttttttaaatgaatgtttatagtaatagtcaacatttactaaaccgtttggtaaatacttcagataacagtgaccaaaaagtgaatgagtgccaacacttttaaaagttaaaagtttttctcaaccaggcacacataatgctgatggtattcttagagccattgattgagaaaaatacatgatgataaaratctatcatgaattttgtaatattaaagtatattt

SEQ ID NO: 9661 - DNA, 76 bp, Homo sapiens
tttcctttatgccattttttgtttttgttatttgcaaaagatcttgtattcctttttttttttttttttttttttt

SEQ ID NO: 9662 - DNA, 446 bp, Homo sapiens
agaacgtgctgtgtggatgcggcgaaacgctgaggcgcggccttcgctgtgtggtggggactcacaagaccgacgtcaagatgatgctttcaagggccaaacctgctgtaggcaaggcgtacagcacactgacaaaagaaagaagaaaggtaggaagattccaaaactagaggagctactttcaaaragagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcrcctacttctttcttgggatgtataaacaagctgaagcagctggatttaaagcttcaaggagccgactcc

SEQ ID NO: 9663 - DNA, 204 bp, Homo sapiens
gccattcttgagggagtaaggtggtatcatattgtggttttaatttgcatctccctaatcattagtcatgttgagtactttttcatgtttttggccatcttctagacattggcttaggcaaagatttcatgaccaagaacccaaaaggmaatgsaacaaaaacaaagataaataggtgagacttaattaaactaaagagctttt

SEQ ID NO: 9664 - DNA, 456 bp, Homo sapiens
tgcactatagaacaactggacctaatagatatttacagaacatttcatccaacagctgcagaatacatattcttctcctctgcacatggattattctcaaagatagaccatgtgttaggtaacaaaacaagtcataaaatatccaaaaattggaaataatgtcaagaatattctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatataccaaaacctataggatacaatgaaagcagtaggagagaaattgtagcaatatgtgcctacatgaaataaaaacaaaaacaaaataacttcaaataaataaaacctgtatcttaaagaacca

SEQ ID NO: 9665 - DNA, 469 bp, Homo sapiens
tacagttcactattgctatgaaaatgttgactgagcttgggtccctattgagaaacacagaactaataggcatttgggcctacaataaatacagacaggagttcaagccacaatgagaattggcagtcagaatttaaacagaaccctgactgatcagcattgctaatttttctttcctgctgagtccattagcttatctttggtctaatttttgtaacatatgcgccagtcttagaaaagcattttcccatggttaggataaagactgctcctgatatttcacaagttacacagaaagtttctgagcacttaatagtacaagaaataagatctgagagattggtccttattttgcaacataatggaagaagtacagaaatgactgccacatgttgaaaatcacctctcatatttcaaacacctttttaaaaaggtgctgaaaattaattatatattaatagtagtaatg

SEQ ID NO: 9666 - DNA, 452 bp, Homo sapiens
catttagttctgctctgatctttgttatttcttttcttcttctgggtttgggtttggattgttcttgtttctccagttccatgaggcatgaccctagattgcctatatgtgctctttcagactttttgatttagacattttaggctatgaacttttcctcctagtactgcttttgctgtgtctcacaggttttgataagttgtgtcactattatcattaagttcaaataatttttaaatttccttgaaatttaaattccaatgaagttccaatgaaatcttgatatcattgttgatccaaccattacttagaagcaggttatttaattttcatatatttgcatagttttgagggttccttttggagttgattttcaattttattttactgtggtctaagagattacttgatataaccctgattttcttaaattyactgaacttgttttgtgs

SEQ ID NO: 9667 - DNA, 216 bp, Homo sapiens
agggtgagctactgtcgagatacataacatgtaaatgttgaatctgcatctcacttgaaatggttgggtttggagaaacggataktcaagcttattggaattattgttaaaagtgttctttcttggaaccatctgccaagctgtgaggaagctccagagccatatgacaakacctgatggaggataactgaggactttggccaacaacccccagct

SEQ ID NO: 9668 - DNA, 474 bp, Homo sapiens
attgatggaacagatgtaaactcataaatttagtttactgaggttttcggtgagtgtggcttcccgtccgcgtgcttttcctatacaaccagcggcgtcctggcggaggagtcactgtggacttccccggagcgttgtcactgccatccctcccgcggtgaatcacagataccaaaaggaaactcggcactgggcatgttcggatgtgaatggttttgctgataasaacagcctccggaaccaaagcctcaaaatagtcgtctcccccgcccctcgcagaagcggcgagtggtatctgccaaacagatgacaaagtacctccgactgaatcccacagacagcgctttgagcagaacgcacggctcaactcattcatatggccttgaacccacagtgaattgaagagagaaagaaatggatatgtctgaccccaatttttggactgtgctctcaaactttactttgcctcatttg

SEQ ID NO: 9669 - DNA, 285 bp, Homo sapiens
  misc_feature 191,253: n=a, g, c or t
aatctcaggacctaatgagttcgttgtaaaatattcctgggagtagatgggggatctactcccagttttttactttttacagaatattgttgctttcctavaamcaatgtacawatatttgcagttgtatatgctttttttttttccaaataaacttgtcaccctgcatgcccttggcaaatargtgaagnagaaataggaacacagtccacattcaagttgaggaacagtktayctttaaragctgmccttnwgggtgacctggaaagggggaaagatggctaa

SEQ ID NO: 9670 - DNA, 455 bp, Homo sapiens
atattaggaagagaagtgaacatcaggatccaaggcgggaagggatgggctaactgtactgttttgtgcaaatgcagccagatgtatgatcaggactgcccttatctataaaattgagccttgaagggaaaagaaacactgcctgccactcttttggttgtacagcaagatggctgagcagcaactctttttctggatcagttatataaatgctttgtttttaaagtcgggaagtaccttgccagtaagggattgcctttaatgttcttttgatattggacaatgcccctggccacccagaaccccatgagttcaatacaaacacattgaaatggtctacatgcgcctaaacacaacacctctaattcaacctctagataagggagtcataaggactttaaggatcattacacacagtactctgtggaagagaaccccaattgagagaatatcat

SEQ ID NO: 9671 - DNA, 81 bp, Homo sapiens
tttcctttatgccattttttgtttttgttatttgcaaaagatcttgtattccttttttttttttttttttttttttttaaa

SEQ ID NO: 9672 - DNA, 481 bp, Homo sapiens
acacagtagatcaagtttgtttatcccctatatttaaagatattttcaggatcttgaggcaagagacccagaaaaataacaggatcacatttctcaaggaagaattgtgaatataacattgctgaatgggtcagtaacatattggccacatttgatagaatgagcagaactagaaattactttataaatgcagaagtaaaatgtcaatttattaagaaaactggagctacaaaagcaaaggaaacatgaaaacatatggtcaacacaatggaagcttcactccaggcaattacagccaagaaaatagatctcccttatcttgctcttggtcaagagatgcaacatttctcattctgcacagctgtttgttgaagaccaatatatccaggtgaatgaggctgagaagtctgggagctcctgttctccacccagcatttaaaatagaaatctacttcaggcatggcagactgagaatactgat

SEQ ID NO: 9673 - DNA, 488 bp, Homo sapiens
tttaacactgataatgaggttcaaagcttaaggagaaaagactataaatgtgagaagagaagccactaacgattcacagtaagtggttttagtagattcgctagctatacagttataaaatcttaaggttttttcttaagcattccctgagaaaaatcttaagattttagacacttttctagtcaattatttacaataggtttattgattaattaactttgttttagttcacttcctattgtcaccttctatagtttctggtaatcataacatattcataaagagtaggctgggcgcagtggctcctgcctgtaatcccagcactttgagaggccgaggcgggtggatcacgaggtcaagagttcaagaccagcctggccaagatggtaaaatcccgtctctacaaaaaatagaaaaagaattagccgggcatggtggcaggtgctgtaatcccagctgcttgggaggctgaggcagagaattgcttg

SEQ ID NO: 9674 - DNA, 210 bp, Homo sapiens
aggtccttatttcctctctttcagccagattcccattccatcarraatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgaca

SEQ ID NO: 9675 - DNA, 378 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaag

SEQ ID NO: 9676 - DNA, 429 bp, Homo sapiens
  misc_feature 381: n=a, g, c or t
atagcatagaaagtttccattcagtttgctatttagaaacatgcaatgctccctaagtattgtatttgtagggtgatgctttatcatcaagarggtcttgctccacctaagggaatttccaactaaaggaacctcatctttttaaatgcaaaaaccattaaaatagatgggttttaaccaatttggacaggaaacttgctgctaaagtgtatgccgttcctttagtaagcaaacactaaactcagtttagtattaaactaagtttacaatatttgatgactgtggttacattgaaaaggctggaggaggtggagggggttgtccagaggaggaaagatactgtttaasctggcaggaaatggccccagactgttcactgcntattctgtggattcctttctgacagctgtcactttctgcttatcagck

SEQ ID NO: 9677 - DNA, 434 bp, Homo sapiens
actgattgccgcagctactctccctgccgtcgccgcccgggaccgggtgacattgaggttttcgtctatcgccgctgggccgataggcttctttttaagatttggctttccaagtaagatttttgtttgcctgcttttctcctggaatttttttgtttttggtcgaagaagcaggtaacttgcatatcttaaggaaaacattgtttttgctttgcttttgttgtttaaagatcctaaaacgtaccgtgattcctttacgttactaataattggaaagtgtgttaaatcaagggttcgcttaatgttctttagcctttgtacatagaatatataaatgtcgtgagtcatctttacgaggtttatgagtttgtgttcgggtttggcttttttgttgtgtgtgcgtggttttttttttycttttcttgtaacaccgt

SEQ ID NO: 9678 - DNA, 170 bp, Homo sapiens
cttctaggctgttagctctttaagagtcaggattgccagctgggtccagctgttatttgagcaaatcctccttgtttccgggcgtcagtttcctcyttctgtatagtaaagtgttgttaaatcagttgttctccacactacccttcagtggtttcttttttttttttttc

SEQ ID NO: 9679 - DNA, 441 bp, Homo sapiens
gaaataattgttagtttttaatatgcacttcgtggggaaatttcttagacgtatgcaagcaagtgaaaacaattagggccagtggtattaactacttkataaaattttatttttgtttgtaagaagtcatctatttaaggcccagttaatataagtggaatcatcatagtttaaggaatacccagagattgctgctgttctatttattttacagaaaggatagctagattgaaagctcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaa

SEQ ID NO: 9680 - DNA, 97 bp, Homo sapiens
tttctccctggargamaatgctcattatttckgctctgtgagggcaggagcctwrtttcttttgmwwcctgaccttctcccctaagctgtatgagaw

SEQ ID NO: 9681 - DNA, 372 bp, Homo sapiens
tagaatatgggtggtaattgacaatattggagtgcatctgagcatgtagggagaaagctcagagtgagaaaacagaggcctgatagagtcctgcagacactaaaatgtgatagtttcatacaagaggaggagctttgaaaagagcctggaagtgaccaacgagttggagaaacccaggagagtttgtgttaaaaatgccaggaaagagaatgtctcaagagagtaattgctgctgagacgatgattagtagaactgagaagtgcccattggttttggtgagatagaggtcagacattaccttagcactttttggggaccaagtcgaatcaaagtatattggggagcaaaacttttcaagcttggccatgaag

SEQ ID NO: 9682 - DNA, 432 bp, Homo sapiens
tgttattttgtagctttaatgatttttgttttctaatagggcaaatgtctctaagcttggtgtttagagctgcttcatattttaaactagttyccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgtttaactcattactttgtttgatgtgtcttacatatttttgactaaaagttatagaatgttattcctctgggggaatcttttacaggtggaggaatggggatagcagtattgcctcagattcaaactggcatcac

SEQ ID NO: 9683 - DNA, 323 bp, Homo sapiens
taaggtgtctgaggtatgaggaaactatgaaaattggctggggacatgtttaatgtgtgagatgaaagggggaaaaaatatgtcccatcactccttccatatccacaccctccttcacaatggggcattactcaggttctcctcaggtaaagtaggcttggctccctgaccaataatcggtcttccactctcccaattcctagtaagattcacttatgaagagaagaaacggtctcaagttacgtgtgaccactacgctttgaactctgggramcttcaatgtattactgagaccatgaaccacaaaaataggtttgagtgag

SEQ ID NO: 9684 - DNA, 432 bp, Homo sapiens
aataatttctctctctctctctctttcataaggacacttgtgttggcatttagggcccacctggataatccagaataatctccccatctcmaagattcttaatcacatcctcaaagatgaacccattttccagttaaggtaacattcacaggttctggggattagaacatggacatatctttagaagctatcagactaccaaaataagcaaagacattttaaaatttaccatttattaagtaccatatgccagacacctacatacatttttctcacctcaattaagttttacaataaccctgaaatgtaggtattaatgcctgtattctatagacgaggaaactgaggctcagggagattgagtcacgtgcccaatgtcacgtagctggtaaatgacagaactaggatttgaaaccagatgagctgggctcc

SEQ ID NO: 9685 - DNA, 90 bp, Homo sapiens
gaggttgagacaagagaatcacttgaacctgagaggcagaggttgcagtgcagcctgggtgacagagggagactccggccccctcccaaa

SEQ ID NO: 9686 - DNA, 461 bp, Homo sapiens
tagaatagggttttcagccaagtcttgaagaatgagaaattttacacaggaagaaaggtattctaggaagaaggaagagcaggtgcttgtarggttgacatatagcatacatcaaggcacgtactaggaagttcctggagaggtaggagactgatcataaacacactagtatgattgatatgcagaggagttaggactttatcttatccatttattcctcacagtaacattataggatagctcttttattcccatataagaatcaggaaacgaagacttagaagtatgtaatgtgccaatgatccctgaatttagtaccctattagattagggtaagggaagttgaagagtttagaatgactcccagttgtctataatgggtgattggggcagattgggatgttcagttttagaattaagtttaaataccagtccaagtaaagatgttagaatgctatgca

SEQ ID NO: 9687 - DNA, 361 bp, Homo sapiens
caaacagaattaccagataagccaaaaatactgcttctaggtatacgccctaaagaactaaaaacaggtgttcaaataaaaactcgtatacaaatgtttatagcamcattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 9688 - DNA, 416 bp, Homo sapiens
  misc_feature 272: n=a, g, c or t
tcatcagcagtgtataagcatttcaattttaatatacttcctttaaaattaggtatcagtattttaaaatgttttacctaatgaactaaagagtaaaatggtcttgtgaattttctttcatttacattttcagttattttgtatagaaatttaataggaacaagaagtcagaagcagattagagacatgcaaaacttaaactcctaaccagagcatttggctgtgtagactactatgcactgcactagtgttttgaatctaaacctgtttmntccaggcgccgtggctcatgtctgtaatcctagcactttgggaggccactgtgggcggatcacttgaggtcagaggttcaagacctgcttggccaacgtgatgaaaccccatctctactaaaaataagctggatgtagtggcac

SEQ ID NO: 9689 - DNA, 67 bp, Homo sapiens; identical to SEQ ID NO: 8447

SEQ ID NO: 9690 - DNA, 440 bp, Homo sapiens
caatcaatcaatcaataccttatattccagtctggggaaggagtcagaaatgttagattagcaagaatagctaacattttctagtgttwatwatgttccagaagcccaagttatcttatttcatcttcacaataaccatatgggttaggtaatattaatatttacattttgcatgtgaagaaactgaattgcagagaggtcatcagtaaatggtagagccaggattcaaatcaaagcagtctaactctagatcaagaccacttaacttaatgctaattagcagtcattcaaagtagggtgaaaagtgctagttatactgtgggaggtagggagagacaaaagagagagagaagagattaatgctaagggcgtccaggagatcctttgtatagaagatgaaattttagctgatcttggatgattttcagtaaatatagtat

SEQ ID NO: 9691 - DNA, 387 bp, Homo sapiens
ccatattatgaatatgaaaataatgaagttaatttcctgttgcctttctgtgtcagccacaatatcaggtctaaccctaatccagggatgcccagtaaactgaaggcaattttaggttgtagaactcagattaattgtagaaaccattaattttaattgctctaattttcatagtaatcataaaaagtatgcaagtacctaatatataaactcaattgacactgtatctgtagaagtaaatttttaatggctggttaattatatcactacattttattgcagtatagtactcatttaagcacttaaaaatggaaggtgtacaaagattaaattaagacacggtaaattgactaaatatttggtttttatataaataaaggtcataac

SEQ ID NO: 9692 - DNA, 445 bp, Homo sapiens
  misc_feature 392: n=a, g, c or t
catgttaaatgttgttcctgggtccacagataaacatctgaggtaacttaatcttcatgactaaaactagatatgaggcccaggtaaaatgattatttkgattgctttgctaggaaagaaatcattgccatgggttagtacaaaatgcacaggggatttcccttttctaattggagcctcctaatgtgagtagctttgaaagccatttcttgtataaatactgcatcataatatttcagacttgaaatggacagagtataagagtgctttggactgggtgcagtggctcacaccagtaatcccagcactttgggaggctgaggcaggaggattgcttgagtccaggagtttgggaccagcctgggcggcacagggagacctcgtctccacanaaaataaacaaaattagccgggtgtggtggtgcatgcctgtggtcctagctam

SEQ ID NO: 9693 - DNA, 51 bp, Homo sapiens
cattatccatctatggattcattcagtaataaactttcctttttttttctt

SEQ ID NO: 9694 - DNA, 254 bp, Homo sapiens
tatatactgctccgagtgtggtgggctgtcctggtagttgcggatttgtagttcctcctgtaaccggatgcatgaaattgcaagagggctggctattgacaattgcatggcagttcttccatgtgacttataaaataatgagaccaatgccccattactatgtaatgagaccttacatagccattcacaataaatatgaacatataaccttataacccgtargcatggggggctawtttgkttcaaaatgcagt

SEQ ID NO: 9695 - DNA, 421 bp, Homo sapiens
aaacatggacttctcaaattagaaaaaaacaaacaacaaaaaaacaggttaagtgttttgttatgaaaattatgaaaatgttcttattattatggaaaatttcaaatagatatagagagaataatgttacaaacccccacatactcaacatttagcttcaaaaattatcaactcatggcgggttttgtttcatctgtacaaactagtcggcacactatgatggcctgtggacaaaatccggccctctgactgtttttgtaaataaggttttattggaacacagccacacatatttgttgacttattgtttttggctgtttttgtacttcattggcagagttgagtaattgcagcagactctatggcttgcaaaacctaaaataattactttgtgtagcgctttatagaaaaaatttgctaa

SEQ ID NO: 9696 - DNA, 458 bp, Homo sapiens
tggagtctcaactcttccctttagaagtcttgtaaccttgggcaagttcaaccttcctttctttttatctgcagaaggaaggaaatggtaatatgcaatttatcaggttgttgtgagaaaatatatctgtttgtgaatggatagcattcatatccatgttagttttttaaaaaatggtggactattttaaaagtttctattcaataaaatgcttttagtaacataatgcaataccatacaattgtgcaagattatacaagataatcgtagcttttataaaatgttaattcagaatatatattaataggacacaagcttttaaatctagttttatttttattaataccttttaatcaaactgctaataaaatacaactaaaggtgtcctaaagaaaaaagcagtcccttgccttctgtttcctaagccagttttttttagaggcaatgactttggatgt

SEQ ID NO: 9697 - DNA, 391 bp, Homo sapiens
ctccagacttgtatttgcaacttctgattctgttatgcacaacagcatgtatcagaaagtgagataatttcccagaaatgttagaaagttttaaattagtgtactgatgctagagaaagcagccatgaaagtcatcctcaatacaaagttgctggcacttttatggacagtatataaggtaatttagtgtattttacattcatgaataatcaaggcaggttaatcttgcatatttgtttctaattactctatttttactactcccatcatttctctttctcctgcaagaagttggaatgtcctaaccacagtgcatcacatacacccacagaacagtagcaaatgagggccccagtgtttctgtagagaaagcagtcaccctgataactgc

SEQ ID NO: 9698 - DNA, 86 bp, Homo sapiens
gaggttgagacaagagaatcacttgaacctgagaggcagaggttgcagtgcagcctgggtgacagagggagactccggccccctcc

SEQ ID NO: 9699 - DNA, 432 bp, Homo sapiens
tgtcagcttatggttcagcaggctagtgagcggagttacaaagaatccagtgggatttatctggtcagcatggggtcctgcacataatggaggagtcactggctgttgtttctgcctcctcttgggcctatcagtctttgccaccatcaggagaaccgtggagaccctcaggtcccaggcctgcatactaaacaggcttgggtttggcaggactcatgctgccttccccaggccacattgttttgctcatgtgtttggtatcccctgaaatccttgctatcaaagatgcctgtgcccacctaagaggagttaccttaaaatgaaaagcaaacaactttgctcttatttagaaagcatgaaaccagtgccttaaccttatggttttatcattcaaactacagagttggaaaaagtgtgtgtttttttgttgtt

SEQ ID NO: 9700 - DNA, 440 bp, Homo sapiens
ttaaatgacctagaaggtgcaagttgactgtacatcatagatattaaaaagcagacagtcattaacaatcaagatgtaaaagtgatccatgtttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaa

SEQ ID NO: 9701 - DNA, 336 bp, Homo sapiens
tcaacaatagaacatgtcacacacgaactggaaactgattctgtgggcgacaagagtctatagtaaacgttatgacagattctttgaatgcgctaatctcagactggactaaagttgcgattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaataaaaaataaagcagcttgcagaaacttggtctttg

SEQ ID NO: 9702 - DNA, 399 bp, Homo sapiens
cactaattataaagaaaaattatagtaggaggtgagcagttctctttgctgccattttgagataacggggaaaattttcaccataatcatatatactttagtaaatataagcacttcttgtttgatacagatttgtttttctagaagtaaaattgtttacctattagcttttattgatttgtaagttgaaaggttagcttactagagatcagcatcataattactaatgtttcatcctctgtacatcatctcatatacatctttttccccatcctttgtttcatcctttgtgtcaccatccatggaaggtcggggagtgaggacactaccaatctatttaaactcaagatagtttagatttatggtgtggtataccaagttaaatttgtgcatcaaaaa

SEQ ID NO: 9703 - DNA, 89 bp, Homo sapiens; identical to SEQ ID NO: 8903

SEQ ID NO: 9704 - DNA, 323 bp, Homo sapiens
tataaaaaagattagttctatttcttcaatatgacctaaacttcatctcaagtccagttggtaagagaactatgaacctgtttttcctggtctgttgtacaacggttcccttgtggactaaacggtaatgtgttctgcatgaatccaagcacaactgacattcactgtgttaaaaaacaaaaaagagaaacatttactacctttttcagatctcatttctgatggacctgaaaatattgtaagtgggtattttcttcaaatactcagagactgaattctaacatgtaaagaaaatgctgactcacacatgactcagtttgaag

SEQ ID NO: 9705 - DNA, 407 bp, Homo sapiens
taaagaaaaagaggtttaatggactcacagatccacgtgactggggaggcctcatgattatagcagaaggtgtaggaggagcaaagtcacatcttacatggcagcaggcaagagagcttgtgcaggggagctcccctttataaaaccattagatcaggcagggcacagtggctcacacctctaatcacagcactttgggaggccgaggcgggtggatcacctgagatcaggagtttgaggctagcctggccaacatgttgaggccccgtctctaataaaaatacaaaaattggccaggcgtgatggctcatgcctgttgtcccagattcttgggaggcwgaggcacgaaaattgcttgaaccgaggargcggargttgcagtgagctgagatcacaccactgcactc

SEQ ID NO: 9706 - DNA, 383 bp, Homo sapiens
cctttctcttctgccctccgcccaaacatttcacagcagggtatgaagcctttgcctcccttgcctctattatatcctatcctcaccttccgttgtttttttgttttttgttttgagacagggtttcactctgtcgtccagtctaaactgtagtagcacaaccatggctcactgtggcctcaacctcctgggcccaacaaatcctcctacctcggcctctgtttagctgggactacaggtgcaccaccgtgcctggctaattatttttttcttttgtagagatgggggggtctcactgtcttgccagggctggtcttgaactcctgggctcaggcgatcctctcacctcagcctcccaaattgctgggggttacgagcgtgas

SEQ ID NO: 9707 - DNA, 463 bp, Homo sapiens
atctcaggtctcttggctttgccagggcccaccggagaaaactgacgacccgtttctgtaatccttatgggagaccaaccttgtgcctccgggagaatccactckcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatkkctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcgcgat

SEQ ID NO: 9708 - DNA, 405 bp, Homo sapiens
  misc_feature 232: n=a, g, c or t
tctgcctctggaggtttatggttgaatagaggagcacacgatcacagcaagagtgatgtaggarggcaatcgaaaatatcgacaccttaaccaarctkggagagttkgtttttggggaaaaacaaaattactaaacttcagaacctggatgcgctcaccaacctgacagtcctcagtatgcagagcaaccggctgaccaagatcgagggtctgcagaacctggtgaagcacngggagctgtaccttagccacaatggcatcgaggtcatcgagggcctggagaacaatgtgcaggacagcctcacgtactgaggggaagtgtgctcacagagtccccascctcctcagctgcctccagstcaccctgctctgccccagtgcggtgttcaagacaaataaaagact

SEQ ID NO: 9709 - DNA, 72 bp, Homo sapiens
aatkgtgttcgcagccgccgccgcgccgccgtcgctctccaacgccagcgccgcctctcgctcgccgagctc

SEQ ID NO: 9710 - DNA, 367 bp, Homo sapiens
taattgatgatttttatttctattttgcataaagtgatttaatgttgcatttcctgatgtaactgtaaccaatatcaaagttgcttttcctggctggggcakggtggctcacagctgtaatcccagcastttgggaggccaaggcgggaggatcgcctgagagcaggagtttgggaccagcctggccagcatggcaagatcctgtctctacaaaaaatgaaattagctgggtgtggtggcacatgcctgtagtcccagctactcggggaggctgaggtgtgaggtcaagactgcagagccatgtttgtgccactgcactccagcctgggtaagagcaagactctgtctcctaaaaaaaaaaaaaaar

SEQ ID NO: 9711 - DNA, 411 bp, Homo sapiens
aggacccttgggtcaaggcaagccccgtggggcgcacgccggcgaggggagggcgggtcgggctcgtgcacgtaggggggccggwakrcgargggctttccykcstgtccccaaagtcccccacgctctccgtgccccggggctgcagagaagacagctctcaccccgcgtgtgccaaggtggagtatgcvtacagcgacaacagcctggaccccgggctttttgtagaaagcacccgcaagggragtgtagtgtccagagctaatagcatcggttccaccagtgcctcttctgtccccaacacagatgatgaggacagtgattaccaccaggaggcctacaaggagtcctacaaagaccggcgcggcgcgcacacactcaggctgagcagaagaggagggactccatcaa

SEQ ID NO: 9712 - DNA, 71 bp, Homo sapiens
cttttcgatccgccatcvgcggtggagccgccaccaawatgcagattttcgtkaawacccttacggggaag

SEQ ID NO: 9713 - DNA, 103 bp, Homo sapiens
  misc_feature 5: n=a, g, c or t
gaggntgagacaagagaatcacttgaacctgagaggcagaggttgcagtgcagcctgggtgacagagggagactccggccccctcccaaaaaaaaaaaaaaaa

SEQ ID NO: 9714 - DNA, 369 bp, Homo sapiens
taaagattaactacaaagataaacatggccaaaaataaataaataaatatggccatatgtccgttgttgcttagtcttcccttgcagccttttacccttgawttctscsttcabctctacccaaatatagcacaactcctcaagtaattttttttttttttagatggagttttgcycttgttgcccaggctggagtgcggtggcgcagtcttggctcactgmaacctctgcctcctgggttcaagcaattcttctgtctcagccccagagtagctgggattacaggcacctgtcaccatgcccggctaattttkgkatttttagtagagatggggtttcaccatgttggccaggctggtcttgaactcc

SEQ ID NO: 9715 - DNA, 316 bp, Homo sapiens
catcccaggagcacattccctcactgagggttccagccacctcttccgcctcattatactttgcttagcaccgagaagtctggcatcgtttctgttggaatgaaaagawtkgcaagagctgccctggacaacagcactgcaaaacactgtggcagaaggtttggtctacataccaaggcaggcaaagtattaattgcattctctgkgatcacaaaaataaggcgctgaattattctcttcatgttttaagaatgacaggcttttgctctgccagctycaagcatagtgcatcacatggaaaggagatgctagattt

SEQ ID NO: 9716 - DNA, 59 bp, Homo sapiens
tctccgccagaccgccgccgcgccgccatcatggacaccagccgtgtgcagcctatcaa

SEQ ID NO: 9717 - DNA, 359 bp, Homo sapiens
taaacaataagtgaaataattcccaagatttttgaacagatgcttggttttgtgaaccagaggagagccttgaagrbktgagcagataggaatggctttctggagaaagcacatgctgagctaagagttaagggttcggttaggtccgagtggttttcagaggcaagagaggacattctagttaaatcaacaagttgggaatgaatatcacttgttcttaggacaaggagatttgcctgcttttagttggaagtactcactgattatcttgggcagtgtggatggttgagaaggttggggccaatatacagaggatctgagcgtttagatctgataccgtaaaaaagatgagctgctga

SEQ ID NO: 9718 - DNA, 57 bp, Homo sapiens
tkgtaacatctctgmcttctctacctcctctgtgctcargtgactccacatcttctr

SEQ ID NO: 9719 - DNA, 434 bp, Homo sapiens
atatttggttaagatggcaaatgtgggtgtaactcttgattccccttagcattgctgttgctgcctttcatgtakskgtgcccagccaagagccaggttgtatggsmgtgattgggatgactggyatttactgctgcccactggcagtggtagaatagatcacctttgtttcttaggatagccatcagccatttggtttctatatttgtttaatatttagacatagaatgaaagghktgtgggaaaataattaacattgtaatcctacaatagctacaaaagatgtactaatatgtaatgacaataaatgaataacatgctattattgttagttaccccaccatatttagcaagctagagcagtgctgttgaataaaattataacataagccacatacataatttaatattttcttgtagctacattaagacat

SEQ ID NO: 9720 - DNA, 434 bp, Homo sapiens
  misc_feature 396: n=a, g, c or t
tcattgacttgcttagtcgtatactcaaatgatgataaacctacatgtgcaaaggctcacgtttaagattgtcargssagcagtctactgttgtgttgccattgcttttccattgggagaagaaagaattaaccagtcattaaaccatttggtaagttgcactttgctgtgctgrksscacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcrgaagaaatttattttaaattgtttaaatatctggaaatacttttagcwntcatttataaagatagttttgttctcagtttcactata

SEQ ID NO: 9721 - DNA, 378 bp, Homo sapiens
gtagccggagtgagaccgctctgcaaaccactgcgtgctttgcagagtgattatcagcacagttccctgccctggataaggaacagctacagtcgctgttaaatgtgcctgaaaagcaatttgcaatctttgcattaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgcgcggggcacaagggacgacgcccgcctttctctctccgagaaggatccccaaacctcactctcttcactcctccccgctaaaaaaaaaaaaaaaaaa

SEQ ID NO: 9722 - DNA, 368 bp, Homo sapiens
tcaatttacattgtcagagtgaaatttaacagaaccattttaggggaaagatcttgggggcctacaaggaatttccttgtgagcaaattgtgagggaagtatgtagcttttttatcttgkagctattytattaggaacaaaactggatgcaggtttgggtgacccagttcccagcttgacttttccctttggcttarggaatttggggtactgagatttattttcctttcacatcacccaggccttatttgatctcaggtcttcccattttgcctcacctccagtgctctcttagaacagaataccttcccagcaaggatatcacactcctaacttttaatctattgccttcatttgcagactgttca

SEQ ID NO: 9723 - DNA, 300 bp, Homo sapiens
atgaaaaggttgtggtgtagytggtctgtwattaagttgcagatttaaaactgstgttagctttgtaaatcaaaatatasstgttttttgtcctggtatatcgsmttccatctgcagctggagctggaatcccattgatcttctagctaccattcattttcttcactgttcacaaaagaagagtgtgaaattcarygaatgctgyyactaatcctgktacsagatgaatctcatttcaccaaaattaaattatgtttttccgctamaatgatgatacaagytgaagacmcatcactctgm

SEQ ID NO: 9724 - DNA, 227 bp, Homo sapiens
ttaaaaaattactttgggaatagcatacccttccctgaataataaagaggtaatatcagggaatagagtagtgtcaggatgtaatcagttctcacctgacaaatgatggccmgggscarggktattcatctttgctggtgatatatgaagccgatccagggttctcagagttggacagaaggggttgtttggcaggtggtgtgagggtcctgaagttggctggatct

SEQ ID NO: 9725 - DNA, 297 bp, Homo sapiens
attgatcttaatctactaacagagaagggtagwyagtttgtgttaaatgttggcatttacttgtattgaccaaagttttgcagctctactatattctgtgctcaggactaaaatgctgktaattttttttttttttttccagkgctgdgcatatattctgkgatgggaaacattgttgatgtcctaacagaaatatatttkgatctattttcctatggagttgkttctattatgaccatttaattttgtttttatttaatagtagtattyccttcccttttatctaattttttatak

SEQ ID NO: 9726 - DNA, 183 bp, Homo sapiens
  misc_feature 129: n=a, g, c or t
ttcaccctgtggaaagtgcgaagatagaaccaccagatactggactttattatgatgaatatctcaagcaagtgattgatgtgctggaaacagataaacacttcagagaaaagctccagaaagcagacnaaaaaaaaaaaaarmmaacaammaaaaaaammaammmaaaaaaaaaaaaaaawh

SEQ ID NO: 9727 - DNA, 167 bp, Homo sapiens
tttctttctactgctccgccattgtgagggcgtgcttgcgtctccttcgccttctgccataattgtaagtttcctgaggcctctcagccatgcttcctgtacagcctgtggaactctaagtctattaaacctcttttgttcataaattaaaaaaaaaaaaaaaaaam

SEQ ID NO: 9728 - DNA, 67 bp, Homo sapiens
agactgaggctgaggctggggaacatcgggcagcatgagcggctgcgggctcttcctgcgcaccacw

SEQ ID NO: 9729 - DNA, 356 bp, Homo sapiens
acaaaaaataaataaataaataaaaggaaaaaaaagaattttgatggttagtcacccaataaatgttctggttggccgggcgtkgtgggctcatgctgtaatcctagcactttgggaggctgaggcaggtggatcatttgaggtcaggagttcaagaacaacctcgccaacatggtgaaaccccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcr

SEQ ID NO: 9730 - DNA, 58 bp, Homo sapiens
acgccacgggdcagccwagctakwagcctgwkgakccggwgakggtgctggctgccgc

SEQ ID NO: 9731 - DNA, 621 bp, Homo sapiens
ctggatttattgggtggcaatcaaaaataatcaaatacagtccttatttgtataacaaatgtgagatattggaaaatattttaccattatacatcatgtggacttattttatattaaagaaagaagattatattttggctaagaaacggaaacttgtctacacttgattagagaacaactatattttacttcccataggaacgacagaagcttttacaaggagttagagaacaaaacacatcaatataattagtagcacttttgtttaattaggtgtgatggttaactttatttatatgtcagcttgactggctaagggatgctcagatgattgatagctggtaaaacattatttctgggtttgtctgtgaggctgtttctggaaaagatgattagcatttgaatttgaatcagtagactgagtaaagaaggtcctccctcaccagtgtgccaatgtgggtggcatcgttcaatctgatgagggcctgaatagaatgaaaaggtagaggaggggcaaatgctgtcttcttgctgagatgtatccatctgctcctgcccttggacatcagggctctggttctgaagcctttagaccactctcctgggtctcagcgtgcaatg

SEQ ID NO: 9732 - DNA, 207 bp, Homo sapiens
acacctgtaatcccaacagtttggaagaccgaggcgggtggatcacttgaagtcaggagtttgagaccatcctggctaacacggtgaaaccccgactctastaaaaatacaaaaaattagccgggcgcggtggcgggcacctgtagtcccagctactcgggaggctgaggcaggagaatggcgtgaacccgggaggcggaggttgca

SEQ ID NO: 9733 - DNA, 87 bp, Homo sapiens
tagtagagacggggtttctccacgttggtcaggctggtcttgaactcctgacctcagttgatccgcctgccttggcctcccaaaagt

SEQ ID NO: 9734 - DNA, 63 bp, Homo sapiens
agtgagcggagatcgcgccactgcactccagcctaggcgacagagggagactccgtctcaaad

SEQ ID NO: 9735 - DNA, 135 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaaaaaaaaaaw

SEQ ID NO: 9736 - DNA, 93 bp, Homo sapiens
tacgamagacaaagagatgataagccaaaagacagtaaagcaaaacgaagaaagacaagggaggaagctgagamactacctgaggtgtctaam

SEQ ID NO: 9737 - DNA, 371 bp, Homo sapiens
caagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatga

SEQ ID NO: 9738 - DNA, 429 bp, Homo sapiens
  misc_feature 277: n=a, g, c or t
aagaatgttgagcagcagcctcccaaatcacagtatgcataaaagccaaaacagatgacagagctcagtaaggaagaccttactatttgtgacatccatcagaattttaacttgagaaactgatttcaaggacctgagggcactcgctttgctcctgtcagtacacactcccaaacagttaaacccagctctaattccaactctgcaagagcytttwaagccaatgsaggactttgtctgcamcagrgaaactcactccaagagcaagawgccaaangaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagac

SEQ ID NO: 9739 - DNA, 146 bp, Homo sapiens
aaatatatgttctttctacatcacccctctttctactaaaaataatctcagtaagattattattattattattatkbkbgagacagagttccactgcactctagcctgggtgacagagtgagaccctgtctcaaaaaaaaaaagam

SEQ ID NO: 9740 - DNA, 61 bp, Homo sapiens
agtggagggacagcttatagaaagttgagatggtcctaatgtaggtaaatagaaatctcar

SEQ ID NO: 9741 - DNA, 57 bp, Homo sapiens
ttttgtttgagatggagttcactgttgcccaggctggggtgcaatggtgtgatcttg

SEQ ID NO: 9742 - DNA, 108 bp, Homo sapiens
agccakctttcaattgtgttcgcagccgccgccgcgccgccgtcgctctccaacgccagcgccgcctctcgctcgccgagctccarccgragagaaggggggtaagtr

SEQ ID NO: 9743 - DNA, 146 bp, Homo sapiens
  misc_feature 80: n=a, g, c or t
aaaaatcaatgactkaagagtagctttctcccagcctccccgctggctctggagtatagagggaagccagccttttcvtnccccatcctgcccctcccctctcttctcatcttcccctccactctcctcctgaccctggcctggcc

SEQ ID NO: 9744 - DNA, 337 bp, Homo sapiens
  misc_feature 108..110: n=a, g, c or t
ataaaaaatgttatattaggttggtgcaaaagtaattgtgttttatttatttatttatttattattttttcctttgagacagagttttgttctggagtghagcgmwvnnntctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaaw

SEQ ID NO: 9745 - DNA, 78 bp, Homo sapiens
tttcctttatgccattttttgtttttgttatttgcaaaagatcttgtattcctttttttttttttttttttttttttw

SEQ ID NO: 9746 - DNA, 60 bp, Homo sapiens
ttwayyaktttcattytgtcawggtytatayatktacattctgtacattyacattctgty

SEQ ID NO: 9747 - DNA, 415 bp, Homo sapiens
  misc_feature 296..299: n=a, g, c or t
atccgcaccggctaccgccccacggggcacgagtggcgctactacttcttcagcctctttcagaaacacaacgaggtggtcaacgtctggacccatttactggcagccctggccgtcctcttgcgattctgggcctttgccgaggctgaggccttgccatgggcgtctacccactccctgcctctgctcctcttcatcctgtcgtcaatcacttacctcamctgsagscttctkggcccacstgckgcagtccaagtcagagctctcccactacaccttctactttgtggactaannnngcgtgasgtttaccaatatggcagtgctttggctcatttcttctacagctctgaccaggcctggtatgaccggttctggcttttcttcttgccagcagctgccttctgtggctggt

SEQ ID NO: 9748 - DNA, 501 bp, Homo sapiens
gtatttaawataggaagaaaaatcacagcttcaattaggaatatccttggtaaagcagtamaaatgaatcgtgaccccactttttagtaccctatgttatgaaacacgcaaagcacttctgctgcatacacaagcatgatggctgctgcaggaaaagcacttgagctacaagctgaactagctgttctttctatagaacaaactatggttaattcagacatgggtactaagttttttaaaaatgaagttaagtctgttccttgaagtaaaagaacagtatttgggttttttgttttgagacagggtcttgctctgttgcccagatttgagtgctgtggtgcaatcactgctcactgcagcctcaatctccaggactcaagtgatcctctagcctcagcctcccaagtaggattgagctgctccataaaagtcaaccaaagcaacacattccaagagtggagacagatgcaggtatgagaatccagctgtgttctattaagc

SEQ ID NO: 9749 - DNA, 406 bp, Homo sapiens
  misc_feature 197: n=a, g, c or t
agttctagaggctgggaagtccgggattgaggggccagcatctaccaagggccttcttgttacttcatcccatgatggaaggtggaagggtaaagagaggagaagaagcagtaccgggaatcttacatcagtgacaacctggacctcgacatggaccagctggaaaaacggtcgcgggccagcgggagcagtgcggngcagcatgaaacacaagcgcctggtsccgkccatycaacsgcmakccacagcagttcccacacctcgggcattgaggcagacaccaagccccgggacacggggccggaagacagctactccagcagtgcsatscaccgcaagctgaaaacctgcagctcaatgaccagtcatggcagctcccacacctcaggggtggagartggcggca

SEQ ID NO: 9750 - DNA, 109 bp, Homo sapiens
aatttttataaacttttgttctttcttgtaactttttatcagtcagctattccaatgaagcaaaatctgataatatattgcttttatactaaaaaaaaaaaaaaaaaaw

SEQ ID NO: 9751 - DNA, 371 bp, Homo sapiens
accaatagttctaatgaatatagatgcaaagatcctcagccaaagtgaatcctgaagcacattacaaggatatccacaaacaaaactgttagagctaatacctcaatatcacaggatgcccaggatcaacatacaaaaattagttatatttctgtatccttgcaatgaacatttcaaagtgaaatgaagaaaactcatttacagtagtatcaaaaagaataaaatactaataaacaagatgtaagacttacacactgagaactacaaaacatagttgagagaaatttaaaaagacctaaataaataggcattttatgttcacgtattagaagactttgaaaatggcaatactcccccaattaaccaacaga

SEQ ID NO: 9752 - DNA, 103 bp, Homo sapiens
gaggttgagacaagagaatcacttgaacctgagavgcagaggttgcagtgcagcctgggtgacagagggagactccggccccctcccaaaaaaaaaaaaaaaa

SEQ ID NO: 9753 - DNA, 83 bp, Homo sapiens
agaccagaccaacagtwwcaccaagggcargtgggcaggcctccgssctcctcccctactccagggcccactgcagcctcags

SEQ ID NO: 9754 - DNA, 224 bp, Homo sapiens
  misc_feature 112..114: n=a, g, c or t
tttamttatttgttcatcagttgatggacattttggtgttttcacttttrgctatttwtkagtaatactgctgtgaacattcatgtacaagttttttgtrtgaaacatadmnnnttatgtttataaaacatgttttatgtttatgtttttatgttttatgtttatatttctcttgggtacattccacctagaagtggcactgctgggtcatatggtaactttty

SEQ ID NO: 9755 - DNA, 462 bp, Homo sapiens
actgggattaaaggcatgagccaccgcgcccggcctgttagtataagtaccttgcattttaattttcagaagactttccagkagagaaggacacttcttcaaatggactaatcccaaggagctgagttctgaatctgccatgtataccccacacagattctgctgaacagtggaaggaggccaggatgggaagtttgtcaaagggtcacactaaggttcattctgcaacccatctacactcctgagtgttacccaaatgctctggcatcactgttaacattgttaactcatcctctcagaaataaggccttcattttcttttaaaaacaggattagaacctggcaggccatcagtatgtaaatkkgtttaatttagtcagtgattctcaacaaggatagcttcatcccaagggggaactttttggtattacaactgtttgatgctacaagcttttactgagt

SEQ ID NO: 9756 - DNA, 86 bp, Homo sapiens; identical to SEQ ID NO: 9617

SEQ ID NO: 9757 - DNA, 430 bp, Homo sapiens
acagcctgaccaacatggtgaaaccccgtctctactaaaaatacaaaaattagccgtgcgtagtggccggcacctgtagtcccagctacatgggaggctgaggcaggagaattacttgaaccggggaggtggaggttacagtgagccggaatcgccccattgcactccagccttgacctcctgggttccagtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccgtgcctggctgggtatttatattatcattctagtttcagagtatacagaagtttcatc

SEQ ID NO: 9758 - DNA, 477 bp, Homo sapiens
  misc_feature 239,241: n=a, g, c or t
agccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgsaargtcacttatacatctcmaggaaagrttctngngaagaaaaaagkgcttagcaaaaaaatatactcacctctcctgcgataaagtcttctgccagccatggcagagatgcattgagggcacctgtgtttgtaaactaccgtatcagtgcccaaagaatggcagcagtgtgtgcaactaacaggagaagcttcccaacatactgtcaacaaaagagtttggaatgtcttcatccagggacaaagtttttaaataacggaacatgcacagc

SEQ ID NO: 9759 - DNA, 487 bp, Homo sapiens
tagtttttaccaaatggacccttttagagaaagaagcatcaggataaagtcccaatcttcagtggtttgtggaagagagaatctgatgattcatgccctcctaccctgttagaattaggacagggaatggcagaccctaaacatacatgtgaactgagcaaagattgcctttgcttcacctattgacacatttaagaacctcgttttatagagagtacggagtggggtctgagattctacatttcttacaagttcctggtttatgccagttctgtttgtctggtcaccacacttctgaatagcaaggtttcagaggactctatgaagtttttatttctcaaaaatttggcttaggtacatctttacatacagtggtgctagatattattctttcagaacttaaccatgcaacaatgcagaagaatacaaaaaatgcttgcacacagtagtgtattttaatggaactataaaagcattgaactgattc

SEQ ID NO: 9760 - DNA, 130 bp, Homo sapiens
aatacctctagttcttcccgtccgccccagccgcgtctgggccaggagaaaagcaaaaccasattcctgctgctgwcagttttgatgcactgagaaaacttcagagacctaagctttttccagagaagag

SEQ ID NO: 9761 - DNA, 432 bp, Homo sapiens
atgcaacgtgcacgtgcttctactggaacactaactgtcttgatgtcctttctgggatgttctcttttgagactcagcttctatgttatgagaagctcaggccacattgaaaggctatgtgtaggttgtcagtcccaggtgaactcagtttttgagtcatcccagcccaggtgcttgacatgtcartgraaggrgcccccmaratgactcsaktcccaagccatgacatcagcctcagccttagtgacttttgtgatgttgagaaccagagataagccattctcactgcacactgcctgaatccccaacccacagaatctgtgagtttaacacaatggctgttttaagcaacaaagatttgttatgaagtgattgtaactggaacacatccatcctccagaaaagaggcaattgcttccaaatgtttccatc

SEQ ID NO: 9762 - DNA, 483 bp, Homo sapiens
tgcactatagaacaactggacctaatagatatttacagaacatttcatccaacagctgcagaatacatattcttctcctctgcacatggattattctcaaagatagaccatgtgttaggtaacaaaacaagtcataaaatatccamaaahttggaaataatgtcaagaatattctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatataccaaaacctataggatacaatgamagcagtaggagagaaattgtagcaatatgtgcctacatgaaataaaaacmmaaacaaaataacttcaaataaataaaacctgtatcttaaagaaccagaggacaggcaccatagctcatgcct

SEQ ID NO: 9763 - DNA, 323 bp, Homo sapiens
ataaaaaatgttatattaggttggtgcaaaagtaattgtgttttatttatttatttattattttttcctttgagacagagttttgttctggagtgcagcggtgtgatctcagctcactgcaacctccgcctcccaggttcaagtcattctcctgggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaa

SEQ ID NO: 9764 - DNA, 337 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaaw

SEQ ID NO: 9765 - DNA, 126 bp, Homo sapiens
gatccccggcgctcccgcgttcggtgacggccgggtaggctgtaggcagcgcaatgccaagacagagctgctggcggcggcgggcgaatctccctgcaccatgagcctcggctccggccccgttas

SEQ ID NO: 9766 - DNA, 284 bp, Homo sapiens
  misc_feature 10..11: n=a, g, c or t
actctatcgnncaggctggagtgcagtggcgggatctcagacccctgcaacctctgcctcctgggttgaagcaattctcctgtctcagcctccctagtagctgggattacaggcgcccgccacctcgctcggstagtkkttkkatttkaggcagaracggcgtttcaccatgttggccaggctggtctcgaactcctgaggcaagagaatcgctcgaacccaggaggcagaggttgcagtgcggcaagatcacgctactgsastccagcctgggtkrgagagca

SEQ ID NO: 9767 - DNA, 76 bp, Homo sapiens
attttccaaagccatggtgaaacatctctgtgctaatttcttttgttttgtttcctaatttttttttttttttggm

SEQ ID NO: 9768 - DNA, 135 bp, Homo sapiens; identical to SEQ ID NO: 9735

SEQ ID NO: 9769 - DNA, 466 bp, Homo sapiens
attctggggttcgtttagaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaagaccgtcactacataacttcaaaaataatcaaccaccctcccttcccaaaccacccaaattcacccatccctactaaaaatacaaagattggctgggggtggtggcacgcccctgtagtcccagctatttgggaggttgaggcaggagaatcccttgaacctgggaggtggaggttacagtgagctgagatagagccactgaactccagcctgggtgacagagcgagattgtcttaa

SEQ ID NO: 9770 - DNA, 440 bp, Homo sapiens
agaccgctctaaaaccgagatgactagaggttccgtttaaccgattcctgcctgggaagcgtcagaggtggggatctcggggcagcctgcattccagctctacctgggattgtcgccgtgcacatggctggaggagcgtctctccgccactgcgcacattttgcagcctgcaccggccaacgcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttt

SEQ ID NO: 9771 - DNA, 407 bp, Homo sapiens
atgtactgtatgtggagcagtgtacagtgaagcggaggcagagcgggtccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgcgcaaagaaacttcttga

SEQ ID NO: 9772 - DNA, 443 bp, Homo sapiens
  misc_feature 311: n=a, g, c or t
ctgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagatmncatctgtgagtgcttactggagcatgaggagcaagtcttgagggatgcacctatggattccattgaatgggctgaagtggtgatcaatgtgaacaatattctcaaggatatgctgcaggctgctagtcatta

SEQ ID NO: 9773 - DNA, 89 bp, Homo sapiens
actcactttctctgatggttttgaaggcctggtgttcgctgatttcacgtttccttaatttcttctttgtgcctttttttttcccttty

SEQ ID NO: 9774 - DNA, 151 bp, Homo sapiens
aataagaggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaaam

SEQ ID NO: 9775 - DNA, 424 bp, Homo sapiens
  misc_feature 10..11,368,374,377..378: n=a, g, c or t
actctatcgnncaggctggagtgcagtggcgggatctcagacccctgcaacctctgcctcctgggttgaagcaattctcctgtctcagcctccctagtagctgggattacaggcgcccgccacctcgctcggctagtttttttattttagcagatmcggcgtttcaccatgttggccaggctggtctcgaactcctgaggcaagagaatcgctcgaacccaggaggcagaggttgcagtgaggcaagatcacgctactgcactccagcctgggtgagagagcaagactctgtctcaaaaaataataataataataaatgatgaatgrtttatatttkcktcttcttgcttactgatattttctaattnrtkkanvanngtgaataaatgtkgcttctctaaaaattttttttcaataaaattaw

SEQ ID NO: 9776 - DNA, 248 bp, Homo sapiens
  misc_feature 188: n=a, g, c or t
attatctgtactcttcccggggtgggtctaggtctggctcctcctgaggtcggttgtccacctcaggggsargaggscarggggtttyctggggggctgggggtcctgccggccaagggtcgtcaggccggggaggttgaggaggatccgttctaggcggttcagggggccagactccagtttcagmnccacccagccccagccccaggaggaggagsctgtctggatggacgcagcctaactgaccc

SEQ ID NO: 9777 - DNA, 322 bp, Homo sapiens
  misc_feature 86: n=a, g, c or t
aaaatttttttccttccatttttcttaaaaaagaaagaggccgggcgcggtggctcacgcctgtaatcccagcacgttgggaggcngaggcgggcggatcacgaggtcaggagatcgagaccatcctggctaacacggtgaaaccccgtctgtactaaaaatacaaaaaattagccgggcgcagtggcgggcgcctgtagtcccagctactagggaggctgaggcaggagaatggsgtgaacccaggaggcagagcttgcagtgagccgagatcgcgccactgcavtccagcctgggcgacagagcgagactccggctcaaa

SEQ ID NO: 9778 - DNA, 68 bp, Homo sapiens
agagctgtaaccaatctcactgtttccgtacctcacttctgattcctgtacgtcactttacctttttt

SEQ ID NO: 9779 - DNA, 399 bp, Homo sapiens
aacgtcttcttttactcagcaaacacgccttcactcctcctctgttaatgcgtctcccacgaggcatttacgatggctggarggcaaatctcttacccagaggaatgaaagccttcttgaaaatgacctacacatgaaaaagtaaattattggatccaggcaaacattacacgcagacaagaaaagtgtaatttctttgcagtaatataggattttttgtgcagattcatctaaaagcctgtctaagtgactaaaagtaaaaggaattctgcacaagtgatatggtagaaagcaggtaaaaaacacagccacaacaaccctgatgctctggttatgttttcgctttcggcttgactgacttatgaattgcctgctggatttgtggatgtactggatatg

SEQ ID NO: 9780 - DNA, 542 bp, Homo sapiens
  misc_feature 464: n=a, g, c or t
attctggggttcgtttagaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaagaccgtcactacataacttcaaaaataatcaaccaccctcccttcccaaaccacccaaattcactcatccagcgtttacttttaaatccactcagaacttttttctgcgacccccctccctaaatggagttgggttggggggaaatgaatactgagttggcctttattttttaaaagactttttgatccaatkaggccccctaaataattgagttttgggtcctggttggttvgnttattttttttcctccaaaattttaccccctcccccctgagcccgaggtgctgacgtcgcaaaaaaaaaaaaaaaaag

SEQ ID NO: 9781 - DNA, 153 bp, Homo sapiens
actctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagc

SEQ ID NO: 9782 - DNA, 431 bp, Homo sapiens
gaaagctctacaagatggcggcggtcggggccgaggcgcgaggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctac

SEQ ID NO: 9783 - DNA, 353 bp, Homo sapiens
cagggatggccagcaaaggggcacaaggaatcttttagagttgataaaaatgttctgtatttttattgtgttggtggtttcatgggtgcacacactgtcaaaatgaacactgaatagatacaattattgtatgtaaataatatcttgctaaagttgattttttaaaatacagaagatagatccatatctgaatatagttcatgtttaaagatcagatcattttattaattgaaatcatttcaagttatagagaagtatataccaatattttatttcttgtaattgcttcattgcaactttaaaatacatcatcactcttagaccatcatagtaagtacaggaaaaaaaaaaas

SEQ ID NO: 9784 - DNA, 346 bp, Homo sapiens
gtgagagtcatcagaaacaacagcaaaatcagcttgtaaaaacttttgatattggatgatcaattatagatttattttataaatatatagaatgtatttaacattgaaagtataaacaggagaatataaaaactgacaaagtagatctgaacaattagaataactaaaaattaaaaattttaattgaaataaaaaatcaaagggactagttagcatattaaaaacagatgaaaatttaacagtaggctgtcatgaccaaaaaaaaargagagagagagrgagaaaatcagtccagtcacggtggcatatccctgtaatcccagcactttgggaggccgaggcaggt

SEQ ID NO: 9785 - DNA, 435 bp, Homo sapiens
agtggattcatcaccatgtgtgggggcagaaactacttccactcttaccttccatactgcataactgccagatagacaacttctgcctcacacttaaggccccaaaggaacaagaataaaagcaatacttagattatcaggaactacaatgccaatgaaggaatgacaaccatcattgttgtcaacaacatgtcaacaacatcaacaaatagaaagcattcctccattcatcactccttctgggaagaagtagactaagaggtaagaagcaactaatttttcatgggatttgaaactaagtaggtgaatctgaagtctgcgctgcttccattccatcccattgtctcttctgagggagaaagcttctaagggagaaagcctttggggcttggaacaaaagaagccagattctttagagtacacactccgtacttc

SEQ ID NO: 9786 - DNA, 380 bp, Homo sapiens
ctccaatcgccagccctccaaccgcctgccctccaatcgccagccctcctggcttccatctcctcccagctacctgcagtgccaccaggtttatcaccttagagcatccacagccacagttacccagagagaagagaaggaggagacacagggcttggggacgaaggcattcaaacaggcaggtcctcccacgggaatcccgtgacggccgactccacgaccacttccccagcatgactagatttcctgcagcttcgaaatgcaaacattgcctcagacaaaagctaaaattgttacagtcagaaccgaaaccacgagtgagaaggggctctgctcccagtacccacagccacggggagccaccgaccagcacgtcttac

SEQ ID NO: 9787 - DNA, 362 bp, Homo sapiens
aaggagaactgaggcaaaactaacaggcagcagcgactgcccgctcatagctgccagagatactatcctgcaggtttttttcagaggtaagaacaggaaagacgagagaacacgagaaaaccagcaattaaacggcaagcaaaggaataaccaccaagcaatgagtgatccaacagagatttatgtagaaggatgctaattgcaacaataagtgttacatttaaaagagaaaaactggaaacaactctaggatccaacaatggagaaaatggttaaataatgcattattccagttggagatataaagcagagaaccatcattctcaaaactgttctgagagtcagcatgtcacctctttcam

SEQ ID NO: 9788 - DNA, 500 bp, Homo sapiens
  misc_feature 159..161: n=a, g, c or t
catacagattaatttaatataaatwtttttttattatactttaagttttagggtacatgtgcacattgtgcaggttagttacatatgtatacatgtgccatgctggtgcgctgcaccactaactcgtcatctagcattaggtatatmtcccaatgctannnactmcmccctccccccaccccaccacagtccacagagggtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcatttttgatggctgcatagtattccatggtgtatatgtgccatattttcttaatccagtctatcattgttggacatttgggttggttccaagtctttgctattgtgaacagtgccgcaataaacatacgtgtgcatgtgtcaaaaa

SEQ ID NO: 9789 - DNA, 429 bp, Homo sapiens
aaaatcttcggagtttgttcagtctatgggtgactgttggaaccctaaaataacttaaagtagaatttggtcatttattgtttttttttattaaaaggtccaactgagaacatccctgaacatctgaaccagaaatttgacatagagctctaaatattcactcattcattcatgcaacaaatatttatttatcaagcacgtcaaccatccaaggactgttctaggtacacatagttgatgtgatgaagtcagcaaatctgccttcacatggtctgcattctagtggagaagtcagatagaggatgtttggagcatgccagctagaaagaaggcaaacaagaaggacacaacaatagcaagtggaaagttctagaggagcatcctgcattggcgatacgcactgaggatctggcaaggtagacagtgggc

SEQ ID NO: 9790 - DNA, 375 bp, Homo sapiens
agttgcttgtgtcgagggagggagggagggaacagagggtgcgcgtgtgaaagctccgcccccagccctagctcctccttcccgcttcagcaggtccaggctctgcgccagtgcatccttctccaagagtgcgctgcctgggcccgcttgccctggagttaacttcagcagtcaacggagagaagagtggaaaccttactggatgcggacaggagagccagttactgaaagcagatataacgcggatcctgtaaagagtgaaaggagaagaccacttttagttgcctccctgctagcaccctgacttgctctgcttgaataagaatccaaggacacaagctaagacatttgcactgggkttagatctactgcgat

SEQ ID NO: 9791 - DNA, 425 bp, Homo sapiens
gaccgtgatggatgtcgtcgaatattttactgaggctggattcccggagcaggcgacagctttccaagagcaggaaattgatgggcaatctttgctgctcatgcagcgcacagatgtgctcaccggcctgtccatccgcctcgggccagccctgaaaatctacgagcaccacatcaaggtgcttcagcaaggccactttgaggatgatgaccccgatggcttcttaggctgagcgcccagcctcacccctgccccagcccattccggcccccatctcacccaagatcccccagagtccaggagctggacggggacaccctcagccctcataacagattccaaggagagggcacctcttgtccttatctttgccccttgtgtctgtctcasacacatctgctcctcagcacgtcggtgtggggagg

SEQ ID NO: 9792 - DNA, 299 bp, Homo sapiens
acaaggataatttagggatttataaagttgtaaggatttcactgttttcggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgkgc

SEQ ID NO: 9793 - DNA, 356 bp, Homo sapiens
agctctccataaaatagaccaatcagcaggatgtgggtggggtcagataagggaatagaagcagactgcccaagtcagcagaacactttgctctggtacggttctgcggtgtggaagttttgtttttttgatctttgtaataaatcttgctggtgctagttctttgggtttgcactgcctttatgagttgtaacagccaccgcgaaggtctgcagcttcactcttgaagccagcaagaccacaaacccaccagaaggaagaaactccgaacacgtcggaacatcagaaggaacaaactgtggacacactaactttaagaactgtaacactcacggcgagggtccccggcttcattc

SEQ ID NO: 9794 - DNA, 456 bp, Homo sapiens
aaaaacctagatggtatagcctaccacacacataggctatatggtattgtatagcctatagactgcttccaggccgcaaacctgtatagcatgttactgcattgaatactgtaagcaactgtaacacaatgaggcacggaagcgcatccgtggaaatccatcccttccgacttccttacacctatacaaaagcctgcatttgatgcccaggactccagatcagtacattctgtgacaactaaggcacagtggaacaagaagggcccaaccacataaagctccaggagagtaggaattagtcttgctctcaaggacattcctggcacccagcagaatacctagcctagtaggcaacaaatgaatactggatgaataaatctatgaatccatcaagaagcaagcttgagaatgaggccaaaacacagaggaaggcaaaagagcaatgaagctgagcaa

SEQ ID NO: 9795 - DNA, 385 bp, Homo sapiens
  misc_feature 302..304: n=a, g, c or t
aattttttttttgacggagtctcgctgtgtcaccaggctggagtgcagtggagcgatcttggctcactccgcctcccagcaggggcggggtttcaccatgttagccaggatggtgtccatctcttgacctcgtgatccgcctgcctgcgcctcccaaagagctgggattacaggcctgagccaccgcgcccggccgtacagtttgtattctaacaccaactcataagggaataaaccagggttacaagtgttgctgcctcaccatggacatcccacaggacaatccactgaacaaataaaannnwtgtgtagatccaggatacttttcacttcctaaacataaatcccaccacatctgttcaaccagctctgctccaggataaaa

SEQ ID NO: 9796 - DNA, 374 bp, Homo sapiens
aatttaggaccctctcaccactaggttaggattaaactccgcatctttcacttcgaagtgaagagaaggaatcccggaggtacaaagtattttcagcaggcgctttgctcggtgcactcctctagatagctcaacgaggagccagccccgtggctcaagcacctgctggcttgcccaggtgctgctcgccacgagtctgttcgccttgtcctcacgcccctgtccacagatggatggagttaccgaacggcctccacgccgcgcttcacttatccccgctcacagcccatcttcgggctgttcataatgttctgacacttttatgagtyccttgctctctgccaggacaggcggtccctcgaaatgtgcagtga

SEQ ID NO: 9797 - DNA, 446 bp, Homo sapiens
ascaggtgctgcgcatgcggacagcggatcgcaaggggaaaagaccccggamatcatatgaagtgtgcgtatggtacctattggagctatcttgagcccatataaagmgtaagctttagaatgacggcgactcacagagaaagctaagamtcatcagamaatgaaaatcgatgtctctgaagtctctcttcagccaggaggcttttcctattgaagcactctggggcacattgatttctcctatgttttaacttcaaacatggcatcatctgaaacctatattttgattatgggtttgtctgcaaggtttttttcaaattggcacaaatttccaaaaaggtttctgaaatatttattgaaaaaaaatccacatatcattggagccacaccaatcaaacctgtgttgttcaagggtcaactgtattcyctaaagtctcaattcatga

SEQ ID NO: 9798 - DNA, 375 bp, Homo sapiens
  misc_feature 103: n=a, g, c or t
gaaagatggggacaggccaaagaaaaaagtgactttcaactcttcttccatcatttttatcatcaccagtgatgaatcactgkcagttggamsgacrgcgacnaaamccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattattttaattcaacgggtgctttacataatgaaaaaaccacttgt

SEQ ID NO: 9799 - DNA, 425 bp, Homo sapiens
cagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgt

SEQ ID NO: 9800 - DNA, 405 bp, Homo sapiens
gaaaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctccaaaaaaaaaaaaaaaaagg

SEQ ID NO: 9801 - DNA, 462 bp, Homo sapiens
tattatattaagttccatttgtaactggttctgtatggtgactggcgaattggagtgcttctttctccagcccaatcagggcatggagtatgagaaggaggcattaataaggttacacaattagaatgagagctgttctgttcggtcacttgaactcactttgtccctgctgaatgtaaaaggctaagttctattcaatttaatttatttgcttgaacctgacagctgtctttcagtttttattgtattcccctttaggctggtcaatttctgacaaatgagaaaaaatatgttaatcactgagtgtttgattattggatgatttgtgtattttagttattgtctagatttggacttgaagataaaatgacctggtaaatttcatgaaaaagaacaaattggaaaaaacctctttccctgtttacatctcaatatatcatttcctataatgcttctgtaatc

SEQ ID NO: 9802 - DNA, 91 bp, Homo sapiens
aattctcttgcctcagcctcccgagtagctgggactacaggcacccgccacctcgcccggctaatttattttggcattttttttttttttw

SEQ ID NO: 9803 - DNA, 236 bp, Homo sapiens
acatttgagtccctgtggaccaaccggaacacaacttaataggcaaacatgattgaaacctaacttaggactaagttagttaagtcttggccaatcccagcagcagtacgtcaaccactcatacactgctgtgagtgttcaaactgtgttcaagtaaggcaaacaccaacctataaccaatccagccgttttgtacctcacttccaatttctgtacgtcactttccgttttttttk

SEQ ID NO: 9804 - DNA, 254 bp, Homo sapiens
  misc_feature 122: n=a, g, c or t
acattagggggagcatcacagcagataaagctagagtttttgcaggagacagaaggaaatggaaaggggagtctgatccctgaggtggactatcaagatatggtgaggaggcaggaggsddnattgagtatattgacattggaccgatacttctgagactggagagaaatgaaaaaaaatctactcatctggatgcataaatcaattaatgttatctgttaaatctattaaattaattaattgttttctattaa

SEQ ID NO: 9805 - DNA, 351 bp, Homo sapiens
  misc_feature 118: n=a, g, c or t
aaaataaggccgggtgcagtggctcacgcctgtaatcccagcactttgggaggctaaggcgggcggatcacgaggtcaggagatccagaccatcctggctaacagggtgaaactccanctctactaaaaatacaaaaaattagctgggtgtggtggccggtgcctgcagtcccagctactcgagaggctgaggcaggagaatggtgtgaacccaggaggtggagcttgcagtgagccgagattgcgccactgcactccagcctgggcgacagagcgagactccgtctcaaaaaaagaaagaacacaaataaaaaaccggsctcctattttgtgtacacagtccctgtacar

SEQ ID NO: 9806 - DNA, 425 bp, Homo sapiens
atcctatcaaaagttacggtgaagtcagggtgggtggcgagtccctgcaaggtcgcccctctgtgccaacacagcctgatggcttcttgtttcaggaaacatccagaattacaactgaccattgagttattacatatcaattgaacaaggtagttttaaaatgaaagaaaatcttgcaacatgaataaagagatagactctttgaatctggcatacagctttcccttccttcttcctgctttcctggacacaccgtggacagacccatttccctctggattcatggtaaggtcccgagtgcttctgatacagctgctgagcagaccccgctcatctcaggagtcccgaggacactcgcttccctgcagcccgtccgccctccataagcctgggggcatctgscctgcagcactggggaggagcas

SEQ ID NO: 9807 - DNA, 68 bp, Homo sapiens
attcagataaggatgttgaagataatgacactaaatctatggacacacacacacacacacacacacas

SEQ ID NO: 9808 - DNA, 394 bp, Homo sapiens
  misc_feature 348: n=a, g, c or t
aaaaggaacaggcagaaaggagaaagaaggtatctaaagtaaatggccttatgtataatcctgaattataagtcattgcaaaagaatcaggcttgtgggctacttctctgacagagccaaactctccaattcaattattctgagcaaaacaaacaaggagggggaccctcttacggattaaagacctctttgtgatatgactggcccaattcaattgcctaagcatcacgtagaaacaatagttcaatacttcaaaggaaagtttcagaaaggtgatgaaaktkaagctgggctttaaaggctacatcaaatttgacaaatggaattgtgaggraaagcacatagaangtaaagagtgaacccacaaaaacaagagavcatcatgtttctagag

SEQ ID NO: 9809 - DNA, 463 bp, Homo sapiens
tgttactcataatttttaaactcatatattcagactttctgtcaatgtccagtattaacaaacttttcctgttttccatccaacaaaaataaaaatcttactgtgccttttctttctcttgttttcagactatgggggattgccatcctagatagctatgattatattttcacaaccaacacctatataaatggggcaatatgttttcctggtttctttcctcactactgttttttctatctattttcttttttaaaaatatatattttattggccaggcgcggtggctcacgtctgtaatcccagcactttgggaggccaaggcgaacacatcatgaggtcaggagatcgagatcatcctggctaacacagtgaaaccccatctctgctaaaatgcaaaaaattagccaggtgtggtggcgggtgctgtggtcccagctactcgggargctaaagtaggaga

SEQ ID NO: 9810 - DNA, 368 bp, Homo sapiens
aactgcaagctccgcctcccgggtttacgccatwctcctgcctcagcctcccgaggcaggagactagagtagctgggactacaggcgscccgcacccaagcccggctaattttttgtgtttctagtagagacgggatttcaccatggtctggatctcctgacctcgtgatccgcccgcctcggcctcccaaagtgctgagattacaggcgtgasaccgcgcctgcccaggagaaacttaarhstatagtttgtagtttaaacaaagatggtaacagccttttcccaaagcagacctccttctcgcctggagactatattgcctttgtaggactaacagtagccacaagattggaaattatggtttaag

SEQ ID NO: 9811 - DNA, 62 bp, Homo sapiens
atttccaaagccatggtgaaacatctctgtgctaatttcttttgttttgtttcctaattttt

SEQ ID NO: 9812 - DNA, 502 bp, Homo sapiens
tttgtagatttggcccgagaaagtgcctggattttacaacaggaagatacagatcgaccttccatatcaagtaatcggccctgggggctggtatccctattgctacaatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtc

SEQ ID NO: 9813 - DNA, 500 bp, Homo sapiens
atgccctcaggatgtaatacaagatggaggcttgatttcacaaccaaaactttccagagaatatagtgatagatgttggaggtccctagtctagcacaacatcttctaaaagaaaatgaaacttttaaaagttaactaccaacagggtagagagaaaagaaaagaaacagtttaaaaatacctgaggaagagcctctcattcctatgcaactgattcgtccaccatggagattagttcaattattgtccaatggagtagaaccccttggctggggtaggggaaggagaagaccgcaagctggctctgcgaagacccttgagccacgcgtcccagccccagcatgaagcagtgatggaaggaaaatgtctgggaagccccggtggaatgcaacaggaagatagcaacagcatctatctcaaagtgtgtccggaattggtgggttcttggtctcactgacttcaagaatgaagctgcggaccctcgcagtgagtgtcacagt

SEQ ID NO: 9814 - DNA, 500 bp, Homo sapiens
agaaacatcttgctctagaaatggaagaggcatagggcctacagagaattacataacaatgtcaaaattgtttaaagggcacccttgaacttctatatggtctccaaagacatgataaatacagagattgctctctcctctcaactgcaacagtaatgattscytttgcattttaattaagtcttttacacatgaataagtctttatcctcaaatggactaaagactcctcgaggacaagaactatccttcagtcccatacattggttacctggcaaaggaccctaaatgcagtctttctttattacacaggctggactcaaactcctgggctcaagtgatcctcccaccctatgctcagcctccaagtagctggtactataggtgtgcaccactgcacccaacaaaaaccttaatagaaaggaaatgagccatgactactgaaaattaagactagctattatccacaagaggtgctcgctgcctctttgcagaagtgat

SEQ ID NO: 9815 - DNA, 416 bp, Homo sapiens
agaacattccattccttgcactaatctcttgagtttgactgcccatcgggagctttgctctcaggtggatttctgagaagagaaagccaccatttgcttgctataccctggggccaaccagctgccaagtgccagctgaacagaggtgtatcaagaggcctgcagtcaaaaggcagcaggatggccaattgccatcaatttctgcagcaagtctggcatcatggcatcttggcatcttgctgctctccccctcccccagatgccactgtggttggatggcatcccaggaaagatgtgaagtgctactgccaggaatgaatgattggcattgggtaaagcaattctctgaactcagccttggcataccattaattgttaagtctgttctgctaccaccaacctcttgtcagaatcat

SEQ ID NO: 9816 - DNA, 370 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggs

SEQ ID NO: 9817 - DNA, 471 bp, Homo sapiens
tgttgtagccatggagacctcagatttggttgaaataaatagacaaaattaaaacctgcacaaaaagttggtatcagaacaaacaatattgacagtttatatttcaagagtattttgtctgaggaaatcaatcattctacagacatgacctcattctgatctctcaggtagcaaaaggacagtcctgccttcctctaagatcctcaaaggactcatggtgacgaccaggctgtaagatccacaagagtagagacaattgctggccatgcttatcactgtggacccaaagcctgaagtagcatctggttcattaaacacatgatgaatatatgttgaataactaaatgaatgaaaacaccgttcttcaagctcccactaacaccttaccactctctaccatgtcaacttattttattataacaattgctcatcattaaaccgtatggtcctggaagaaaaagactgttttta

SEQ ID NO: 9818 - DNA, 400 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgac

SEQ ID NO: 9819 - DNA, 472 bp, Homo sapiens
tttggcagagaaacttagaagagggcatttctgttaaagaatctcctcatacttacgtagcttaaattcactttgcttttcaattggtgtatttataaggcacttgtcttccaaaagtagatttgtatttcgatgataatggcaatagtgctttctttgtagaacctatctgtgtgatcttggccaaatcagactgggtgaaacatagagcacacatttgcttcttctgaatggtgcttcatctcagtggctgagccacgtggatggcattcagaaataacagttgtgcttccacacagcggtgagccaatccccagtgattctaaaggctgaatgttctggttctgcaaccaaatgaatacaattatagatacttagccgaccctgactaggtttcattctttcattaattaacacatgtattataggcacttatttgggcactgcagagctgctgtagattatctaaagk

SEQ ID NO: 9820 - DNA, 482 bp, Homo sapiens
tymwkgraratccycwactttccaatcgtgggctggtgatgttgacctccttagcaaatgtaggctaggcagtctaatttttagccatattgtggaacaccagggtttcatttgtatttcctgtttggttaaactcatagttttgtccttcccttaattaaattattcttttctatagggtaaaaccttcttcccaaagtcacccagaagcttctgaaagatgtttggaacctgagggtgacttttcaatgaatgagccgatcacaccaaactcctgtaactttaaaaattctgcwattcyccygrgawatmyggcmaatttaaatggtatataattacagtgcccawagtgtagactggcagtccttttcctgtgtcctctgaagtgcttgtctgatgtttcgctgaaagacatgaaagwgtagtcatgccttcagcaataaatatttgcttcacttattgtaaagaaaaaaaaaaaaaaw

SEQ ID NO: 9821 - DNA, 441 bp, Homo sapiens
aattcagatttaatccttgagtgaaatgagtcactggctcatccagttaagatcatcacccactttcctaacaaaacttctcttcaaagaaggactcgctcatccatcaggtggacctccacaggaacaaatcatatccatgtcaggcggcaccaaacctaaatctgcttctgcctcagcagacaggacatgttgagtttggccagtgagtgctgcaggatactggagggaggacaacagagaggaaggtcacctacatgtctatgttcagaagctgccttgatgccacatgcgggaggctggaaacgsytgaaggttgmcmastgctcagcagcagtctaccagtgatggatgagagttggtgcacaaataccccagctcccttgcctctcagtttggataatcctgaaaaggtgtgtactatgctatttctgagattaa

SEQ ID NO: 9822 - DNA, 444 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaargtcaggktacccacaargggaaggcccatcrgactarcagcagatctctcggsagaaaccctacaagctagaaaagagtaagggccaatactcaatgttcttaaagaaaagaattttcaacctagaatttcatatccagccaaactaagcttcataagcga

SEQ ID NO: 9823 - DNA, 237 bp, Homo sapiens
aaagttctccaagtcctcactggacccagcagcgcaaccggcttcacctctcgcagtccaggcgggactttgcggcacctgtcccaggcactcctgcttcccagagggagggcttcccagccaatcaagaggaagagaggagaagctagtaacmsaaaggagacsmgmcatcgtggscaacgacamcgcgaagasggaagggcggtccatgcacgaggacccagcgtccaatcaagc

SEQ ID NO: 9824 - DNA, 79 bp, Homo sapiens
tgcaacgagaagatggccatctgtaaaccataaagtgagccctcaccagacaccggatctgtcagcaccttgatcttgg

SEQ ID NO: 9825 - DNA, 452 bp, Homo sapiens
tgacaaaaagatgatgctaatacataaagagtttttacaaattaaaaataaaccagagtagttccattccaaaaatggagaaagacaataaatagacagttcaagaaataacacatataaatgtcagttaagtatataaaaatctttaggccgtgcgtggtggctcacgcctgtaatcccgacactcttgagaggccgaggcaggcagattgcttgagtccaggagttccagaccagcctagcagcatggcggaaccccgtctctactaaaaatacaaaaaattaacccaggcgtggtkgcakgtscctggtggtccaaggctactcgggagcctggggtaggagagtcacctgagcccagggggagaggttgcagtgaggcaagatggcaggcaccactgcactccagcatgggtgacagagtgagaccctgtctcaaaaaaaaaaaaaaw

SEQ ID NO: 9826 - DNA, 155 bp, Homo sapiens
attcaaacgatgccaaaggggcggcgcggcascacagccccaccatgagccagcggtcggctccgcccctctatttcccgtccctgtacraccgcggcatctcctcgtccccgctcagcgacttcaacatctggaagaagctcttcgtgccgctg

SEQ ID NO: 9827 - DNA, 438 bp, Homo sapiens
aacacagggagctctaccatcaagtgaggggaatgcccaccatcgctatcatcaccatcaccactacttctgccacggccatcacattcacctctacctccaccatcaccatcactactcaagttggagaaatagaggccaggggaaggggataaagggagggcaaagaaaggtaattccaaaggaacatgagcaccaataatgctttaagatgtgattctgggtgtcatctgtcacatttgtaaaatgagtatattatcacacaatccttcgcaamtgtgscagsahtttcccytaggmaawytgcaamcttgagttttcaggaaaacagtttacatgagaaaaggcaagttctttcccatttcgaatgaagtaccattaaactctgtcacctagtgaaaaataataaaaatacttgcaacttttaaaaaaaaaaar

SEQ ID NO: 9828 - DNA, 463 bp, Homo sapiens
gaatcacaaaccactaggtcagagtagagctatttacaatcgtgctattggcaagccatccgcttattctaaggaatcagccaaaatcctttagagctgtttttgaaactgcttttaggacttagtatgttcttctgatccttttcatctagaaagcctatgtcttggaaacaatttggtttctgaaaataatttttgatcatttgatgttaagtcttgaagtaagcaggtagccggcaattctgaaagggagggacgcatttggattggawtggtcatcaamagccycaagggmhtttcscggttccttggcccaaycyccakgrgctttcccttggtcaagggcatcctcagaaggcataggaagacaagactacatgtctcttckgttcttggatcggtctttgcttcattcatggcacacgcatttcctgaatgtacaaagaaatgctggcttgaacaa

SEQ ID NO: 9829 - DNA, 487 bp, Homo sapiens
  misc_feature 300,310: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaawtgttaaggcagcaaggagaaaaggcmmggttwscccamaangggraacccnwtcagaytaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagat

SEQ ID NO: 9830 - DNA, 479 bp, Homo sapiens
tgcaagagaagccaagacaagaagagggctttatttctgatactagaatcagccttcctcccctttattctctaggggacatttttctttgctgactcatctgttcagaaagaagaccctgctccctatttggtgtacctcaagtctcacttcaacccctgtgtgggcgtcctcatcaaacccagctgggtgctggccccagctcactgctatttaccaaatctgaaagtgatgctgggaaatttcaagagcagagtcagagacggtactgracagrcaattwamccccawtyavaawbssgyccgtyactgggahctacvgtcatagsgccccacaggatgacctcatgctcatcaagctggctaagcctgccatgctcaatcccaaagtccagccccttaccctcgccaccaccaatgtcaggccaggcactgtctgtctacactcaggtttggactggagccaagaaaacagtggc

SEQ ID NO: 9831 - DNA, 79 bp, Homo sapiens; identical to SEQ ID NO: 9824

SEQ ID NO: 9832 - DNA, 426 bp, Homo sapiens
agcagaacttgcagatctattacagatgtaggggtgaggagtgccagggtgactcttgagtgtctggcttgagcagctaggcaaatgatgtggatcaaaaaagcagcaggttgcagggaggacggcagtgttaatcgaaagtcatgttctgtaagttttaggttcgatacgactctgagcggagatgtcaattagtcaaccgaatgtcaggtgtgaagatcggcacagagggcagaaccagagacattcattagagagcaaacaggtagagggcacttaacctataggaaggatgcactcatatagagcgagaaaagggccagaaggagcctaatgagtagagaaagacaggctgaaaaggacatcdgcgaggtcagagaaatacctttagggtgtaattacgcctacgcgagtgggtaaaatgag

SEQ ID NO: 9833 - DNA, 369 bp, Homo sapiens
atttttcaggacttgtattcaatcagattgcactagtacactttcaccaggcattaaaatgttgatatcttatattacttgttggtaaatagccgccccaaaccctcagagtacccccctccagttgtcttgtccacattggccattcccccagaaccctctggatctcatcacaatctaactcctaaaaaggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacag

SEQ ID NO: 9834 - DNA, 500 bp, Homo sapiens
gaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttac

SEQ ID NO: 9835 - DNA, 343 bp, Homo sapiens
ctcatatgacctcagcgattgcatgatagtagtaaactagtctcctggaaataatggatgtaggtgcttctagaatatgttacagaatttcagacttaacctattaatagataaatggatcttgacttaaggtgacaaaatgaaacttttattattgcttaaaaatgctgtgccaatattgtataactagctcctctaatacttttggtattttggatttaataataagaccttaagcattttaaatgtgaacatgttcagggaagtatgctttgatgtaaatgtctcagatctaagttgtaacacaattgaatacttgtggcttattcttggtttaacttag

SEQ ID NO: 9836 - DNA, 497 bp, Homo sapiens
gaggggtgggtacgacccgcgcacgagccggtgccatctgtgggggctttgggccaggggtctccggacagcatgagcgtgggcttcatcggcgctggccagctggcttttgccctggccaagggcttcacagcagcaggcgtcttggctgcccacaagatacatggctagctccccagacatggacctggccacagtttctgctctcaggaagatgggggtgaagttgacaccccacaacaaggagacggtgcagsacagtgatgtgctcttcctggctgtgaagcacacatcatccccttcatcctggatgaaataggcgccgacattgaggacagacacattgtggtgttctgcgcggccggcgtcaccatcagctccattgagaagaagctgtcagcgtttcggccagcccccagggtcatccgctgcatgaccaacactccagtcgtggtgcgggagggggccaccgtgtatgccacaggcacggcacgccc

SEQ ID NO: 9837 - DNA, 72 bp, Homo sapiens
haaaaaaaaaaaaaaaaaaaaaaaaaaaaaaaaaaaaaaaaaaaaaaaaaaaaaaaaaaaaaaaaaaaaaaa

SEQ ID NO: 9838 - DNA, 507 bp, Homo sapiens
  misc_feature 423: n=a, g, c or t
acgcccacccggaactccagctggctcttgctcgcagccccggttcccactcgcacctctccctccacacctcccagcaagctgagggagccggctccggccttggcagcccagaaaggggcagwggwggcgcagagagcgagcgagggctgtgaggrctgccagcacgctgtcatctctcagcaacactcttgcattgtgtagacagtgcagtttcctgtgcatgaagctggggaaggcagccgtgtctgaaccagtccgtccatttccaacgacttcagtcgcaggcctagacggaacgttcagtgtgaggaagcatgtgtgagccagcgaggagacagaacacacagcaaacccgtgccaagtcagcaatgcattttctttagcactttgtacagttgttctgaagtaaaagaactgttnktagaaataraacaaaatattataaaagcttcacaatcaatttgaaacaaaccatggatttaaatgtgcaaataaattttaaaa

SEQ ID NO: 9839 - DNA, 574 bp, Homo sapiens
  misc_feature 531,534,536,538: n=a, g, c or t
aaaatgatttgtttcaatggattttacagaagtcatctgggcttttcaacaaaatagattcctctctccattgacctgaattgccttaactgccaaatgtctgggtctttgcttagtaaaagatagacacagggtgcaattcttctattttgtatccttgttccctttgtcaattgaacgtctagttgggcatttattgctgaagcgcactgaaggcaatttcagctgaaggttattaaaacaccaagtgtgaaaatctggaagaagttaaggtggagaacaagtacgaagggcctaagaggaagaatgcttgtctcatttaaagcaaagtcatgaggctgattggctcctgaagaaaagctgaagggaagggtggaaggaggtaagatgagcaacgtaacgatgaactagaccctggaaggccatgtagaccattcaagagctccacagattggacctagatattaaaacagaatgagatttctgactgtctacaagattttgccttgagttactggaaaaaaatggagnghnanankyatttactgagacagacaaagatgcaggcagactt

SEQ ID NO: 9840 - DNA, 303 bp, Homo sapiens
atwctggcggctgggcacagtggctcaagcctgtaatcccagcactttgggaggccgaggcgggcggatcacgaggtcaggagatccagaccatcctggttaacacggtgaaaccctgtctctgctaaaactacaaaaaattagtcgggcgtmgtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaaaaaaaaaaar

SEQ ID NO: 9841 - DNA, 78 bp, Homo sapiens
aatcgcccatttccaaagccatgaaaaacatctctgtgctaatttcttttgttttgtttcctaatttttttttttttg

SEQ ID NO: 9842 - DNA, 415 bp, Homo sapiens
aatcacagcactttgggaggccgaagtgggcggatcccctgaggtcggagttcgagaccagcctgaccaacatgtagaaacccccgtctctactaaaaataaaaaaattagccgtgggctgggcgcggtggctcacgcctgtaatcctagcactttgggaggccgaggcgggtggatcataaggtcaggagttcaagaccagcctggccaagatgatgaaacctcgtctctactaaaaatacaaaaaaattagccgggcttggtggttggcacctgtatgtaatcccagccactcgggaggctgaggcagagaattggttgaacccgggaggcggagattgcagtgagccgagatcgcgcccctgcactccagcctgggcgacagagcgagactcgtctcaaaaaaaaaaaaaaa

SEQ ID NO: 9843 - DNA, 214 bp, Homo sapiens
tctttgtgtggtgcccagataggggagcggaggtggcggcggcggcggtagggtggccttggttgtcttccagtctcctcggctcgccctttagccggcaccgctccccttccctcccccttcctctcttccttccttccctccccttccctaaaaaaaaaaaaaaaaaaaaaaaaaaaaaaaaaaaaaaaaaaaaaaaaaaaaaaaaaaaaaa

SEQ ID NO: 9844 - DNA, 529 bp, Homo sapiens
atatttgtctgtcctagttctaccctctgtggttaaactagcaagctataatcatttttccatatggaagtactttttctatttgaagagttttcaaatctctttggataatcttatcccagatccttcaactatttctcttgattttgagaacttcaccgtcttgatcactttctgtggaaaagctctgcttactgaacaactctgaatgagggaaacttaatcgacagcaacactactcttgtactttgggacttttattagataaagtaactgttccttgaacacaagcactgccataccagaaagtcgatgtgatcgcagaaagggcggctaagtgactcacaggtgaaaagctgttacagcgtggatctgctggacaaagggaagattcatgtcctgagagggacggaacctgacggcccaagatttcatcacactactcagaactgcagtcagacttcttgggagcgtaacaaaagaagactaagaatttgtcactagttgactgtactacaggaaatactaa

SEQ ID NO: 9845 - DNA, 71 bp, Homo sapiens
atttccaaagccatggtgaaacatctctttgctaatttcttttgttttgtttcctaatttttttttttttk

SEQ ID NO: 9846 - DNA, 424 bp, Homo sapiens
taaagcaccagggacacttcctacctcctcaggttgttgcactgtggctgcataatttaatgtgaagtgaatactcagaatatcagacccaaaaataaattagacagtgaagtaaaaataatttttggcttatgcttggttttctttgatcttaactgtaataataacaagttcaataaataaatgaattacttgcagcagtggcttaagatattcatagaagatgcaatttgttaacaaagtggcaaagagttccaaaagttgtataagtttggtgtttgtaattggagaatttgttgactgtcctttttagtttgtcatttagttaggatttactgagctgattaaccaaattttactaataatttaggaatcttaagggaaatttttttacccaaagatctgctaaagtagaagtataata

SEQ ID NO: 9847 - DNA, 455 bp, Homo sapiens
taatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgag

SEQ ID NO: 9848 - DNA, 339 bp, Homo sapiens
agatgaagggatatgctcaggatcacaaagcaaattattggcagttctataatagaaatcagcaacctaaagtactaaaacttgaggacttcttacaagaatactttcatcaccccccacggaaacaaaaaacacatgcccggctgggcacagtggttcacgcctgtaatcccagcactttggaaggctgaggcgggaggatcacaagtagagatggggtttcactatgacctcatgatccatctgccttggcctcccaaagtgctgggattacaggcatgagccactgtgcctrgccacggaggctacattcttgaaaaaaaaaaaaaaaaaaaaaar

SEQ ID NO: 9849 - DNA, 449 bp, Homo sapiens
tctctagtcagttccatcatgaagcgcagttatcagtgtctcatttcttcatacccttcccaagcccattgataattttcaggaacataacatgttactataggagagcttgggatccagctgactgaatgtttacagatgacttgatgagacccaagaatgtggcccttatgcccgtggaagcttttaattgcctcttttggaaactagttttgattcttcataatcacgtctgtttgaggacacagacgatcaatcttcgatcttcctcatctttctcaccttcctcactgaacacctaagatcattcagaatcaaagataagcacaatatatttatggccttggtgtttaaagtggagctgaagattactgcagatgcctttccagtaaagctaacaaaaaacaaaacaaaataaaaccacatccaaaatactaaacagctgtctc

SEQ ID NO: 9850 - DNA, 117 bp, Homo sapiens
gcaaccctctcaggtcaccttccatgctgtggtggctttgttctttccctctttgcaataaatattgctgctgttcaaaaaaaaaaaaaaaaaaaaaaaaaaaaaaaaaaaaaaaaw

SEQ ID NO: 9851 - DNA, 173 bp, Homo sapiens
  misc_feature 145: n=a, g, c or t
attcggtaaaaagtctagctggcgccattggaatatgggctgctagactcaatttctagttgatgtttgaggtgaggcaaaaataaagctaaagtagaaaacttaaaaaaaaaaaaaaaaaaaaaaaaaaaaaaaaaaaaaaarnvaaaaaaaaaaaaaaaaaaaaaaaaaam

SEQ ID NO: 9852 - DNA, 444 bp, Homo sapiens
  misc_feature 393: n=a, g, c or t
cgagtttcactatcttggccagggtggtcttgaactcctgacctcgtgatccacccacctcagcctccctctcttaatcttttattttattattattattttttaaatttaatagagacagggtctcactatgttgccccagctggtctcaaactcctggactcaagcaatccattctccttggcctcctaaagtgctgggattacaggtgtgagacaccacacctggccccctcctaatcttaaggactgctatgaagctggggtgcctatagtcccagctactcaggaggctgaagcaggaggattgcttgagcccaggagttcagggccagcctgggcaacatagtgaggctccaattctaaaaaaaccccaaacaccaataaacaaaangcgatatgacgaagataatcttgccgggcacagtgactcacgcctgtaatc

SEQ ID NO: 9853 - DNA, 387 bp, Homo sapiens
aatagggttgcaccatcccggaagctgctgttagctcgccggtcctcggcacgccgcccgttcgcccctgcgctgtccgcccttcccctagcgkttacttccggtccctcgctgagggggttcgtgcggctcccaggaggcgtgaaccgcggaccatgagcgtgggcttcatcggggccggccagctggcctatgctctggcgcggggcttcacggccgcaggatcctgtcggctcacaagataatagccagctccccagaaatgaacctgcccacggtgtccgcgctcaggaagatgggtgtraacctgacacgcagcaacaaggagacggtgaagcacagcgacgtcctgtttctggctgtgaagcacatatcatccccttcatc

SEQ ID NO: 9854 - DNA, 396 bp, Homo sapiens
agaatgttcaaagggtgcaaaatgaactacagacaactatccccggcacacaactcctatgttgtcagcactgttatcagcattagcaaactctcacttatgaatgagaacatgcagtgtctggtttcctgttcttcacgggaaattttaaaggaactgtggtgtgtgagacaaacaaataactgctacaacttgttggttgcttattaaatacctgactcaatgctaaatgatcatgtgctattttgttgcatttaatcttcacatcaatcgtacaagggcacagaccaaagcatgtcaggaaatgacaaactttattaaaagacttcttctgggctgaatacatacttattatttaattactggaagaaattatgtatacctatgacatttgag

SEQ ID NO: 9855 - DNA, 92 bp, Homo sapiens
tactcttatttccccttgttgtaactaagtggtgcaggtataagcatatccccagcattcctgtgtgtgtgaatgtgsactgctgatttgga

SEQ ID NO: 9856 - DNA, 439 bp, Homo sapiens
cattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatattattatgtttgtaaaattcattgcmgatcaaggttgctcttctgtgatatatgggatattatgttttaaagaccatcttggaatacaattagagaacttagtattttgatgtactaagacctattttaagtttaatattctactttgcaaaaactttaattaaagatgttatttaaaaaaaaaar

SEQ ID NO: 9857 - DNA, 440 bp, Homo sapiens
  misc_feature 135..137: n=a, g, c or t
ctaatccattattaagaaatagttatttcctcagtttcgcactcagagctctcaacaagctggctccaaagcaggatcacctcccactacttcacaaggcttttgcaacaattaaactggcttatttaccagdcnnnagaatctctatgaaaaatcctgcatttatgagcatggcagcattgtagttaaaacatctcttacatgtctacttgatcagtggtgggcacttgcggaggagaggactaagatagagatgatgatagttcagctatgaaatatccaaataaagggaacaaatgggagcaaaatggcagagtagcctacctatattttgtccctgtctagaacagccgttcccaacctctcgggcaccagggaccagtttcatggragacaattttccacagaaccgggggtgaggatggtttgggtatgattca

SEQ ID NO: 9858 - DNA, 429 bp, Homo sapiens
  misc_feature 324: n=a, g, c or t
agaaaacttgggaagccagggatttccagcgcagagagctggggctgtctgtggggtgagtaggggccagaaagcatagccagcgggacaggagtcctttgaagagacaccattgttgccaaggccacagcggtgcaggtcacaccagccagttacagggatcagagacccaaccccagaatcacattcctcatgacccatgcgttcagaagagcctctgaactccaaggggcaaagcggacagctggcagccctttccctggccagcagaggtggcagttctggtaaaactaagagtggggaggaacatgaacttgctttacngattcccttccattaataaaacagaggaccctacacggggcgcttcataaatgtgctcttgcttaatcaccaacaaaaatctgcaagtwaaacgcaatgaacags

SEQ ID NO: 9859 - DNA, 488 bp, Homo sapiens
  misc_feature 197,349..351: n=a, g, c or t
gacaattgaggaaagaataactaccgtacatttttttcatggtatacataaatctattcataactacagcttctactattaaagtctaaaagattgttggttaatataatatatgatgtagacaatttttgagataacataaaacccagtttttttgtccatttttagtttaccagaatgattccttcattcagttntttaaattcaatgccaaaatcacataagaacatgtagtaggcatggtgcttgccaggctcttgaactaagattagtgtaagattattttatcaaggacgcaatgatctagttcactggttctcaggctttgctgctcgatggaataattktnnntttagggaattaaaaaaatatattggccgggcgcagtcgctcacgcctgtaatcccagcactttgggaggccgaagtgggcagatcacaaggtcaggagatcgagaccatcctggctaacgtggtgaaacccgtctc

SEQ ID NO: 9860 - DNA, 438 bp, Homo sapiens
attccgagcttccggtgcagcaatgagctgacacaaaccgtggcggcctgaagacctggaccttccattttgcctttcaggacccgtgttcacaccagcacttagtttggaggaagcacctggaggagatgcagagtccagatgtgcgccctctgccggaagsctactgcaccaggacgtaggcctggagtggcccttaacgcatttggaaatcagtcttcactaaaaaaacttcctccaaaatgttctttaacagccctttaaaagccattgtttcaaaacagtccaaggtggtgaacaattaatattttcgatttacatgaagactctggagtaggaattacctgagttggaaactcagttctactctattggtatcaggttgcattctgkatcatcattaaaattttcagaaaaactctcaaaaaaaaaaaaaaw

SEQ ID NO: 9861 - DNA, 553 bp, Homo sapiens
ctcatttttctactgctcgtggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacact

SEQ ID NO: 9862 - DNA, 472 bp, Homo sapiens
ttarawyyttgrakyywaccggggaagtragactgttaaataggtaactgcaaggaggtgatatgaatgccatgaccgggatgcacagctctatggccacatacaacagggtgcctacctgtccaaggaggtagtgaagaccgcagagaaaagtcatgtttagtaggactcgcttattacctcttgacagatctgtttttggaagtccctaacaagatgtaattcagttaggtgttgcaggatagcttgtacaaagaattagttacttccaatcacaatcctcaagtcatattccttcttccatactggaaagtataaggaagaggtgataccagccagccggtattaccggtagatatggacactatccctaatggccacaagatggcagtagaatccatcagccagtttcccccacctcaaaaatatttattgaataaagttttaaattgtatgttttaaaaaaaaaaaa

SEQ ID NO: 9863 - DNA, 345 bp, Homo sapiens
tataacatacagatttgaactataattcttcctaattaagacttccaatttggctaagtgcagtggttcatgcctgtaatctcagcactttaggaggctgagcttgagcccaggagtttgagacaagcctaggcaacttagtgagacctcatctctgccmaaaaaaagaaagaacgaaaaagaaaattaggcacgtctgtagtcccagctacctgggaggctaagttcacgggaggatcacgtgagcccaggaggctgatgttgcavhgagctgtgtttgtgccactgcactccagcctgggtgacagaacaagaccttgtctcgaaaaaaaaaaaaaaaaaaaa

SEQ ID NO: 9864 - DNA, 110 bp, Homo sapiens
attctgtctggcaagcgccgcgcgatcctcggttcccgccgcgccgttgccgccgctcctctccctcctcacctccccgcaagctgagggagccggctctggccttggcc

SEQ ID NO: 9865 - DNA, 157 bp, Homo sapiens
cctcattggttagtgcctgccatggcagttggtmmctgttttgcatatcatccctgcccattagagtgaacaatattagcamrggcwctgwgwagghwtaatcttggcctgtttatcgamcgggactatkcatttccctggctacgaggattttaaa

SEQ ID NO: 9866 - DNA, 461 bp, Homo sapiens
agtcctttagagctttatatttaatggaaggttaaaaacaaaaacgggatgggaagctaacctcctccatcggaaaatgtctatcaaaacagagacagctggaccaatgtttcaacgttcctgaacaattcttcagcaactggaggtaatagtgcaaagaagggtgcagtcccagaggctcagctgcgctgacagtgaagttctaacaagcttcccgcggatggcttccattctagtaacaactttggacagcctaaccaacagtatatgttgtcaaactcctggatttttgccagtctctaggttgtccttaagatttcatatatatggaatatcaacacttcatcaatttctcccttgattcccagagagcgaagttttcccaattctatcaaggaatttacttacattgtctttgggactttaaaagtctttgaagagatggggtcctgctggtctca

SEQ ID NO: 9867 - DNA, 475 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaawtaccagaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtratccaactgtctcggcctcccaaggtgctgggattacaggcgtgacactgtgcctagcctgagccascacgccggsctaatttttaaattttttgtagagacagggtctcattatgttgc

SEQ ID NO: 9868 - DNA, 144 bp, Homo sapiens
attcggtaaaaagtctagctggcgccattggaatatgggctgctagactcaatttctagttgatgtttgaggtgaggcaaaaataaagctaaagtagaaaacttaaaaaaaaaaaaaaaaaaaaaaaaaaaaaaaaaaaaaaat

SEQ ID NO: 9869 - DNA, 502 bp, Homo sapiens
  misc_feature 453..455,459: n=a, g, c or t
gtttggatggcaccgggtaaagactgacaccagcattttctctgcaggcctttgaacttttgtgttatttcatatattatatgtgttataaagcacattacaatatatttttctctgtcttctccagtcctaggtgaaatgtgtcatttaaaaaaaatttcacttgccattctaaagtttttctggtgagagttttgtgtttttcatttacgcaaacacatctccacataagtagggaaaaagtcttcttgagtatattagtgtcttcagcctttgtattgggacagtagcgtccattaatttttatgtgaagtgaaattaggtatcgggtcawaatcagtctgtghggtcttcacagctttcacatttaccttgtgataatcaagtgtgtttttcctcaggtgttaaccagagaagaggggtcagggactcttccctggtcgtagctttcannnghcnggtaaggaagactttccggaggctgtacatgactggggtcttg

SEQ ID NO: 9870 - DNA, 356 bp, Homo sapiens
agaagggttaatttcagctagcaaacaagctcagccaggtcctgtatctcatccaccccatcagtaatatctcacatcattccagcaatctcaagaattactccaactgagtcacattctggaaatgtgtttggactattcagcgtggctctcatgatgaccttagtgttctcataattagagatactgaagaccttaccttctctgccatgtgaggatacaggatgaaggtgtcacctgcaagccaggaagaaagtcctcatgaagacctgaccatatggcatcctgatgttgggcttctggcctccaaaatcatgataaataaatttctgctgtctacgaaaaaaaaaaaaaaw

SEQ ID NO: 9871 - DNA, 165 bp, Homo sapiens
atttttctactgctcgtggattacgcgcacgttggaaccgaagagagcwctgttgttgcaatgttcagcccacaagagcttactggtgaaggaatgggacaagacccatctttatgcaaagbyagcgttacagtaatgttccagagcagcttgttgctatatacc

SEQ ID NO: 9872 - DNA, 424 bp, Homo sapiens
aggacacagcagcagaaggctatctgcagccaaagacagaggcctcaggaaaaaccaaacctgatgacacctcagtattggacttctagcctccagagttatatggacccacctctctattttcaagagcattaaattcagttaaaaactaaaaacaaaaatactaccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaattttt

SEQ ID NO: 9873 - DNA, 175 bp, Homo sapiens
  misc_feature 71: n=a, g, c or t
tactttcatttccctcaataattccatactccaaaatatggttacaaatgtttcacaagacagcaagtgmnctgagaatattcatttggtttccaaagcagactgccttggaaaccaaatgaatattctcaggtacttatcgtccgtggaaacccaggaagggaaaagaaaggtg

SEQ ID NO: 9874 - DNA, 500 bp, Homo sapiens
aatacagctgttgcattttccccaccactagccccacttaaactactactactgtctcagagaacagtgtttcctaatgtaaaaagcctttccaaccactgatcagcattggggccatactaagtgtgcttcatgaaacaaacatctggaaaactccaagtataagagaccctggactgatgatggcccagccaagtatatggagggacagagttctctctgtcattaatgaggacatcggttttcacaattgaacctcatgcactgtccacagcatctcacctagctcctgtatctcctgatctgcttttaaaaatagttagttaggctgcctttttacaccaccttctctctctccccttgtggtaattttccagccttccccatagatataaaactagaacacctttatgatttggggtctatgtaatgactgaccgataagaacccaggcagatgctaacatacttaacagctcgcattaaaatactttaaatcag

SEQ ID NO: 9875 - DNA, 452 bp, Homo sapiens
cttctcttctctgctgccgtctgaggtgcgcgtttcaccttccgccgtgattgtgaggcctccccagccacgtggaactttggatctgcctgccgtcaagactcaccacttcccacctgtacactgctgtctgtcctcatttcaagtgaatcaccttgcggtcttcttatgccaggttcagagctcatgccagacgctgtggaaggattgttttttgactctctaatactgtggaagaaaaagagatcttccagatatcagagttctcctgacagctgaagagtgatggatgagctggggtctcaattcatcagaacatcaaggcatgtgagacgtgcctgcctccacttcgccttccaccatgattatgagtttcctgaggcctccccagccatgcttcctgtgcagcctgtggaaccgtgagccaattaaacctcttttctgtataaatt

SEQ ID NO: 9876 - DNA, 365 bp, Homo sapiens
attaagcattgccctggcctaagacaccacatgggtcatttcttccaggctccaacttgcttctgctttgccatatggtaacacgccgtattatggaagcaccatcattaccgccatttgcaggggaagcctaaagagataaatgccagccagcatccctgtctctggggccctggagaggccttcaacacacctggcctcactgccctgtggcttcaacaaagaggccgagcatctcctataaaccttgaggtccatggatgacatagcggaatgatggatttcagaaaagcacactgctgttacgactccagaaccgataaggaagctatgtgtggaagtatgagctcaggtcgccttctgac

SEQ ID NO: 9877 - DNA, 426 bp, Homo sapiens
cgggtcccggcacagccggttccagccagttccaaccagcctccgcctaccctcccccaagtctcgggactcccagcgggggctcacactcaccatttcctggctttcaggtgactcccacgtccaaagcagtcacaacacagacgacagggcgacagaagtatggcggtggcaaccggtccctctcagagcaggaaaaacggggtgccaacctcacccggcgggaggggccaaagactgaggcgaacggcaatgtgacccgcggataaacagttggccgggccccaccccggcgactctgattgggtggagcgccaggccccgccccctgcatcctgagtgacagcagaagtcctgggtaacagggccaagcagagcaggactgaccgcttcaagccacagtccaaggtcaagttccctctctam

SEQ ID NO: 9878 - DNA, 439 bp, Homo sapiens
gcgaagtcaaactgttgctgtttgctgatgatgtaatcatrtacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccacagattcaatgcaattcccaccaaaacaccaccatcattcttcacagaa

SEQ ID NO: 9879 - DNA, 504 bp, Homo sapiens
atttttatttgagaaggcagcagaaagcaattataaaatatgtaagactaggacatatttcacatttcttggatacttctctattttcttttaaaaaactcaggtgctttgggaggctaaggcgggcagaacacttgaggtcaagagaccaggctggcaaacaagccaaaacctcatctctacttaaaaaataccaaaactatccaggtgtgatagtgcatgtccgtagtcccagctactcaggaggctgaggccggaaattcacttgaactcgggacagaggttgcactaagctgagatcatgccacttcactccagcctgggtgacagagcaagactctatctcaaaaaacaacaacaataacaactcaggattcttgctgaagttggggattgcaaaaatgaacacagaagcccagaggtcaagacctagttggaagaaggttcaaaagagcctgaataatgtttgatcaagcatggagtctttgtcactaaataaaccaa

SEQ ID NO: 9880 - DNA, 194 bp, Homo sapiens
atcctggggagaggggtcccagccagcactcgtggtgagaacagagctccctctcgggaccccgttatgctgaccctggcttccacttctaggagaaataaagcatagaaagtcctgttggtggtaagattgcttgctgctttctgtggccaaaacgtaggggttccatctgccagcattttgaaataagtagg

SEQ ID NO: 9881 - DNA, 483 bp, Homo sapiens
actttgaagttagtgagatagttgtctcttgctatagatttttgccacttgtatttcttctgattttcttgtccaggtactcttgatcatttttctctttaaatttttctttttaaaaacttcttcttattattattatttgagataaaagtccactctgtgacccaggctgggagtgcagtgctgcaatcacaactcactgtagccttgacctcccaggctcaagcaatcatcccacttcaacctcctgggtagctgggactacaggcgcgcatcagtttccagctaatttttaaattttttgtagaagcaaggtctcgctatgttgcccttgaactcctgacctcaagtgatcctcctacctcaacctcccaaagtgctggtttactggcatgagcactgcacccagtcgggtttcataattttctaattgatcattaaacaaacattttcataagttaaaaaaaaarraaaaaaaaaaaa

SEQ ID NO: 9882 - DNA, 438 bp, Homo sapiens
  misc_feature 153: n=a, g, c or t
attttccagtctaaggcctgaagggtaagtaggcattaaccaagtgaagggaaggaaggtgtgaacacggagaaaggacataagaagaggagacgcagaagaaattgtatatggagggctgtacaggaagcatgactgggaaggsctcagganacttacaatcatggcaaaagcaggaagaagaaagcgaaatgaaaggtgccacacacttttaaaaaaccagatctcaggaggactcgctattatgagaacagcaagggagaaatccgcccccatgatcccatcacctcctaccaggcctctcctccaacaatggggattacaattcattatggaggaggacacaaatccaaaccatattaccaggctaggctggattttcctttcttattctggcatagcgccatgttcttttttttcaaattaaaaaaatgacat

SEQ ID NO: 9883 - DNA, 581 bp, Homo sapiens
acttttttcctcacgaagaggtctctggtctcccctctctgagcactctgaggtagggttgctgtgtgttttgctcttggtctaattcctttggctaaacatgaataattatattaatgaatggctttggagattcttcttccgtcctttgcatttttccgagatatgtttctggttttggtatctattagaagggtattttggtttctgttttgtgacaatcaagatttatagtacagaaaattagaagtgattatttctatttcaaggttctttctgtggcagccaggtaatcccttgggtgccctgatttactcacttggtttttttctctctcctgggtataagaccaactacataatttacaaagcccagggcaaaataaaaatgcagcctctcattcagaaattatcaagaacttcaagagggtgagagcacagcatcaaatcaagagcagggcacttcttttttattttaatttttccataagtattggggtacaggtggtatttgattacatgagtaagtcyttaaatggtgatttgtgagattttggtgcactcatcactcgagtagtataa

SEQ ID NO: 9884 - DNA, 345 bp, Homo sapiens
  misc_feature 180,325: n=a, g, c or t
aaaatttttttccttccatttttcttaaaaaagaaagaggccgggcgcggtggctcacgcctgtaatcccagcacgttgggaggccgaggcgggcggatcacgaggtcaggagatcgagaccatccctggctaacacggtgaaaccccgtctgtactaaaaatacaaaaaattagccgrncgcagtggcgggcgcctgtagtcccagctactagggaggctgaggcaggagaatggcgtgaacccaggaggcagagcttgcagtgagccgagatcgcgccactgcactccagcctgggcgacagagcgagactccggctcaaaanaaaaaaaaaaaaaaaaaaar

SEQ ID NO: 9885 - DNA, 585 bp, Homo sapiens
  misc_feature 46: n=a, g, c or t
acatttgcatagcccctgggacgtggcgctgcacccaagcctcttntcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggccaccctttccgtagttgtcccaaatggagctggaattggatgctggtgaccaagacctgctggccttcctgctagaggaaagtggagatttggggacggcacccgatgaggccgtgagggccccactggactgggcgctgcgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtaga

SEQ ID NO: 9886 - DNA, 359 bp, Homo sapiens
agtttattgaattaggatataaagaaagaaagtttttttgtacagctaatgtgtttgtgttttaaactaaatgttattaccaagacagtaaaaaagttttaaaaaatttaaaagtttagaaggtaaaaaagttatgttaagctgaggttaattcactattgaaaaaagaaatatttaaaaaataaatttagtgtggcctaagtgtacagtgtttataaaatatacattagtatatagtaatgtcctgggccttgactttcactcaccactcacccagagcaagttccattcatggtaagtgccctaatcagtaatcaggcataccatttttcgtttttgggtttttttttttttttttk

SEQ ID NO: 9887 - DNA, 444 bp, Homo sapiens
aaaaaggaacaaaccgctccgagcccgggtggtgggaccgatcctggagcccagatcaagccaagtccggccaaagctgtgtcgcaaagtaagaatctgaagacaggtccggtgcttaaatgactatkattctaaagagttgaagatgggaacggtggacgcacaaaatctttaccctcggcttaaaacgccttttctggcaaaagtttgtgtatgaaagaaagctgaacaaacacgttgtagcactgtttaagtgaaggcctttccttttagaacactgctttacaatgcctaatcagccggcgctcaggttggtgcattcagagacccgagcgtttgtgttcctaataagtttgctagaatgtcaggtaactgaagcaggttagtttctatcctgscccaaaacacagactgtcactggcaccacaatgttgtggttttttc

SEQ ID NO: 9888 - DNA, 454 bp, Homo sapiens
aaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccata

SEQ ID NO: 9889 - DNA, 461 bp, Homo sapiens
attggtctcctagcaaccaactctactaacttacttttgtccctatcactggagaatgggtttggtgctttgagctgtgtttctacataaaaaagaaggaatcaaagtgatgctgggtaactactgatggtgtgacaatataacatttgaagctgctccaaacaactttgactgtaaaaaaaggccaagagaatacaagaggctctaaccaaggactctgacttcactaagccactgaaacattcctggcactacctacctcctgccttttcgttatgggaggaaaccctattggttaggtcactggtttaaaacacgtcctttaaaattgcagaggaagaaaaggcttggaggtgataaaggaataaataagttcattcccttgattatggtgatggtttcataggcatatgcatatgtccaaactcatcaacttgtatacatcaaatatgtgcaattta

SEQ ID NO: 9890 - DNA, 79 bp, Homo sapiens
tttcatatgcctcttcttacttcacccatgtttgttgttatgtaaataaaggttttctctccgaaaaaaaaaaaaaaar

SEQ ID NO: 9891 - DNA, 439 bp, Homo sapiens
aaagtttgaatatattattagatgtgctgcttagggtttttgatagtttgcttattttttgtttttgkkttttagatttgtttgkggaagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaa

SEQ ID NO: 9892 - DNA, 68 bp, Homo sapiens
agatctctggtttctcttcataacgaataaatctttcgccttttactaaaaaaaaaaaaaaatgsvaa

SEQ ID NO: 9893 - DNA, 482 bp, Homo sapiens
tacataaaatattggctcattactctgtcaaattgctgtaaaatattttaaacagttcatggtcaggcagtgaaatcagactatacttttaatagcattggtctggttgctgatattcaaaggctttccaggtaacctcctcctctaaacttctttggcactgtgacaacttctagccatgaaaattaggagataaaatggcttaactcagttttcctgatttaatgagaaataatgtctgtgataggatctgagaagataaatatgaaagagataattccaggtatctgagttactctcaaggctggtgttaaaggagaaagtgggctgggtgtggtggttcatgcctgtaatcccagtgctttgggatgccaaggtgagaggattgcttggggccaggagttagagaccaccaacctgggcaacgtagcgagaccctgtctctacaaaaaatttaaaaattagctggacatgtggtgcat

SEQ ID NO: 9894 - DNA, 145 bp, Homo sapiens
  misc_feature 114: n=a, g, c or t
agtgacatgtctggcagagcacggtgcctgctgtgtgctgatactgttctgtgtaatggggattcagtgaacaagactaaaaaggwacckgtacttatggcgcttacattttgntggaggaagacagacaaaaattaaggaaata

SEQ ID NO: 9895 - DNA, 379 bp, Homo sapiens
  misc_feature 323: n=a, g, c or t
aacttttataatttatcttattttataatttaagaatatagtacatatcagtwgggtttggttttggtcatcgrgactaaaagctccatcaaaacagaactttgtgttttctgctaacttatttaatgacacaagttttaagagaaccacaattcattgattcacttattcttttccctaattgtgaattttagtgataaatacacctgtactactgaagaaaatattctgacacttcacgtgtgcaaagtatagaactgacagtgtcagtttcagattttgtatgtacgatttctggcttatatatccaatggtgcagattnkgaaatttgtaagaacaaaatttgttaagaaaaacaacttgctctagttttgtgac

SEQ ID NO: 9896 - DNA, 449 bp, Homo sapiens
  misc_feature 236..237: n=a, g, c or t
atcctctggctgctgctgcascagagccctctgcagacctttggccatgctctcattacacttgattgccattgacagcytgrattgkwaagtcaggtgaacaaatagaagctgagggtgaaggacctacagctgtcacctttatctcttctcaacactgccaactgtccccttggatctcbvagacagacaacaagggacatctctggtttctcggtgccccctagaaacctcbnntcatttcaaggcattatgcaaatgagaagctttccttctcttcacctcatctcctgatctgcacaaaagtgactgtaggacccagtgttgtagatgagcatgagagtgtggagcagagtcggcgagcgcaagtcgagcccatcaacctggacagctgtctccgtgctttcaccggtgagbhdgagctaggggaagatgagatgtactactgt

SEQ ID NO: 9897 - DNA, 478 bp, Homo sapiens
  misc_feature 324: n=a, g, c or t
ttggagatagcctcgtagaaatgacaaccacaatgttaatactaacatatgtattacatggcttgtttgttctttcgcttwaatattttcagagcacctacctattataggcactgtcacttctcacaaaactgggacaactaactgtttatccaacatctgctggctaaataaaddcatgatcttcaccttttgggattgttaatttaaaattgttccataagagcaatgcaaagacagagatatttggcagcactgcagctggtgatttatatggctcttcacaaggtgttattttggggtatcaaggtatggatgcttamnmtcagctgcaggaagtaagaaagaagaaaaaaggagtgataaagataaaaaaaaatcaaccttggtccttccaccaagacccattaatttccatatcatcatctgcataagagggaagattcctacatgaccaggttactgcaaggatgtgaat

SEQ ID NO: 9898 - DNA, 414 bp, Homo sapiens
tttttagctcgtatgacttgttttcattcattaataataatttgaaataaaactaaggaaatggaatcttaaaagkctawkamcrgkgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatbbtgacttgtaatcaattatgaatatttcttgatatttaatgtataggacatttatttatactcaataaatatttttcaa

SEQ ID NO: 9899 - DNA, 177 bp, Homo sapiens
agaggaacctgtgacatcacaaggaaagctgcccatgcgactgctgtccctgcccacttggggagaggggcggggcctgcctactccgggagaggggagggctggtttttgctttaaaatgttaaaaataaactttaaaaaaataaaaaaaaaaaaaaaaaaaaaaaaaaaaaaaaw

SEQ ID NO: 9900 - DNA, 245 bp, Homo sapiens
gataagaaacaaaggtcttgttttcatgtaaatgagtttaattatacagcttgctgttgaaaagtctgtggttaaggatacttatagaatccggtttggtttttgtttcaatttctcacttttgcagttatgaatatagacaattaggcatttggttaaatgggaagagagagcagttgctgaattaggtgagggagaactaagcatactgagactgtagagtatcagttgtctctggataatcc

SEQ ID NO: 9901 - DNA, 425 bp, Homo sapiens
  misc_feature 93..94: n=a, g, c or t
ctgtgttttctacccatagtcagtgctcccaaagttcctattctgtggagattctggagttgccacttcggtgttcctacgtccttcataahnngatagatggccttctacttggaaaggttttacagttcagcctgtagacagggaactggaaatacttttgggtagctcttctacaccaagatgatggtgttaatgatagtcacttttccttctcctctacacccctctcagtgttttttctctttgtttatcttgggcatctgcttctcatatatgtattctttattctcctcaaggctggtcttttccagcctcctgtagccattttcacagcataatttgaagtcctcccatgtctgctgatttaaataaatccctaataattttcttccaaatcatggctgagcacactctaaatctgt

SEQ ID NO: 9902 - DNA, 155 bp, Homo sapiens
attgaaggctcagagttttgtttcaagaactgaatcccaagcccacacgttattagcctgcgcttcttaaaacaagttatgagatgggaaaaagggcacccacaaacatacgtatacattatgtatataataatatacagtatcatatatataat

SEQ ID NO: 9903 - DNA, 308 bp, Homo sapiens
tgaatacagttaggttaaagtataaaattaaagaatttatattttgtaataattttgggaaagaattttaggacatagaatattccacatagtttgagttttgtatcagtttaacctttggacataagtttgtatttacagaaattactgttcaaaagtaagttttattcaaccaggataattaattactagtatatttactattaataaataacttatttaaaaaaataattctgggcacatgttgtcaggacctcctgaggctgggtctccaaataaaaaacaaaaaaacccactattctttggat

SEQ ID NO: 9904 - DNA, 79 bp, Homo sapiens; identical to SEQ ID NO: 9890

SEQ ID NO: 9905 - DNA, 296 bp, Homo sapiens
aggatatgtgttcgagagaagtggtcatcatggagcatgggagaatgagtcaattagagaggcttcgtaacattttagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgsctyccatgscccmacatgtattttwaaagtgatgagctagagttt

SEQ ID NO: 9906 - DNA, 429 bp, Homo sapiens
  misc_feature 311: n=a, g, c or t
caaagtaagctattaattcataaagtatactgaatataaattgcctttcattatgatgtttccacaaataaaaaaaatcattttccttttataagttaaagtacgaacagatattagagatgaaagccttaaagaatttttttagcctgttttattattgttttaaaatttactacagtgtacccctttattgcctgcactgggggcaatccacttctgccttgcacttagcatgacactgctttttattgacatgtaacatacattcagaaacagtgatcagatgtatccagatcaaacatcaccacctnrgtcaagaaagatgatattacaggtatcccagaagcccactccacaacccctcctaathgwtaacaccatatattagttttgtctcatgtttatcttcaaataaatggaatcaatcaa

SEQ ID NO: 9907 - DNA, 174 bp, Homo sapiens
aagctggtccggtccttttcgagggtgtggaagctttgtgtttttgctcttcactgttaaccttgctacctcttgttgtttgggtccgtgcccatctttaagagstgtaacactcactgggaaggtcgctggctagtcggtgccatctttaagagctataacactcactgcgaa

SEQ ID NO: 9908 - DNA, 180 bp, Homo sapiens
aacatggtacatgacattcttcctgttttcttcacaagacaaggatgatgtttaaatgggcatttgtttgcggaatgacttggagagttcctctctttcagccatcttttctcaaagactaaggctgtggacaggatgggcatgaagactgtcaaggagcccgagtgagggaagcagacc

SEQ ID NO: 9909 - DNA, 265 bp, Homo sapiens
tgaccaggatggtctccacctcctgacctcgtgatccgcctgcctcggcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcct

SEQ ID NO: 9910 - DNA, 424 bp, Homo sapiens
  misc_feature 315: n=a, g, c or t
tcctataccctggagcccactgaaagtgctcaaattagtcaatcctaagcctgcgtatcctgcctcatccattccttcctgcagaaaccacaataaagacacttgtcttccctcttcctttgcctcacgaccaaccttggtgcttcccctgagtggccctgtgtggcatattgtgttcttcccagagaactgtcagtataagaaactgtaaaactctttctggtttctgtctgttgatctgcatctggcctcaccaggtaatataactaaaacagtattaaattaatactgagttggaagaataacaatttgtanttaatataaatgcttttccagccataatctttgaggcacaaatgaaataatggatacaactttaaagaatgacaattccttgtaaatgtagggtattatagttgactct

SEQ ID NO: 9911 - DNA, 73 bp, Homo sapiens
atctacctgtgagttaggggagctaaaagagcataaagctcactcctgaacatgctgtctcttacctgcttaw

SEQ ID NO: 9912 - DNA, 441 bp, Homo sapiens
  misc_feature 241..242: n=a, g, c or t
tctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttkgttttcccccactaaatagaaatgagggtccttagtctgttyynnacaatckgtwaatttcttaggacagctgyctttggtttgctttccagcaggcgtagtatatttagtcggagagcacatctgwatgcgamaacttgattacatcttttttyctagcwatttkgcattttttcttttaccatgtttcagtttckgcatgtagatttaaataaaaaacaaaacttgtaaagttgtaacattt

SEQ ID NO: 9913 - DNA, 414 bp, Homo sapiens
cgaaaggagaaaaaaagccgagatgtagactctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgtacacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgt

SEQ ID NO: 9914 - DNA, 442 bp, Homo sapiens
tgtcatcaattacttgttaattacagatatggttttcatttttttttctcaatttttcattatgttatttttggagactgtcttaggtggggagtgaattataaatatttttatttcaccacctttaactgagtcaccatatgttatttgcacttccaatagaccagggattgaccagagtatcttttactgatatgaccaccagagctacatggcttttaccttctgtatatcagatgtcactggaatcaagcattaaacctagattaaatctggattaaaccagctgtatggcaccttagaaaattgagaaggactaggaagctgatagaaagaactcctgtataaaaaataaattctttttacattttccttggtagtatttctgcaagcttctttagtttctataggggaatcccagagttttcctctgagattgctt

SEQ ID NO: 9915 - DNA, 428 bp, Homo sapiens
aaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggag

SEQ ID NO: 9916 - DNA, 138 bp, Homo sapiens
  misc_feature 46: n=a, g, c or t
gttgccgcgatccgggccgggagctgcgggcgcccgggcsaagggntttcccggtgcgctccgccaggtcagtcatcgctagagggttattattgacatttactcatcataaaatgtgatgtcagcctaccagctcgg

SEQ ID NO: 9917 - DNA, 412 bp, Homo sapiens
aagtggaatttggttttatgctaaaataaaatcctagagccaggtgtggaggcgagtgcctataatcccagctactcagaggctgaggcaggaggatttgttgagaccaggagttcaagaccagcctgggcaacataataagacctcatctcaaaaaaaaaataataaagtaaaataaaataaaaatcctactctagggcacctgggaaccaaccagtggtgcctttggaaatcttggtttatgcttcctctctgacagtaggaaaaagctattgtgggagtttctcctgccatgtagagtgatggaagagcagaattgtggaggagcagggttgctttgttttgtctttgttgtactcagctggaaagctgtttaaggaaagaatctggtcawatgacctcctttctgcaa

SEQ ID NO: 9918 - DNA, 891 bp, Homo sapiens
tactggggtgtcttgcggagtgcagaaggctttctggcagctgcctgggtttggccagaccctgcctcccctcccgccggccaacccctagtccccttcctgtctcsacttgcattcaggggtggctgctgttctgagaacattagaactgggaagagagatggagtcacatggatttttggtgggcattattctgaactttcgtatcsaagttagtcccccttattccactgtggcattgccgytctaagcagttacctgatgcctgctgctgaagagctgctcacaggaggcggcggcggccctggcactgccccttrcattasgtcttgtgtttgatgtsttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggcctctgtggaccttggctccctccgtggacctgggcttcgtggtgagcactgcagcctccctgggcattccctccagcgccasaccactgcaacatatagacctgagtgctattgtattttggcttggtgtgtatgctcttcattgtgtaaaattgctgttcttttgacaatttaagtgattgttttggttactgtagtttgaa

SEQ ID NO: 9919 - DNA, 200 bp, Homo sapiens
taagagataagtacagagagataagtggtatttttctaatcaacaacttcctgttctaagtcatacgtaaaagttaaagtatagcagacaatatcgttttaggttaaaaaaaaaaaagtcakscctgtwwammcgtytgtcaaacaaaagtagakttttttaaawacctcagsycccaaatcaccttctgtttgcccatk

SEQ ID NO: 9920 - DNA, 182 bp, Homo sapiens
caagtatctctctaataactaaatccacttatttgcattctccttgtggattttttgtcacctaaggaaatgcatttbatgagtgctggaaacttcttaagtgctttacagtttgttttcattgtttgcagcggatcactggacatcaaagattcattgcacttatgaacaaggaaccttct

SEQ ID NO: 9921 - DNA, 164 bp, Homo sapiens
  misc_feature 26: n=a, g, c or t
aktggcaaacgcatcctcttgccttnccggtgtttgggccttgcctgtgacggtgggaaaagaaaatggccttgctgtgctacaaccggggctgcggtcagcgcttcgatcctdagaccaattccgacgatgcttgcacataccacccaggtgttccggtcttt

SEQ ID NO: 9922 - DNA, 468 bp, Homo sapiens
  misc_feature 389: n=a, g, c or t
tttgtctcawatacatttatcatttttactcaaaggatgttgaagtattaadagtcattatgctgtctgtggaatcctactattagtacagaacaccctgcagtgatttttccgcccatgttagcattgaagttgtgagctctacttgcttgtctttatggccctttaattcaagtaattggkcarkawcccgaawggggccstttwawaccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgkncttttcagattcttcaaacacctaaatgaaagtgataaattcaaaactgatccttttagttcctcattatatgatatga

SEQ ID NO: 9923 - DNA, 414 bp, Homo sapiens
ccacacagcatcawccaacckgtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggarrycttgsccgkkttycaaatkggttggccaagtcaaacagtgtgaaggaattacaagtccagaaggctcaaaatctatagtggaaggdatcatagaggaagaagaagaagatgaggaaggaagtgagtctataagcaagaggaaaaaggaagatgacatggagaccaagaaagaccatccatacacctggagaattgaactggcaaaaacagaaaaatactgggacgg

SEQ ID NO: 9924 - DNA, 169 bp, Homo sapiens
attcagaaaacttcttatagctacctcatgcaaaaytgttttcttcttccttctcaatggtgacatttgaagaggcagagcaccttggggctcctccttctgtcttaagagaaagccaaggcacgtagagtagggagaagaagggcaccatcctctctttcctccccar

SEQ ID NO: 9925 - DNA, 69 bp, Homo sapiens
aattactattgtgcggctgcaggaggtgtcrgcggcgttatttttttttgcggtttgccttttttttty

SEQ ID NO: 9926 - DNA, 441 bp, Homo sapiens
  misc_feature 196,306: n=a, g, c or t
adagtacatggaacaccatgagtctaacatgattgtstatcttactggtattattagaaagggcaggtgtaccgatatgtttatgcccattcttcttgtgtacttgtgactcttagcagcatggaagagaagtgtaaccatgcaaatacaatgagcttaatatgctaactttagsaagawgtdaaaakgtggrhcnaaawtgggkgggwagggaatgggawagtctgagatacccaggcttcatgatggtgtatattattkcagcatattataaactagtcactaatgaaaatggccatccatgancattgactcaaaactcaccaaggaacctgaccttgccctccacactgtggcctcactgtaacagtttcctcaaggttcctaggagggtatcaccttagagtgaagtctaaaatttggctattttttatctataaa

SEQ ID NO: 9927 - DNA, 168 bp, Homo sapiens
cattttgtyacttaatgccagtacaactgtgttactcctaaggacttttgggattthkatgagacctgcgagggagaagacactgagaagccagtgatctgcaagcatttgctcttgtttccacatcacctctgggatatttcagctgttgtttccaaatggcaaatc

SEQ ID NO: 9928 - DNA, 457 bp, Homo sapiens
tctgtttaagtaggggaaacattcgccagtcagacgtaataaatatctccataatgcattcaggtgaaggagacacactactgtacataaagtacattcagacattcttattttaatccagagttttaccttgatccataaactcttgtgttgttatgtctttccagtataactgtagctcctgttaggacttcaccaacagatttgtaagttctgtgcatgggtcyctcgkggraasatcyccwakgcttwamcwatttdatccattwaaaagcatttgactctgggtccccagctagggactagcaaggaatctaggtcttctcttcaggccttatctaagcattggcttaggcaagttgaagttagatttttcttagtcatttttgccttccagtttttaaagtttcctcaaactagggtgaattgccgggtacagtagctcactcctgtaatc

SEQ ID NO: 9929 - DNA, 54 bp, Homo sapiens
acactcacaaagagccgaggggagagagggtgcgcagacggccagccgggccgc

SEQ ID NO: 9930 - DNA, 379 bp, Homo sapiens
  misc_feature 221,233: n=a, g, c or t
gtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttycccgnccbkrggccggngaagccytgggksctgcaggtattcaaaacctttgaccacatgrccccgtcagratgatgagaagagaaggcaggaacttgaagagaaaatcagaagaaaggaagaggaagaggccaagactgtgtcagctgctgcagctgagaar

SEQ ID NO: 9931 - DNA, 419 bp, Homo sapiens
taacatgtaacttgcagtgtttgccagctttcaaagcaggctttgtgaaaatgtaatacaaacagcagtgaatgggactcaaatgttgtgcttcctataaacagctccgctctttcagggaaggatggtaacaaactagaaggacaaatatgtacgtatttataacgtattaaaactcttttaagtagcttaaggtattgtgcaatggcctagccyagtagaaatggggggaaarcaatgctgtgggaccattgttaaagtgacaggagttgtagggttacccctttgacaagcttccatagtcttcagacacgcacattgatggcatccctacagtcttcttcacttgaactttgtaaaactgcatatggacctgtaatcaacttttgatatttcttaataaaggcgttgaaaatcaa

SEQ ID NO: 9932 - DNA, 422 bp, Homo sapiens
tattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcsgatgcaaactcmrcctcagggatycatttggkgcctwagttttawatgcatccttatttttaatacacckgcttcacgtccctatgttgggaagtccatatttgtctgcttttcttgcagcatcatttccttacaatactgtccggtggacaaaatgacaattgatatgtttttctgatataattactttagctgcactaa

SEQ ID NO: 9933 - DNA, 198 bp, Homo sapiens
  misc_feature 174: n=a, g, c or t
catcacgctccgcgtgcgcagcacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcancagaatgacaaaggcaagaacgtc

SEQ ID NO: 9934 - DNA, 207 bp, Homo sapiens
attgtatttccttgttgtgagtctagcgaatatttgattatctttaagttgatccatagtatattcaacagtctcatgagaacataatttttgttgatgatttgtccaaagtttctatcaatccatcttagcagcagagccaagtgttagagttattgctgcctgagttataacagctgccctgggaatcttgtctgaacaacaagt

SEQ ID NO: 9935 - DNA, 413 bp, Homo sapiens
aagcagagactgcagaacaatgaccaggtctgagggaggatgggcgaaacgcaggctagattatgacaggcatcaggtcaagggtttcctttccaagagagccgtacagggtggcagcagccagtggcatgtggagcctgggccattggtgtccatggaggtcagccagcgacaaggcagggcctggagcaggtgctgacagaagctagactgacctctgggccaaaattccctcttccttccaaactaaccaggccaggcctccaggaaataacaccagaaccagacttctgaactggcaaaagaatcaccatgagccttctactggatatggttgggtccctgaccaggatctccaggaagctgcagctggttgtatatccaatatccgcagctggctcttgctacagaga

SEQ ID NO: 9936 - DNA, 440 bp, Homo sapiens
cagtctaggatctctgtttttattttaatgttggtcagttgtgtctaaattccagagcggggcaggtataatggggcatcccgagccctccttcccattcatggcctgaactggtttttcaggtttctttgggtcccggtggctgcaaggggatgcactcagttggctgggggacttagaattttagttttggtttacagcaggatttgatgggcatgcatatttatcaatgtgaaagtgttgtctgtgggcggcggagggcttgggccgtgtccaggccacgcactgcaagggtgcagcccccacacacggtccctgctcctaaagctgttrcccccactgcaagagtggagtaggttgaggtgtagcatgacattctggaaactacattttttgtaatagtcattttgaaaataaaacatttgaaaatactgtgcagc

SEQ ID NO: 9937 - DNA, 391 bp, Homo sapiens
tattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctcactggatgtgagtatattgggcctgggacaggctgggggctaacaccctgtgtgagatgagtgtctttgtgtctgtgcttgatgttggtggctctctgtagtcacatgacagcatgggtgtgatggagatctgacttcattcaacaaacatattttctaaggagttchctgtgccaggcactaagctgggcactgggaatgtaataaaatagtcaaggtccac

SEQ ID NO: 9938 - DNA, 308 bp, Homo sapiens
catatataccaggcttgctctttgcagtgaatgggaagcctcattttggggaccaagaacctgtacaaggatttgtgatgaacttttccaatggggaaattatagacatcttcaagccagtgcgcaacattttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaatctgaacacaaactcgagacgagtt

SEQ ID NO: 9939 - DNA, 328 bp, Homo sapiens
tacatataccatgtagtatgaccatggttgaaacaaggtcaaaggtgatgtcaatcccatgttgtaacatctacgggggcaggagtcacaaacgttggatcagatatcacctgtgagttgcaagtacaaggtagtttcaaagctgtgcctctgcaatatttcttttcttctttttgaggattcccgtcacccttagaattatatcaaagctcattgccaataccctggtctcctaagccctgtatgattctgctccagcacatttctccgacttgccatgccacttgtcactttgctacaatgacctcccttcatttgtcctgtctca

SEQ ID NO: 9940 - DNA, 400 bp, Homo sapiens
aattaatcatttagatgggaaacataagcctactcagcaaccaggaaaaagcatgtgttcctgatgtctgtgagcaccagtctgagatgcgcggatgcttcagcatgcctccagaagcagagaaagaacaaaagcactggaaccggtctccggttgcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatc

SEQ ID NO: 9941 - DNA, 161 bp, Homo sapiens
  misc_feature 17,19,25,135: n=a, g, c or t
acttctgctgccgctmnvngtagcngcggcggcggcggctgcggctcgggagcgcggctgctttgagggctcgggaaccttacagagtagggacgtdgggaggctagarggtgagahagctggcvggagattagnrcggcgctggakgagggcggtgcgtg

SEQ ID NO: 9942 - DNA, 169 bp, Homo sapiens
  misc_feature 165: n=a, g, c or t
taagtaattcgtttcggtttgtagatgtttcccctgacttgttaaagaggdaaccaggaactcagtcatgtttttgtcctgggataatctacctgttatgccagkactcccatccgaggggcatgcccttagttgcccagatggagatgcagttcagtagatttngggc

SEQ ID NO: 9943 - DNA, 256 bp, Homo sapiens
attcatttcatttccccacaggcatgattgaaaagggttgtaagattccaggaatgaactaaatgtttctctgagcccaaatcaactatcatctgaaatcgtggtgcagagaagaaaggtgcaattcctaaatcacctgctaagaagctgactaatgcattaagcaagtccctgagctgtgcttccagccgtgaacctttgcaccccatgttcccagatcagcctgagaagccactcaacttggctcacatcgtgc

SEQ ID NO: 9944 - DNA, 172 bp, Homo sapiens
tatgctgaagagtttcatctgacaatctgcttcaagaaatctcagaaaatatgataacattttaactttcattttagagcacgttttggtcatttttaaaaatacctaaagtgccagaccggaacctatagctactgctagaagtcttaaaaaaaccaacagsagcacaggr

SEQ ID NO: 9945 - DNA, 138 bp, Homo sapiens
gtttgttgacacatgctaaaaatgtctttggagagaacttctgcctgataaacacccaattctagactgtgggtggattttcgagctgacggtggtcaattcctttcattaagcagtgatctgatttckccacatggs

SEQ ID NO: 9946 - DNA, 88 bp, Homo sapiens
atcatgtccctttttaagccttacctgagaggaacaatgccttaaaataaaaaagcattaatgagatgaaagtatgcacagaataack

SEQ ID NO: 9947 - DNA, 64 bp, Homo sapiens
tagtggatataaataactgttgtaattataackccaaaabagaatgtdtaagtckaaacaatcw

SEQ ID NO: 9948 - DNA, 219 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaaaaaaaaaaaaaam

SEQ ID NO: 9949 - DNA, 190 bp, Homo sapiens
tcctgaggagtgctttacttccaactatgtgatcaattttggaataagtgctatgtggtgctgcgaagaatgtatattctgttgatttggggtggagagttctgtagatgtgtattaggtctgcttggtgcagagctgagttcaattcctggatatccttgttaactttctgtctcgatctgtctaatgk

SEQ ID NO: 9950 - DNA, 188 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggt

SEQ ID NO: 9951 - DNA, 140 bp, Homo sapiens
tattktttacattttgctttagaggcagggtcttggtctgttgcccwcactagaatgcagtggtgccatcacagctcactgcagccttgaacttctggactcaagcgatcctcctgcctcagctagctgrctagctgggr

SEQ ID NO: 9952 - DNA, 188 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggk

SEQ ID NO: 9953 - DNA, 176 bp, Homo sapiens
tatatgtagaagataacaaagcagctgtgtacagtggcttgtgcctgtagtcccaactattcaggaagctgaggctggaggatcccttgagcccaggagtgagagactgcagttagccactgcactccagcctgggcaagagtggctcctctctctcttaaaaaaaaaaaaaaaaw

SEQ ID NO: 9954 - DNA, 176 bp, Homo sapiens; identical to SEQ ID NO: 9953

SEQ ID NO: 9955 - DNA, 479 bp, Homo sapiens
  misc_feature 372: n=a, g, c or t
cttcttccttctccgtggcctacgagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagkacttggaawcbkracbcbtttcbcccwaattckgcggattccggcccctaatattctttatcagaccctcagacaagaggctgacttctgcccccttgtcaaggagcgaggccactttcctctccaccccatgctagcgaggataacttatttctcttctggaattgcatcttatgcgccttnvccacccatccccacagcccctgcaatacccagtttggcctctwttgcttaataacgcagatcccagcgccacggcaccttagaacagactttttctttctcgcgtg

SEQ ID NO: 9956 - DNA, 400 bp, Homo sapiens
tattttttacattttgctttagaggcagggtcttggtctgttgcccacactagaatgcagtggtgccatcacagctcactgcagccttgaacttctggactcaagcgatcctcctgcctcagctagctgactagctgggaccacaggtgcttagcacgtgcctggctgatttttcctggtctcattgttgctggggstkgscstkramsycmaaccstcaggcaatcctcctgccttggccacattttatgttgggattacaggcctgacccaccatacccagcctaatactatttttaaaaacaaaaagtaggaaatcaattttccttttaaatgaacactaaattataagaattaacttgggtaatctatgcaacattctcacttttttttttttttk

SEQ ID NO: 9957 - DNA, 380 bp, Homo sapiens
tgggaaaatttttgaattgaaatagcgtcttttgtggtaagttttaagaccttttatttgttaaaatgttgctcaaggtggagctagtgaggaaaaataaatttctggaaaaaattggaaatatttttgatatttgccaatcgaatatcacataactaacctaaaggaacagaagtaggtgtactttagttaactcagkttgrwtawkgatggccaaggadttaaaaagaaaaattgyctycctttcagactttttcttttttggagatgggtactcactctgttgcccaggttgcagtgcagtggcatgatcatggctcactgcagcctggatctcctggctcaagcgatcctcccgcctcagcctcttgagtagctgg

SEQ ID NO: 9958 - DNA, 112 bp, Homo sapiens
  misc_feature 47: n=a, g, c or t
tattttttacattttgctttagaggcagggtcktggkctgttgcctnbtctagaatgcagtggtgccatcacagckcactgcagcctkgaacttctggwctcaagcgatcck

SEQ ID NO: 9959 - DNA, 423 bp, Homo sapiens
ccagagcccgggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcacvctcacagactataccaaaccagbtggbttccmaggmawkgccagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggt

SEQ ID NO: 9960 - DNA, 128 bp, Homo sapiens
aacacgggaacacccacctttagagatgagacacaagcaggagaagagggattaaacctgctagttttggaaaaaaaaaaaaggaaagaaaagaaaagaaagaargaaaamcaaaaaacaacaacaam

SEQ ID NO: 9961 - DNA, 364 bp, Homo sapiens
tcctgaggagtgctttacttccaactatgtgatcaattttggaataagtgctatgtggtgctgcgaagaatgtatattctgttgatttggggtggagagttctgtagatgtgtattaggtctgcttggtgcagagctgagttcaattcctggatatccttgttaactttctgtctcgatctgtctaatgttgacagtggggtgttaaagtctcccattattattgtgtgggagtctaagtctctttgtaggtctctaaggacttgctttatgaatctgggtgctcctgtattggatgcatacatatttagtatagttawccwcttcttgttgaattgatcccttgaccattatgtaatggcctt

SEQ ID NO: 9962 - DNA, 56 bp, Homo sapiens
accaccgcgcctccgcctcggccgccgccgcagctgctcctggtccccgtcccttt

SEQ ID NO: 9963 - DNA, 185 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctg

SEQ ID NO: 9964 - DNA, 469 bp, Homo sapiens
atcagagtccacatatgttcgggggagggaccccagaaggcggctgacagtattcctttagccagaaatcccttcagggaagagaaaggtgctcccctttgcctgcttttatactacagactgtttccaactccagctagaagtgactattgccgattatgctaatcagtggcgacaagctccctttgactgctcacttctccagtgaggcttcaagcttctaggcatcaagattatattttccagaaaatatttcaagcagaatatacttattttccagttttgaaaacaactagattgcccatctccatttctctctatcatctactgtattattctatggacaactgccaccctaataaggtcaagaagggaagccagaagtcaaggccacagaagacacaggaaacatcatatccaaagtgggagacaaagctgttaacaggaaattatttgtaaagtcaagagc

SEQ ID NO: 9965 - DNA, 56 bp, Homo sapiens; identical to SEQ ID NO: 9962

SEQ ID NO: 9966 - DNA, 72 bp, Homo sapiens
cagacactgtgctaggagaatggaaaacaattttgaacaaaactgtctacctacatgatttttttttttttk

SEQ ID NO: 9967 - DNA, 104 bp, Homo sapiens
atatgcacttgtatattctgacagccatgtcacttacaccttctcacctktkgtctcgtcctattkgctatckaccattckaccactgtccatttckaccagct

SEQ ID NO: 9968 - DNA, 176 bp, Homo sapiens; identical to SEQ ID NO: 9953

SEQ ID NO: 9969 - DNA, 56 bp, Homo sapiens; identical to SEQ ID NO: 9962

SEQ ID NO: 9970 - DNA, 434 bp, Homo sapiens
cagacactgtgctaggagaatggaaaacaattttgaacaaaactgtctacctacatgattttttttttttttgagactgagtctcattctgttgccaggctgaggtgggagaattgcttgatcccaggaggtcaaagctacagtcagctgtgattgtgccactgcactccagttttgatgacagagggagaccctatctcaaaaataaaaaaaaagaaaagaaaaaagcagtaagaaatggtacattttatgttatgtgtatttttaccacaatttttaaaaagtgggtccagggctgtgccaccccactggcaatgctggctgccttctggaaactgcatatgcctcactccctcagtgtgtaaattcacaaacactaatggataacaacagaaaatggcatgaaaacagtaggaatcagcaattttgcacra

SEQ ID NO: 9971 - DNA, 439 bp, Homo sapiens
atatttaaattgttagctctaaaaatagattcagagaaagggtggacacatgttccaattttctcataacagtcctgggttgtgcctgttatcctggcatagttattaatcctgtcccctttcactctcagactctcctggtttggaggataatttcattctattcmaagagggaaatctacaaaaaggtgtcatcatctaacctgtattcatataaacattttccagtctcacggttctgtgtacctctccaaacccctcaatcttctaatcattttgtgtattatttataggaaaagagcaccagctaaaatatcttgcccttggatttcttcagccagctgctgaagtaatttgtcttagtctttactgaagactgaattgtatcattaagactttcttctaagtcctgttattttgactttttgactcactctgk

SEQ ID NO: 9972 - DNA, 114 bp, Homo sapiens
aatttttataaacttttgttctttcttgtaactttttatcagtcagctattccaatgaagcaaaatctgataatatattgcttttatactaaaaaaaaaaaaaaaaaaaaaaaa

SEQ ID NO: 9973 - DNA, 349 bp, Homo sapiens
gtttttgtattggaagcagttgtttggccttgctgagcaaacgtctatgccttctccattacatccaaaggagaatagccccatgtgaagaatggaatcagtagatgtttggtcgctgtaccatatccactcctaggatacaacaagagcaagcccaattctcttggtggtgtgggcagtcggcttgcaccacgtacctatctcagctctttttggaagcttatgtcctccccacaacttccagctttcttatgggacaagggtacactcaccactgccatatctaatcctgcttgcctggtaaatgttctcttcttctttacamccctgatgactctggtcamtctam

SEQ ID NO: 9974 - DNA, 505 bp, Homo sapiens
aacttggtcgggtctgcttccgcgctgtggaggttttgttttttactctttgcagtaaatcttgctgctgctcactctttgggtccgcactgcttttgtgagctgtaacactcacggagaaggtctgcaggttcatttctgagccagcgagaccaccagcccgccargaggaagacgctgccgaacatcagaaggbamcaaactccaaacacgccgcctttaagaactgtaacacctggagggtccgcggcttcatgaagtcgcagagaccaagaacccaccaattccggacacaaatgcatcattgcactccagcctgggtgacagagtgaaaccctgtctcaaaaataagcttccattgacgaccagctttggctgttccaactcaccacagcctctgaaagacccatgctctctttggattgsttggtasctgcagcacgtttccatgcctgggarggargttacatcctgaacaargtggcacagctacatcatgacatct

SEQ ID NO: 9975 - DNA, 86 bp, Homo sapiens; identical to SEQ ID NO: 9617

SEQ ID NO: 9976 - DNA, 487 bp, Homo sapiens
ttaatataatttatttcaaaataagaatatcttaaatattcaaatgaatatattaggaatttaggagccagaaaatagtgttggactaggggtaaggaaacctaattgttgtttttgttttgtcactaattggttttaagactcaagtaaatcatttattggktttactgggttccactcacctcatctatgactatttaagtttctcctaataataatcacaattctagaaaggatctttactagtcaagctcttcaggggactagatctcttccagctctctgatggggaacacaagtacacagaggttgttctgcttgatcagggttaaaggcatgctggaactagaatctaggcattcaactactactcctccctccaacctctagccagtacttctagccatacgtacaggctgcctcatcttcatctgggaataattttgcattaactacattattaaaaagaattattgcaaaacactaa

SEQ ID NO: 9977 - DNA, 338 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccmaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaaw

SEQ ID NO: 9978 - DNA, 473 bp, Homo sapiens
aagcgccccctgcggccgggaggaggacggcagccaggaaagatgaagagcgcgtgcagtccccgaaggtacacmctagggttcccccccacgcgaagtttctctccgcaatccgtgccacctatcgagtaggattcctagtgttcgattcctgtgagaaaaggtagrcctacgctgcctgtcgcagtttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcattccgccccattgaggataatgaaaagagcaaagatgtgaatggacccgaaccactcaacagccgaagcaacaaactgcactttgct

SEQ ID NO: 9979 - DNA, 438 bp, Homo sapiens
  misc_feature 339: n=a, g, c or t
tgcactatagaacaactggacctaatagatatttacagaacatttcatccaacagctgcagaatacatattcttctcctctgcacatggattattctcaaagatagaccatgtgttaggtaacaaaacaagtcataaaatatccaaaaattggaaataatgtcaagawtatyctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatataccanaacctataggatacaatgaaagcagtaggagagaaattgtagcaatatgtgcctacatgaaataaaaacaaaaacaaaataacttcaaataaataaaac

SEQ ID NO: 9980 - DNA, 423 bp, Homo sapiens
  misc_feature 366: n=a, g, c or t
aaacaaacaaacaaacaaaaacaaaaaaacagttacttgtggaaaggttacttatcttgatcatcccattttggtattatatgaaatagaggttgagactttggactcaggatggagctcagagacacagtggctgagccacttaggataaagcactccagcctggggcaagagcgagactccatctcaaaaaaataaaataaaggccatatgtttaatcacattccccaaaaggagaacttcataaggcactaatgagtaatgtttattttacgaatgattttacgggaaaaattacagaggatgtttaaattgcaaaaatactcctccccttttttctcctccaccgccccccaaaaaaaatcntttgcagttatcacctaagctttttgggtgtgtgatttaaaaaaaaaaaaaaaaaac

SEQ ID NO: 9981 - DNA, 283 bp, Homo sapiens
ctttttggaagaacagaagtgaatgggaaaagaaaaggtatggtaaaatcaagaaagacttctggaaagaagcagcagcattagaaattaagaacattgtctgtgaagtctttcaccagcgaggagtggggttgtgagggagaatatctgacatatcattargaacatgaaaaamctagaaggcaggagggtacagagtaactttgaggaaaaccatagaatccatgttgatgtgtgaaaggaamtcattttttagattgattcagaaatggggtaaatgaaa

SEQ ID NO: 9982 - DNA, 55 bp, Homo sapiens
gcgcgaggytgtccgctgttgggagytgccagcccttggcctggsgccgggcgac

SEQ ID NO: 9983 - DNA, 388 bp, Homo sapiens
atttagcataatttcttcaagattcatccatgtttagcatgtatcaattcttcattccttttcatggtggaataatattccattatacagattcacctcatttttttatccattcatcagtagatgggcatttgggttgcttccagttttgggctattatgaatwatactgctgtgraacattcatgtacaattttttgtacagacatatgtttttatttctcttgggtataaggctataagtggaattgctgaatcatatgattcttttggctattctggatccctggaatttttatgtgaattttaggatcagcttgtcaatttctgcaaaaaacaaaacaaaacaaaacaaaccaggattttggagatttacctaagatacagaa

SEQ ID NO: 9984 - DNA, 71 bp, Homo sapiens
atttccaaagccatggtgaaacatctctgtgctaatttcttttgttttgtttcctaatttttttttttttk

SEQ ID NO: 9985 - DNA, 485 bp, Homo sapiens
gtattgttccgggccaggtcaaaacagtgagcttccgagtttcttggtacatatgttgcagtagcatacctaaaactgttatatgttgcctctagacttcagagagtcccaaaaggcaccacgctattttcttggttgtagatttcagatatagcctctttccatttaccttggagcagatatgttttcatgggctcagactgaagaaaaccttgaaacttaaacaaaaggtcagacattgaatttttatggggctctatttctcattttcaggcatacaagtatcttaccaaggcttctgagatattcaatacatcctgcttacagagtccaataaractgctacaattaatagagggaactagcatgatgtcttctggaagaatacaattatacaggtccctataccttacattttgagagagagctagagggttgatatatctttcacgaaagtgaatgacaccttttttctttttctgtct

SEQ ID NO: 9986 - DNA, 162 bp, Homo sapiens
agtggtggtggaagtggtggaagggtggaagggctatttaaatttttattcatcctctgattggttgtttcacttaagcctctaattggttcttgagtcctggagcctgtgaagggtactttattttcagtaaatgcatgctttttttgtttaaaaaaaaaa

SEQ ID NO: 9987 - DNA, 455 bp, Homo sapiens
ttatttaaaaatgttttttggtttttattctgaagtggtcagaagattaaatagagtattccaagagaagcactgagagcggtacctgctgtgtaatatgtgctatgtaaatgttaactgttcatttcttattatgtcatcagtgttccagggtagraaatgcataacctggctgggcacggtagctcacacctgtaatcccagtactttgggaggctgaggcaggcagatcacttgaggtctggagttcaagacggcctggccaacgtggtgaaaccccatctctgctaaaaacacaaaaattagccaggcgtggtggcgggcacctgtaatctcagctactcaggaggctagggcaggagaatcgcttgaacccaggagtcgcactctgcagtgagctgagatcgtgccaccgcactccagtctgggtgacagagcaagactccgtctcagaa

SEQ ID NO: 9988 - DNA, 488 bp, Homo sapiens
aaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcgggtccgaactcggggacggagaagggcagactagtcatcccggagaagcaggggtgagggggtcggctaggatgaggaggggagagactattactctttggaggggaggagcctcggacccagtaacgtgaggaaaataacttgtgggaggcctgtggtcactgagtcccaaagttgggagagttgttgggtaaactctaaagggccctggaggtcgcgattattgtctgggagtgggaggaggtgttagggggcaagggagagaagaggctaattttgacgggggaggcatgggcagaactggggcaaatctggatgtgatggtcttggaaacatactgaca

SEQ ID NO: 9989 - DNA, 383 bp, Homo sapiens
agcagtgagaaaagtgagcctcagatgagtggttgcccttcagcaggaacatggacagctcatccacagtaatgggagggggcagggggatgattgtcctgttgggaaatgtggaacttcttcctgacccatcctggtttactcattaaatgtgsctcaargtcatcggatgaaagagaagattggaagaagctactgaaggtaaagcagaaatataagggataattcctcadctacagtggacagagctggaatctgagccaagcggasagtcatgctgagttcaggaagcctcactgctaaatgccacctatcaaagtggcctcccctgaccatcctgtgtaaaataatccctccttcctctctaaaaaaaaaaaaaaaaa

SEQ ID NO: 9990 - DNA, 491 bp, Homo sapiens
tgttaattggattatgtaactctgttactagtctgttattggctgttgttactggatgcatcttgatattcagaagaataactgtgaggcattcttcagttgcgggttaagtggggttagtttctgttctgtcagatgccctttttcagtcaaaggttagccccttgtttctccctccttccagggtttagggagtgcagtgatgtcgatttcatttcccttccccgcaccccttgacactcagcaggattgcactgaaacccttcacagatctctcgttcactagttgtctcctatttttccataactagcactagtttggccttatgacctggttagaatcactcttctgtattctcatttccaatttttgtgccactaacgtggactagagaaacttggcctgctgtgcagtgggccttctgttcaacttaccctccamcgctgaccctgtgtgaagagagatggtgcgttactgccatctaatggga

SEQ ID NO: 9991 - DNA, 500 bp, Homo sapiens
actgaacaggaagttaggaaaagatgcacatcatctgctctcctgaaccaataagagccagttccaagacaccataactgattgctatattttaggatttttttctgattataaagtgtatctttctagaaaccatagaaatttcaatatatgctcaaactgaagccattcctaatgggaatatcagaaaaagaagaacttggaattcagaaggaaaagtaaagaaactggttaagaattaataaaggctttagcaatgaacttttaagatagctaaagctggaagaaaataaactccgaagttcgaactgtgttcctgtatttgttagctctcaagggaattgagggtgaagaaggagctaaaggcaggagctttggcaagatatcatcaagccaaatatcagataatctcatatgtttaactaagctgagttaattaaataatgattgcccaagatttttccacctcgaacatccaaataacgacagatgtctgacac

SEQ ID NO: 9992 - DNA, 448 bp, Homo sapiens
atttagcgcctcctgactgccgaatgggggctcgccttggtctccgtgctgattggctggcagctgtacagcctggcacttcgccctccaccacatctcacctcctgagggactctgagagaacgcccggccagggtgaacgccgcggcaggagagcacgggagactgtgaagagcatggggagcctttgtcgtgcagcgtgaaacccttgagcctttggcctaggagctgggagactcagggcccttctcacactcagaattggagcagggccttctagacagtcccagcaccatgagccctgaaaagtcccaagaggagagcccagaagaagacacagagagaacagagcggaasccatggtcaaagatgccttcaaagacatttccatatacttcaccaaggaagaatgggcagagatgggagactgggagaaaactcgctatag

SEQ ID NO: 9993 - DNA, 355 bp, Homo sapiens
  misc_feature 223..226: n=a, g, c or t
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaaccccatctctactaaaaatacaaaaattagctgggcatggtannnnaagcctgtaatccagttacttgggaggctaaggtagcagaattacttgaatctgggaggcagaggttgcagtgagccaagattgcgccactgcactccagcctgggtgacagagtcagactctgtctcv

SEQ ID NO: 9994 - DNA, 142 bp, Homo sapiens
aaaccaggatccccactgaagacaggccagggkggtcggawatcacttgggggatggtggaggatgagatattgagggtccagccgtccattccggtggaggcagaggcagtcctggggctctggggctcaaaaaaaaaaaa

SEQ ID NO: 9995 - DNA, 481 bp, Homo sapiens
aaaaaggatggcccctgtgtttgagggccttggcagcaactgccctgctagtacaagaagcaaataagctgactcttgggcagaacctgaacacaaaggccccccatgctgtggtgactttaatgaatactaaaggacatcatgagccctgtcgagcatgattgtgtagaagtgttggactcagttgactctagcagacccgacctccgggaccagccttgggcatcagtagactgggaactataggtggacgggagcagctttgtcaacccccatggagagagaggtgcagggtattcagtggtaaccctggacactcaacaacttgaaggcagatcattgccccaggccacttcagcccagtaagctgaactcattgctttaattcgggccttagaactcagtgaaggtaagactgtcaacacttacactgattcttggtatgcctttttaagccttcaagtgcatggagtgtgacaga

SEQ ID NO: 9996 - DNA, 367 bp, Homo sapiens
atcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgacaccgcgcccggcctgagtgagtcttaatccgtggc

SEQ ID NO: 9997 - DNA, 86 bp, Homo sapiens; identical to SEQ ID NO: 9617

SEQ ID NO: 9998 - DNA, 327 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagctycccaagtagctggggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaad

SEQ ID NO: 9999 - DNA, 348 bp, Homo sapiens
gttgagtgcagccatgggggacgtcctggaacagttcttcatcctcacagggctgctggtgtgcctggcctgcctggcgaagtgcgtgagattctccagatgtgttttactgaactactggaaagttttgccaaagtctttcttgcggtcaatgggacagtggggcrktgatcactggagcaggcgatggaattgggaaagcgtactcgttcgagttctgcaggcttgtacaggaaggatgatgctggcatttgctcggcttcggaggcctcaggaaacttacaaacgtggcggaaggcaaagagggagcgagcacttctcatgcctggagcagcaggaagagaaggg

SEQ ID NO: 10000 - DNA, 479 bp, Homo sapiens
taaagagtagggtatttctataacaratattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttmcmttcttggaagggaacattgatatttaacagagtttttagagattgtcatctcatatatataaaawggacacgtggctataaaacaccatataagagatgagtagtgcgttttattttatatgccaatctactttgtttaaaaaaggtctgaatcaggacttgtgaaaac

SEQ ID NO: 10001 - DNA, 487 bp, Homo sapiens
  misc_feature 336..337,368,370: n=a, g, c or t
ttagacgttgaaagtcttaaacgacatccttcctttacagcgttaaatatctgttcctgatttcagaaatagacaatataataacacaaaacataagagaaatggatgtagagatgaaaacatgtagggcaggcatttaattggtgggatcacatgctcagtaatttgttttgtccaccagtgattgattctgcttgtgtattgactatttgagaacactgtctctgtgaggcctggctgactcttggatgtcttttaaactgattctaggcagagaggttttctgaccagagctgtgaatttatggtagcaactctacaaaaataagtgaathbnnatttttaaaactgttgcttatccaagathynrngaaaagaacaaacataaaaagggatcaccagccttttgcaaatgcacacgatgtgctagcccgctcccgcagtcgagccaacgtgctgaacaaggtagaatatgcacagcagcgctg

SEQ ID NO: 10002 - DNA, 325 bp, Homo sapiens
  misc_feature 221: n=a, g, c or t
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttwngtatttttagtagagatggggtttcaccttgttggccaggttgcagtgagccgagattgtgccatgcaccccatcctggcgacagagcgagactctgtctcaar

SEQ ID NO: 10003 - DNA, 367 bp, Homo sapiens
ttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaaaatggaattgattattttcctttttggccatcacgtacacatgtaatctggaaaatcatacctttgtcaattttaaacataacttttgcatttcccagatttatactatgaagggggtaatacattttattttttcattgctatatgacagctaaggggcaaatgattcaagtatattttaaatcagr

SEQ ID NO: 10004 - DNA, 437 bp, Homo sapiens
agaatgtcaaacttctgttggtacattgttagccaaaatgaagacctgtgttgatacctatacgaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggggctatgaaacccaaacctttgtcagtattaaagtcacttgaagaaaaatatgtggctgttatgaagaaattacagtttgatacgtttgaaatggtttctgaagatgaagatgggaaattgggatttaaagtaaatbaccactacatgtctcaggtgaaaaatgctaatgatgcgaacagtgctgc

SEQ ID NO: 10005 - DNA, 364 bp, Homo sapiens
  misc_feature 168: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcagganatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagwvaccctacaagctagaaaagagtaag

SEQ ID NO: 10006 - DNA, 476 bp, Homo sapiens
aaaaaacatgtgcaacatttccagaaatgtaccagagttgttcgtgatcataaccccaaatcattggtacctcgatgtttagaggggaaacagcattggctgggcaagctggggcagggaacgtgatgaacagtgggctggaataagttaactggaggaggggaggcgtctcaggaagggagaatagcatgaacagcagcatagacgtgagaataaccatctggagtgatgaacctatgctgagtagaaagttccagaaggctgcataagggaggtgtgtgaacagcagaagcaggacaaacctgagatgctactgcacagaccgtgtaaatgaacaggacagccagagagggagaagatggctaaactgaagcaacttggagctagaagataggctgcatctgctcagttcacctgcgcagaccaaaaacagtgcacgctgtagggggcccagtccagctgaatttcatcagatg

SEQ ID NO: 10007 - DNA, 486 bp, Homo sapiens
  misc_feature 74,90,214: n=a, g, c or t
accattggaatgcctcattctgcactctcttgacctcaccttcttctggtctttccacacctcaagcaagccancccgccctttccaranccagccccgcccaccctcgccactcggagatgtttacgtctccaaagagccctcacgtctgtaaccaaaagagggggaaggcggggcctggcgttgtcacgtggctgtaccaccccggaccacngagagagcggtccgcactactttcccgttgacgtcggcggagggatacaaaacgaaatagctcaccggaagtgcgctgctcgcaccccgggacccgcccgggctgccggctgatgtggaccgtccgacccgcgtgtctgataatcctttgacgggttttggtcggcggagaatggtctctaaacttcccaaaccgcccccgtttcacgtcctgtgaaaggaagtgctcctctgatgaccaatcagcggcgagaagctcttttaacgtccgtc

SEQ ID NO: 10008 - DNA, 415 bp, Homo sapiens
  misc_feature 373,375: n=a, g, c or t
tagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgmattatgtgcaggtatgatattttcttcactactttttctatcttaatatagtgtggaattttattgtattattcttccattcttaatactgtaccacattcctgctcagaaactggwcacttccttaaattgtcttttttcccccagcgtgaanbnbatccatttataactgcctattgcctgttctattagcatc

SEQ ID NO: 10009 - DNA, 289 bp, Homo sapiens
ctcagcatctggagtagctgggattacaggcacatgccaccacgtctggataatttttgtatttttagtagagacggggtttcaccatgctggtcaagctggtctccaactcctgacctcaagtcatctgcccgtgtcggtctccggaaagtrcctgggattacaggcctgagccaccacactccacccctaatcaccccttctaataaagacacagctcatgtaggatgagagctaaaaaaaaaaaaaaaaaaaaaaaaaaaaaaaaaaaaaaaaaaaaaaaaaaaah

SEQ ID NO: 10010 - DNA, 440 bp, Homo sapiens
  misc_feature 360,363,376: n=a, g, c or t
acttcaaatctaattttatttaaaagaattagtaatgattttttgagtgaagttttcagaaattgcactaagtattttttaatgcttcagtgaaatatggaacacatgagataagttatatttggttgatgaagttattctgaaaaaacgctatttggaaaggtgaacttctgaaactacaataacatttcatctattcccaggaagaaatattcctaaggtgaagaaactgtgcaacatgcccagatcatacaacaaggaagtaatggaattgagattctatcctgggcgccaagcattgctctaaatctctatgctgcacaagatacagctgagtaaagattagtaacaacaaaaaanaancamcaaaaaaggncaagtcccagggaaggttcctgtgagtctttatgatccactggccataatttagagagaggcat

SEQ ID NO: 10011 - DNA, 326 bp, Homo sapiens
  misc_feature 105: n=a, g, c or t
ataaaaaatgttatattaggttggtgcaaaagtaattgtgttttatttatttatttatttattattttttcctttgagacagagttttgttctggagtgcagcgntgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaa

SEQ ID NO: 10012 - DNA, 361 bp, Homo sapiens
aacaagaattacaaaacttagccagggtgcatcagtaccaataggatatcatttttcaaagatacctattgagtgcagaaaaggaacatctgaaggaacgcctgacgagtctgaacccttggcggaaagaagcctgagtaggctgaacacttggtggagggagcgcctgatgaggctgcacgcttggcgaaaagaacacccaacgaggctacacccttcgtagagggaacatctgagattatcgcatatcctagaaaagaaacatctacaaaagcaaatacaaatgggtttcactatgttggccagagtcgaactcctgaccttgtgatccacccacctcggcctccaaaagtgctgggat

SEQ ID NO: 10013 - DNA, 514 bp, Homo sapiens
gtaagttcatactaactgtttaaaatggcagccagagctacagctatccaatcaatgttctagtcagtagtaggaggaatggaagaaaattgttggccacaggagaaatttgacaaagtgcatagaagccacccgatgctactgatcattctacagttcacagraaaggaaaactgagtctcaaaaactatcttgtacagattctcagacctaccatgggatggaacttaattatgagccccagactccaaaaacatcacatcctaccagattcatggctgaagcgtctgaaacaagactaacaagactaacgagattaacaagagaaaaacatacaaatttttaaaatataagttgtatgtgacatagaagcatttataaagaaaagaagaccagaagaaacgggtagacctgggtatttttatgctacttttgatgaaaatgggaatgcttttggagacgcatgagtgaataaaaaaatatgatctaatggtaataaactagaggaaacagr

SEQ ID NO: 10014 - DNA, 476 bp, Homo sapiens
atattttctaagcccagcaccaagtgctgtgagtctcctgactgggcctgccacagggagaatcgtgatctttccctggactcaatacctaggtcatgtactctcctttctacctagacccagcctacaagggtgtgattttgacctataccttttcctagtacctgagtgatttgcctctttagcctgggctaatcccacagataggattgtgacatatacctggcacaagaacctagggggcattgttacatattcctggcccagaacctaggtgatgtgactctcctacctggtcactgctcacaggtaggatggtgactgtcaaaccaagattcaacacaacattgagaatatggctgccctgctaggacgttgttcacaggtggagttgaggctgtcatttatggatcttgtccaccattgagattccgtctcacacacttgggcacaaatcacagaaggtggtgactctc

SEQ ID NO: 10015 - DNA, 289 bp, Homo sapiens
agaataatagagggttccgtctatgaagaagggtaactcctgggtcacagtgaattagtgascaggcaggattccagaggcctttccttcccacttccaccttgaattccaacttaaaatgcaagccatgtacagagaatgaacagagggscagaaatgtgctacgtttgcctgtgtataacagccaccadctattacagaagaagaatttgtaagtatcatttcaaggggctatttttttctttggsctttaaaaaaatagcaaatattagatcatagaagaaaaaam

SEQ ID NO: 10016 - DNA, 411 bp, Homo sapiens
  misc_feature 383,386: n=a, g, c or t
aattgatttcaaaccaagatgtaagtctaaattgaagataaagtgaggatagtccttagcttatttaagtacttaatgcttaggaactgtaactaaacaattgggacacttggaaagatatcacctggctgcaaactacagttatttggttaacaaattttcactggttttgggaaaaacagacttagaatagggagacatactcctgtcgtccaacattttggtgataatcaaggacaaatttgaaaaagtgaagaaactgtgcaacatgcccagatcatacaacaaggaagtaatggaattgagattctatcctgggcgccaagccattgctctaaatctctatgctgcacaagatacagctgagtaaagattagtaacancanaaaaaacaacaaaaaaagacaagtc

SEQ ID NO: 10017 - DNA, 246 bp, Homo sapiens
gactagtataattatcatggattagttgttatagatagacccacatcaactgagactttctccttggcttcatcaaagattgaaggggaattgataggtaggcggtctctgtaccaccttgcaccatgcatgtacaccagtgagtaacacgtgtgtyccccaatctggagaatatctttctatggaataaaccccaccattctttgtgtaggattcaaaaaaaaaaaaaaaaaaaaaaaaaaarar

SEQ ID NO: 10018 - DNA, 432 bp, Homo sapiens
  misc_feature 338..339: n=a, g, c or t
aagggaataaacgcaggctgccagagsasvagcggcgaactgctggggtccctttccatgctgtggaagctttattctttcgctcttcacaataaatgttgctgctgctcactctttgtgtccaggccaactttatgagctgtaascctcactgcgaaagtctgcagcttcactcctgaagccagcgagacgaggaacccaccgggagggacagacaactccagacagaaagaacgaacaactccagacagaaagaacgaacaactccagacgcgctgcctttaagagctgtaatactcaccaaaggtctgcagcttcgstcctgaaacctgsmwtrnnatgaacccaccagaaggaagacactscggasacagctgaacatcagaaggracaaattscggrcataccatctttaagaactgtatcactcac

SEQ ID NO: 10019 - DNA, 502 bp, Homo sapiens
acattccaccttctgcccattccacctgagttactgagttggcaaagaaacaaattcttttcattcccattccacctgagttgctgagttagcaaagaagcaaattattttcaatcccaaagctaagaggcatcagtcccatacaacaagcagaaaggcagtccaaagatggggctgagagtcacactgtcagctcaggagtcacagtgcctgggctccaatcccagatccaccccattgtaacctgggacaagctcttcaatatctgtgtgtcttagtttcctcatctggaagagaacagggcggasaggatgggcagacagagacaacgtccagcacaggcatcaacatcacaggccaggagggcttccagaagccatcactccctcccctgcctccaggagggtctgcacacccacctttgtcatgaaaggctggtctccttgttctagaacacatcttccctatgctctcctgagtaaacatcccagtgattctctaa

SEQ ID NO: 10020 - DNA, 326 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccsmrtcctggcgacagagcgagactctgtctcaaaa

SEQ ID NO: 10021 - DNA, 141 bp, Homo sapiens
  misc_feature 91..92: n=a, g, c or t
aagaagtagagttgcggttccctcgggagaggggcggaggctcagaggtgcaccacgtggggtttgctgccggagctgagtctccggccgnnmtccagtttgagtctaggttggagttggaaccgtggagatgcggaagga

SEQ ID NO: 10022 - DNA, 445 bp, Homo sapiens
  misc_feature 10,155,368,374: n=a, g, c or t
actctatcgnbcaggctggagtgcagtggsgggrtctcagacccctgcaacctctgcctcctgggttgaagcaattctcctgtctcagcctccctagtagctgggattacaggcgcccgccacctcgctcggctagtttttttattttagcagrnacggcgtttcaccatgttggccaggctggtctcgaactcctgaggcaagagaatcgctcgaacccaggaggcagaggttgcagtgwggcaagatcacgctactgcactccagcctgggtgagagagcaagactctgtctcaaaaaataataataataataaatgatgaatgatttatattttcttcttcttgcttactgatattttctaatknaddkmnaagtgaaataaatgttccttctctaaaaattttttttcaataaaattattaggttgctcttgtttctttta

SEQ ID NO: 10023 - DNA, 212 bp, Homo sapiens
gtatggagcttccggaagtcttggcggctgtaccagcgctaatgttcctccttttcctgaggtggagtgggccgaagaggtggtcaggttgggaaatttagtgagaagcctgggtggggtgttgctgcggtaccatgttataacctggcaagtkggacschtkrtwagtgwcgyaattsctggagtagctcctgagtttccgcagatgagcc

SEQ ID NO: 10024 - DNA, 119 bp, Homo sapiens
aatttttataaacttttgttctttcttgtaactttttatcagtcagctattccaatgaagcaaaatctgataatatattgcttttatactaaaaaaaaaaaaaaaaaaaaaaaaaaaaw

SEQ ID NO: 10025 - DNA, 337 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagctycccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaaw

SEQ ID NO: 10026 - DNA, 146 bp, Homo sapiens
aaatatatgttctttctacatcacccctctttctactaaaaataatctcagtaagattattattattattattatttttgagacagagttccactgcactctagcctgggtgacagagtgagaccctgtctcaaaaaaaaaaagam

SEQ ID NO: 10027 - DNA, 468 bp, Homo sapiens
tgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggraactgarggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgact

SEQ ID NO: 10028 - DNA, 396 bp, Homo sapiens
tactcagcatcgctcagggcactgcattacgccttccaggcaattatacaaggtactgcttgagcttaagcaaactgagagaagatttagcacactttctaaaggtaatatcataaatagacattgattccmatcattttgtttattttgagatggagtctttctgtgtcacccaggctggagtacagtggcgtgatctcgtctctactaaaaatgcaaaaattagctgtaaatggtggtgggcacctgtggttccagctgctttggaggctgagacagaagagttgattgaacctgggagttggaggttgcggtgagccaagattgtgccattgcattccagcttgggtgacagagtgagactctatcttaaaaataaaataaaatkkatttatt

SEQ ID NO: 10029 - DNA, 436 bp, Homo sapiens
ccaatctatgtttcaattagtaattcaagtaattttgatgtacattgagtttgagaaccactggcttagagcaataaagatccatcccttggggctagggaaaggcctagcctcctttgaaggatatgaggccaagaagaggagaagagagaagggggaagaatgaatgttagataggcaaccaaacatgtttacacaattcttcagggagtatgatctttcttacttagtgccagctactattgctgccctcccttcttttattctctgtgtgggcctcaagatgccatactgatctacctgcttaatctctgaaggagcacactgtatctcaaaaatgtgacgccttagttgcttctgattatcacaccactgtggctatgatttgtttgtttgctgtgaagggcttttagtttctttagattataaaaatagg

SEQ ID NO: 10030 - DNA, 452 bp, Homo sapiens
  misc_feature 340..341: n=a, g, c or t
acttctcttgctggtgactcattcagaaatcccaaagttagtcctgaaccccaggactacctcttattttctgggagaaccaggacaaatcacttgcttttctatctctttacccttcatgggtaccgtgactcacattataaactcgctgagggtaggaccctgcttctcatttgtgaaaaacgagttcgaaagacggtcttgaaaaattccttcaaagtatgaaatcccacgcatgcaaaactccgtgcctgtctcttcgtgatactctgaagtggtgcgcgcacacagtgggtaaccaaggatgagctcggtgtaaggaatggaaagcccccagtvnnaaccaccgccccctagacacgggtgaaaacctgcctaaaagctaactcaggcagtgactctatcacccgaaggsccctaggcgcggcgaccgggcttttgaggacacttac

SEQ ID NO: 10031 - DNA, 471 bp, Homo sapiens
  misc_feature 422: n=a, g, c or t
tcctttcgatgtcgacgggaggaaactgtcacgcaggccaccaaccggcggtggagggcgcggtgccgagtcctgccactgcagggtcgccccgctggctcaagctctagaagcgtagacctccccagccgcaaaaagcaactcacgcggcgaaaccgcggactcttttgacccttccgagctaccatttactttccatagaggggcgggacttcctgtttcgcttttatcttctcgagtgcagtggtgagaacacggcttactgcagcctcaaaatcctggacccaaaagatcctcccacctcagcctgcctcccaggtagctgggactacaggcgcacaacaccatcgcttcttggattaaaagaaaaggatgaaacgggccccagaaagaggcggtgacgtcccagaacccatgdswwngggagttgggaaaataaatatttgtattgttttaatctcccttgtggcc

SEQ ID NO: 10032 - DNA, 564 bp, Homo sapiens
cgtcccgcgctccgcttggcccaagatggcggcctccgtgtgcagcgggttgctggggccacgggtgctgtcctggagccgagagctgccttgcgcttggcsgccctgcacacctccccggtctgcgccaagaaccgggcggcccgagtacgcgtaasaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtacttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagacaatccccttttttccatcaagctgtagctgcagaga

SEQ ID NO: 10033 - DNA, 463 bp, Homo sapiens
agcaacgtgctcgggtccccttccacactgtggaagctttgttctttcgctgtttgcaataaatcttgctactgctcactctttgggtccatgctgcatttatgagctgtaacactcaccgcgaaaatctgcagcttcamttctgagcccagtgagactacgagcccaccgggaggaaggaacaactccagatacgctgccttaagagctgtaacactcaccgcgaagatctgcggctttattcctgagccagcgagaccacgaacccacgagaaggaagaaactccgaacacatctgaatatcagaagggacaggctccagacacaccaccttaagagctgtaatgcacaccgcgagggtccacggcttcattcttgaagtcagtgagaccaagaagccaccacttccggacacaagataatgccactgcactccagtttgggcaatacagtgagactctca

SEQ ID NO: 10034 - DNA, 461 bp, Homo sapiens
aagctcccagaagacagaggttttgttcagttcactactggattcctaatacttggaacagtgcctggacagagtaggtgcttaaaacttatttttgagtcaatggataattgacatggctggtttgaacttctggatcttttgctttgctttcacacaaggattacttataccaatactttattttaaaatctctggaaatgagaccatctgaaatcagataaatatggcttcagataccagctctggcactactagttgcatgatcatcaatatgttacttctctgtgccttagtttccacatctgaaaattgagggtaagagtccctctctagatttgtgaatgggatgaacacaggattttaagtacggttagccagcatccaagatggcctcaatgatctctgcctctggtatttatgcccttgagtaatcccattccacatgtctcgggttggtc

SEQ ID NO: 10035 - DNA, 439 bp, Homo sapiens
  misc_feature 156..160,182,368: n=a, g, c or t
catacagattaatttaatataaatttttttttattatactttaagttttagggtacatgtgcacattgtgcaggttagttacatatgtatacatgtgccatgctggtgcgctgcaccactaactcgtcatctagcattaggtatatcccaatgctnnnnnctcvcccctccmmccaccckancacagtccacagagggtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcatttttgatggctggnvagtattccatggtgtatatgtgccatattttcttaatccagtctatcattgttggacatttgggttggtt

SEQ ID NO: 10036 - DNA, 86 bp, Homo sapiens; identical to SEQ ID NO: 9617

SEQ ID NO: 10037 - DNA, 478 bp, Homo sapiens
tttgtgtgtgaaagtataacagataggctagtattcacaagccagagtcattcccaaattcttgttctcaacggagcaataatattttttaaattactcttttttattgactcctcactcacctaagagtgcacttttatctcttggcagtggtcatttaatggtttatttttttctgcccaaacttacatttttaaagataattcttgaatgcgatctgaaacaataattgtgacggagactgtatagcgtctgaaaatgtcagatccatcacatatcttgttgttgtctataaaaaagtaacatttgctcagtcctttgttccaagctaacctacgaaccccatctaagtatatgctctagaaatatacgtgccaatgcactttgattcctactacgttttatcctttgactctcaatttgaagagtttcctaatttacagtcctgacaaaataatttataagttctgtcatcccc

SEQ ID NO: 10038 - DNA, 288 bp, Homo sapiens
agttccagcggcggctacggtggtggcagttccggcggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggataaaaaaaaaaaaaaar

SEQ ID NO: 10039 - DNA, 393 bp, Homo sapiens
attatttttttgacagggattaaaactgcctatgctaaatatctggattctttacctcctccctggttgggccactgttgtatgttaagagttagacacttcatgtcgtgagcagttgagccagccatgtgggatcaatttcactgtgaacccacaggactccaaaccatgccttttttgttgttgctattcaaagtgaatgctgagatgtaaggtcatctcccactgcctgtgtctgctatggatgtgagctgcaatgtgacaggaggcccccaagattagaaggcagcctggcaaggcaggacggtcagaagatggggctgaaactccaactcacttcttggctataggttccttggcacgtcattttctctgtttttttttttttttttc

SEQ ID NO: 10040 - DNA, 435 bp, Homo sapiens
gctcttgtttactctctctcagcagcatcatgtaagatgtgcctgctcccccttccgccatgattgtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggcbwcatgagaagtggttchtaacttgatgtatacaaattttctgagaagattatttaaaaagtagtttccacccaatccaaggattccgattcagcagggctgaggtactccgaagcagggtatggattctgctttcatcttccaac

SEQ ID NO: 10041 - DNA, 433 bp, Homo sapiens
  misc_feature 364,366: n=a, g, c or t
attctcctgcctcagcctcccgagtagctgggactacaggcgcctgccaccacgcccagctaatttttttgtgtttttagtagaaacagggtttcaccgtgttagccaggatagtcthgatctccggacctcgtgatccgcccgcctcagcctcccaaagtgctgggattdyaggctcatcaagagttcatataactagacctgtcttggagcaatttttatcttttgcaaaataccttgatggtttatctcatggagcacctttgctgaagcagctttgtgatcatattttgtttattaacccaccatctggatacatacacctgcaaaggttcaactttccctatatacatatttgtctgananatttattggaactgctaccatctacaccaccatacgcagaataggaacagttattaaagataatgca

SEQ ID NO: 10042 - DNA, 483 bp, Homo sapiens
acactgcgcagaaaacgtgttggcggccgcacacaaactctcggggcccaaacaaacacaggctgattccactgggcgcctctgctccttggacagctgggggagccaaggggctagtcttaggggattgggggccgctcccttctcaggagggtttcgctaccagggcattttaactggagtccaagagcccatgcaaacgcacgccccgctgcgacaactggccttgcctgagtgaaagtccgtaacgcaggcccccaaccacgctctccctggcacggaggacacaggcgccagacgggtccagctcagggtgttaagaggaagtaagggagggagggaggagagaaggaaggaagacagaaccatcagcaccgtgactggcccggcccggccccgaccccagcaagccatacttacttcttcacgttggcctccccgttgggatccttcgcaacttcttcttcttgaggatcttgacgg

SEQ ID NO: 10043 - DNA, 437 bp, Homo sapiens
attttcagtctcagaggaatcattttgtagtatactcttggtcatgcctataggagtcagggacctagcctttgtttttgagggagttctagttattggcaaagttatccaagtgcaaatataaatttttaaatgtaaattttaaaggtttcatatgcccggttattgtcccaaatgcacatgcagaaaaataagttgtgcctgatgaactaaatgtgggctaaccaacagattaatcagaaagtatgtgtaattgtagacaatgaatttttttgtctctcaacctaatgtacagttattttgaagtgaaaggaaactatatctcagggaattatatttagattgtcttcctttttctaagaaataaaaactgagtaaaaaaaagacaaaatttaaattcaaatgggcaaatatatttttgtcaaatgtatattttt

SEQ ID NO: 10044 - DNA, 461 bp, Homo sapiens
  misc_feature 197: n=a, g, c or t
ttgtctctactgatatgtcttattaacatctgahaaaatatatattttttattggwaaattctaatttgttaggccttgaaagttttgtgacaattattttgctgtgtttaaccacaatcattcaccttatggcatgctttgattactagacttcaggcagtctcattcattgtatcatacttacacacaattagcnagttgtctccatgtgtgctatatgtctgaggtgtatggagtttttatttaaaaagtgtgccagtctgaatataagcatttgattttgtaacattggacttttcttaaaagtacagaggttcaaagtataggtatgtccattggcataagaatagagtgggtgagggtctggaccaggttccaggttggtccagtcwgatgccagaacawagaagaacagtcaactaaactggtctacttcaaaaatagtgggcctgtgtgaaga

SEQ ID NO: 10045 - DNA, 135 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaaaaaaaaaad

SEQ ID NO: 10046 - DNA, 72 bp, Homo sapiens; identical to SEQ ID NO: 9589

SEQ ID NO: 10047 - DNA, 78 bp, Homo sapiens; identical to SEQ ID NO: 9745

SEQ ID NO: 10048 - DNA, 230 bp, Homo sapiens
  misc_feature 169..171: n=a, g, c or t
agaatagcttgaacctgggaggcggttgcagtgagccgagattgtgccattgcactccagcctgggcaacggagtgagactccagctcaaaaaaaaatgtatataggggcacacatttttacctctggcctttggattctatatggcttagcatggcactcctgaatcnnntctttatttaaatttgtgttttttttcgtcatggacctttttttttttttttttttttk

SEQ ID NO: 10049 - DNA, 162 bp, Homo sapiens
acaactcgcggggattgttttccacactgtggaagctttgttcttttcgttttttgcagtaaatcttgctgctgctcactttttgggtccacattgctttcatgagctgtaccactcaccgtgaagatctgcagcttcacttcagagcctagcgagaccacg

SEQ ID NO: 10050 - DNA, 391 bp, Homo sapiens
gtgtggttcagtgttctgtgggctgtagcagtgcccctaatggtggtttatacccatattaaggaggatgtgtagagtgtggtaatggtagtgactggagtgtggtaagggccttcctctgatgctaataatgtaacagtttctcggccgggagcagtggctcacgcctgtaatcccagcacttcgggaggccgaagcgggcggatcacctgagaaaagtcctccatacattttctccccaattccattccttgggcatgccatagcattttgggaaaagtccaattgaaatttctagaaatgcatatgagaagtatggacctgtatttagttttaccatggtaggcaagacatttacttaccttctggggaktgatgctgctgcactgct

SEQ ID NO: 10051 - DNA, 120 bp, Homo sapiens
aatttttataaacttttgttctttcttgtaactttttatcagtcagctattccaatgaagcaaaatctgataatatattgcttttatactaaaaaaaaaaaaaaaaaaaaaaaaaaaaaw

SEQ ID NO: 10052 - DNA, 329 bp, Homo sapiens
cccggaactgcaccggaagcctgcatgggccgcccttgtccgagggcttgcagccttacccagctttcccttttccttacttggatacttttatgaccgttttcctgccwracccccctgtctgtcctctgttgtcgccatcgtttttgccatgtccattcctgggggcgacasyccttctgcgatatcaccctcaatgtcgtcagcaatgagtccaactctggacccacccccttcagtcaccagccaaaggagagaggaggaaaagtgggaggcacaaagcgaggggcaccgttcattacttcgagaagcagctcacccttgcagtt

SEQ ID NO: 10053 - DNA, 438 bp, Homo sapiens
ccatctcccaatagaactttgaaattcactcagcttttcctttcatgctgtttgttgcctgcttgttgcactcctcctgssccagaactgcaaggtttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagct

SEQ ID NO: 10054 - DNA, 120 bp, Homo sapiens
ataaaaatggtgtgataggccgggcgcagtggctcacgcctgtaatcccagcactttgggaggcccaggcgggtggatcatgaggtcaggagatggagaccatcctggctaacacggtga

SEQ ID NO: 10055 - DNA, 227 bp, Homo sapiens
  misc_feature 77: n=a, g, c or t
agaatagcttgaacctgggaggcggttgcagtgagccgagattgtgccattgcactccagcctgggcaacggagtrngactccagctcaaaaaaaaatgtatataggggcacacatttttacctctggcctttggattctatatggcttagcatggcactcctgaatcctgtctttatttaaatttgtgttttttttcgtcatggaccttttttttttttttttttt

SEQ ID NO: 10056 - DNA, 94 bp, Homo sapiens
tttcctttcgtctcccccttcttccctcttctgtgctctcargactttccccctcttgctgccgcagggtaactggctgtgtaragaggctgct

SEQ ID NO: 10057 - DNA, 430 bp, Homo sapiens
ctggaagcatttttataccatcttgaaatttcaacaaactggcttttgccrttaatccagctgtctttcaagaataaaagttggggttttcaaggatcgcctcttctatattttaaatggattttbagtagaaatgattttkactaatcaagttaatcccaccccatcaaaaggtattcctagaaatgtcatagacctaggtaactttgaattgaatgggagctaacgttctttccaaagttttcaggtattctttgtgtgacaccttctcaaccaggaggcaagtaaccccgcctccacaatcttagtattttttttaaactgcatgcctgccccttatttgagctgcctttttaatttattgcatatcctttttattatcttattttggtattattcaatctatacaatctttttgtatttattgggg

SEQ ID NO: 10058 - DNA, 473 bp, Homo sapiens
  misc_feature 337: n=a, g, c or t
ttttttcagtctgccccatgagggcaccagctcccatgtgagggaaaagccttccacatcttcagaatccctcctgtctggggctgtgtgggccccagggcgcatgctgtaaattatctgttaattggattaaccaaaagcaagcagccctagacagggggctcagaagggattcagtgacctcagaggaagggattcagtgacctcagaggaagggattcagtgacctcaaaggtcgtgcatctccagtgckctdccatggtggacgtaaagactggtgtttatccagcccttgctgtgcaccagtcatggtggaaggaatcatgkgagtatcarntcattgagcccccaccacctccctgagactgaggtcaatgtccgcattctayagatgaggaaagtcggactcaagagaaaccgaragacccgcctaagggtcagaaccagcttgctgyaggakagtcaggattcga

SEQ ID NO: 10059 - DNA, 161 bp, Homo sapiens
  misc_feature 91,97: n=a, g, c or t
aaaaaaagtactgagaccgggcatggtggctcgcgcctgtaatcccagcactttgggaggccgaggcgggcggatcacctgaggtcggganttcganaccagcctggccaacatggtgatatcctgtctctactgggaactacagagattaaaaaaaaaaa

SEQ ID NO: 10060 - DNA, 344 bp, Homo sapiens
ataaaaaatgttatattaggttggtgcaaaagtaattgtgttttatttatttatttatttattattttttcctttgagacagagttttgttctggagtgcagcgtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaawtgcgaaaa

SEQ ID NO: 10061 - DNA, 496 bp, Homo sapiens
  misc_feature 275: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccanggagaaaggtcaggttacccacaaagggaagcccatcagactaacagcagatctctcggcagaaaccctacaagctagaaaagagtaagggccaatactcaatgttcttaaagaaaagaattttcaacctagaakttcatatccagccaaactaagcttcataagcgaaggagaaataaaagcctctacaaacaagcaaatgctgagagattttgtcacca

SEQ ID NO: 10062 - DNA, 382 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaacccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaaattsctggttttaaa

SEQ ID NO: 10063 - DNA, 272 bp, Homo sapiens
  misc_feature 125,207,227,232,263: n=a, g, c or t
attttgtggcccgctatggcgcggtgttgaggttgggtccgggatgcggggtctttgactgaaggggtaggccaagtggaggtatcagggacgtcgcgsggcacagaagaggaccagcctggacnscggggacgctgtcatgtacggcgcgasgggggccgcgcaaacccgagaggaaaagcggcgcgaaggaggaggccgggccangcggtgcgcggtgggggcanccgantggagctcttggttttcggstatgctgcaanctgttccgg

SEQ ID NO: 10064 - DNA, 530 bp, Homo sapiens
aagtatacattttctggccaggcccagtggctcacgcttgtaatcccagcactttgggaggccaaggaggtcagatcacttgagatchgbagttcaagaccagcctggccaacatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagggaaagcccctcaaaccattttgtattctgtattacacttcagaaagtgtggaagcaaaggtcatctaatctttaaaakctcttaaagtgatcctgaagactttagttctacaaaatgtgaacttcttatggaccattaaagtggggagtaatctgctgatttttgtctagcaaccctacctctgatgcaggataatttttcawaaccgttgttcttcctatagctgtataatagagatattaaagaggaaaaatacttgtgtgttgctgt

SEQ ID NO: 10065 - DNA, 473 bp, Homo sapiens
aaaatcttggtagaaatgtaaatttccatatgccatctgtgatgtgattaaaaagttttcctccaacactggtcctcctactcaaccctgtcctaaagctccaactgtctaacacacttgtaacttcattgtctaactgctaccatgtttaaaaccaagacacacacacacacacaaacacacacacatacccstctgaacdktgtccatcttcctgctaaaatcaactccccttgctacttattctatcatctttgaatatttttgcttcttacatttattgtctttcaactcttaacacagatccttaggggaaagaggatgtgtaactgtagtgttgttatcactttaataacagtagaaacaaccacaattagcaaatactgagtgcttactattggttatctaatattataagcacttgctgaaatctcacaagagccctaagaggtattattgttagccccacttta

SEQ ID NO: 10066 - DNA, 398 bp, Homo sapiens
  misc_feature 380: n=a, g, c or t
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaacccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaaattyckggttttnaaaawttaaaaaaaaaaa

SEQ ID NO: 10067 - DNA, 170 bp, Homo sapiens
ctcagcatctggagtagctgggattacaggcacatgccaccacgtctggataatttttgtatttttagtagagacggggtttcaccatgctggtcaagctggtctccaabtyytgacctcaagtcatctgcccgtgtcggtctccggaagtgctgggattasagggctgg

SEQ ID NO: 10068 - DNA, 404 bp, Homo sapiens
  misc_feature 357: n=a, g, c or t
aatgcggggtttggtgttgctcaagggaagtcgatgtgtgaacatttggaatataggaggccaaggaggaactgagatggtttaaaaaagggataaaagagaaggaaaaggaactcctactatgccaggaacagaaagccactgtcctactgcattcaccttttggaagttgtcttcactttaattctctcctcaactctaatatttgccgtctggtgatttagtaaaatgttgaccaagatgacgtcagaaacttgattagcaccaacgagagaactctccagcacctcaatactcaactgtccagcacctcaatactcaactctccagcacctcaatattcacggagcagtccanggagattggaagcattcatttcaactgggaagcttgccaggaaaggc

SEQ ID NO: 10069 - DNA, 103 bp, Homo sapiens
acctctactgcagctccagcaactgtgttggtgtttgtggcttttctgaaaacacgatgaagcatcgtgaagataaatatcaaagacagtgaactaacaacca

SEQ ID NO: 10070 - DNA, 120 bp, Homo sapiens
agcaccaccgagaagatccacaacctgattcccgtcatgctgaggcaccgtctcgtccccccacccgaggaaacctactccctgcacaggaagatggggggctccttcctcatctgctcc

SEQ ID NO: 10071 - DNA, 261 bp, Homo sapiens
  misc_feature 114,174: n=a, g, c or t
catatgttctcattctttttttttttaatcactgcataatagtccattgtttgggtgtgctcgtttattatccagtttcctagaaaaaacgaacttaaggctaggcasattgcncatatttgaaatcccagsactttgggaggcctagacttgaggccagaagttcaagrccanactggtcaatatagtgagaccccatctacataaactaaaaagttagccaggtgtggtggtgttatgtctgtagtcccrgctatttgg

SEQ ID NO: 10072 - DNA, 322 bp, Homo sapiens
agttgggatgaaaatggcggatgaggccgggcgcggtggctcagcccaaaaattttggagagtagaaagtaaactttggaataaaccraagaaaagatgccaggttacatgttagaggtacctagaccatatgacaaggatgtgatattcaaattagaatctctccttctagttcctctccctctgttcctttccctttgtartttgtagacatggttawgactttactcctaagctcattgtgtgatgagtatctatctcttttcaagggacaattaactctttttaaggactttcrtatcaagtaactcacgtggtgctt

SEQ ID NO: 10073 - DNA, 509 bp, Homo sapiens
attgtcttcaagctacactttcatagcaaatatactgttttaattaagattagatttaaggttagattttatttggaaagatgggggtgtatggccaagggatatttatggctggacccttttcaagaggctcactgacattgatggatattaataaagttgatgctataaagtttcaccaggaatggcagaaggatgaacctgtcaagtaagcacaggccgttccaaagcctagtctaggaatcattgcgccagactgggaaaagtctttctcatctacatggtacaggaactgcagagatttctatggaaaaataatgaacacatttaagaaaagttgaaatcagagttttcttctaagagaaaatgaaaacagtaataacacccagagagatggcctgaaacttggttgtttcaaagaaagctgttggcccatctccccacttcacctgactcccattcccacacaggcaacccaacacattcaaggtcatgtcggaacagctaac

SEQ ID NO: 10074 - DNA, 399 bp, Homo sapiens
  misc_feature 186: n=a, g, c or t
cagagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaanggaaccgcccagccatcctcacctaccatgatgtgggcctcaaccacaaactatgcttcaacaccttcttcaacttcgaggacatgcaggagatcaccaakcactttgtggtgtgtcacgtggatgcccctggacaacaggtgggggcgtcgcagtttcctcaggggtacagttcccctccatggagcagctggctgccatgctccccagcgt

SEQ ID NO: 10075 - DNA, 484 bp, Homo sapiens
  misc_feature 46: n=a, g, c or t
accggcaccacctccaccctcgccaactcagctcaagcccttkkgnccacctcagttyccaacggccgcctcctctcttcagtgccacagccccgagctcttatattggtctgtagctcggtatcwccgcctaaagcttccctggacagcctgagagttgagcaaargttcccggcctcagadggtaccctacaaaaakgaccagatgtctagagcattggctactctccttgcaaaatatgaaaatgaaaatatattcatatatataatttatgtgtgtgtatatacacacatttacatacatagatttgtcacatagcactgagtccattcttctgtttcacagtaccggaatttaagcccccctctccccagccaaagaggaaaggactgatctaaggtcattttttatctgggactaagtacaacgtaaaggtaataggctgggcctggtggcttatgctacaatctcagcgcttttgaa

SEQ ID NO: 10076 - DNA, 292 bp, Homo sapiens
agatcttctaggcttcagccagaagtggcacattggccagaacaattcatctgaccactcccaactatgagggtagctggggaatgtggggaagcagatggactattttttgagcaccattactgtatctgccaaggctgatacaagcagttaatcctctggtctatttcttttaaaggagagttgagaattagcttttctgttttttccacccctccccttctctcccctcctctcttctcttctcctcttggaatatctgtatctgtatgtatctccaattacagtttga

SEQ ID NO: 10077 - DNA, 316 bp, Homo sapiens
ataaaaaatgttatattaggttggtgcaaaaktaattgtgttttatttatttatttatttattattttttcctttgagacagakttttgttctggagtgcagcgtgtgatctcakctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactct

SEQ ID NO: 10078 - DNA, 390 bp, Homo sapiens
  misc_feature 384: n=a, g, c or t
ccttaattagactcaggaaacaatgggtttttgttgtcgttgttgttgttgatgttgtttttttatatgcagtcttgctctgtcacccaggctggggtgcaatggtgtcatctcgattcactgcaacctccgcctcccaggttcaggcgattctcctgcsttagcctcccaagtatctgaactacaggcatgtgccaccaakcctggctaacttttgtattgttggccgggctggtctcaagctcctgacctcaaatgatccacccgsstcagsatcccaaagtgctgggattacaagtgtgagscaccgcgcctggccttgttttgttttcttatactcataaatagagtgttattgtgggggtgggtttagtggtggggatnaacttc

SEQ ID NO: 10079 - DNA, 498 bp, Homo sapiens
atgactgacctttttgtttacctcctgctctttttctttctaaaacgttaataatctagtaatgtgttcaaataatgtattcattttgtcttttccaatgatcttaaccataattctaatattaaaatgagaaaatataaattaattattttctatgaccataactagctgactcctgattgtatgagcttatgttttaaaatacattttctagccaggtacagtggctcacgcctgtaatcgtagcactttgggaggccgaggtgggtggatcccctgaggtcaggagtttgagaccagcctggccagcagagcaaaaccctgtctctactaaaaatacaaaaaaaattagctgggtatggtggcgcatgctgtaatcccagctacttgggaggctgaggcaggagaatcgcttgaacccaggaggcggaggttgcagtgagccaagatcatgccactgcactccagcacaggcaacaaagcgagactccctttcaa

SEQ ID NO: 10080 - DNA, 223 bp, Homo sapiens
tttaattatttgttcatcagttgatggacattttggtgttttcacttttggctatttttgagtaatactgctgtgaacattcatgtacaagttttttgtgtggacataggtttttatgtttataaaacatgttttatgtttatgtttttatgttttatgtttatatttctcttgggtacattccacctagaagtggcactgctgggtcatatggtaacttttt

SEQ ID NO: 10081 - DNA, 472 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtaasacttgtgcctasctgagccaccacgccggcctaatttttaaattttttgtagagacagggtctcattatgtt

SEQ ID NO: 10082 - DNA, 284 bp, Homo sapiens
atgatgcgcagaaaatggaagcaactggcctactgtatactaaaacagctcagctccaggacctaacccactgcattaaaaggaggagcgagaacaagtgagggggccacacagaccctctcctctggttactatgaactgggctcacctcccgcagttggtgatttcaccttcaaagtgaatagcagcatggcattgtggaaagcaccctccctggaccagtctgggaatccatgaacaaattctcttgctgtaaaatgaaaaggtcagaactttgctcccta

SEQ ID NO: 10083 - DNA, 410 bp, Homo sapiens
  misc_feature 94,121: n=a, g, c or t
catagatataggacatttcattctcagaaagttctagtagagagacagtgctggtatacattgccctttttcttcctttcttcccttccttctnccccctttccttttcctccttccttsnscccactccagtcttcctksccctcccttcccctgagcttaactgatcctcccacttccccctcccaaagtgctgggattacaggcttaagctaccactgcaccagtctaccttgcctcttcatatctttgtcagcatcttctgccggggccggctagtacatgcagttttccatccttaggtttcacagaagagtttccgaatttcctttgtcatttatgtatcaccattttcatattaactaattaaactctacctctcagcccacaatggacatgttcagaatgca

SEQ ID NO: 10084 - DNA, 407 bp, Homo sapiens
aattctttttaccgtgagcttcacttccctcggtctgggcttctctgaggcggcgagagatggtcaggtctggagctcgaccgggccagactttttaaaactgtggacttaaatgttctgcaaagtcttacacaaaagcccaatacagtacatgaactacggaaaagcagaactgctctgaacaaggaagaggtgggagatctgagtcctggccccagcacccacttcaacttcagtcacctccttggaatctggggttctgcagcttgaaataatcagtttggattttaaacttatttgtaacataataataatcctaggaactttaaaataatattttgtactaaattttagaattattataataagtgatctaataaaacagtcttttcccgaaaaaaaaaaaa

SEQ ID NO: 10085 - DNA, 345 bp, Homo sapiens
  misc_feature 213,326: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccangcatggtggcacatgctgtagtcccaagtagctgggattggaggtccccaccaccatgcctggctaatttttttgtactttcagtggagatggggttttgccatgttggccangctgttctcgaactcctga

SEQ ID NO: 10086 - DNA, 136 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaaaaaaaaaaat

SEQ ID NO: 10087 - DNA, 461 bp, Homo sapiens
  misc_feature 107: n=a, g, c or t
aaggaccaggactagggcgagggcagcggtccaagaaatagaaaacaatgactgggagagcccgagccagagccagaggaagggcccgcggtcaggagacagcgcmnttggggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtggccttatatcagtatcacattgactataaacccact

SEQ ID NO: 10088 - DNA, 519 bp, Homo sapiens
attctattggccaagcaagtcatcaaggccagctcagattcaacaggatgaggaggaaattagcctacaacttctgatgcgagagtgtcacattaggaaggcatgtggaactggggatgctattgtggtcatctttggaaaatattatcttccatgccctccaagttgcctccagaaaccaaggttacctagagtgtgaacttgttccagatcctgcttcccccaagtgtaccccattatgaaagcctgttttcatcttctcttcactcaaaatgaactttttctatgtttatggcctataaccatgctttcttctgggaaactgaaaaataatgtagattaatgtgttaatgactactgagctattgcctaacactggtaacatatttgtcatcaagccataattttgtcacggtaaatgacttaactcaacataaataattaagaacaatttttgaatattttcaaaatgtatgatgaataataaataccttcttatgggaaaaaaaaaaaaaaatg

SEQ ID NO: 10089 - DNA, 187 bp, Homo sapiens
acagtcgatgtacaagagtagagtatgtttgggaagaaacttttcaacttgaatttgcctcctctatgatgacatctcttatatgcttgtgctgattttctaatttaagagataccatatctctctattcatttctatctctcatttgtatgcttatttttctgagaacaatttttttttttttttt

SEQ ID NO: 10090 - DNA, 465 bp, Homo sapiens
gtaaggtttggtgtgttcatttgagtgggtgccagacgtaacgggcccgggattgaattagtttagatcaaaatttgatgtaattatcgcagagaaacgctttcttgcgagtgtttatctcgagcctgctgtgttcagcatctttcttggtgttttgggagaagcagacaggagttaagtccaagtccccgccctcacagagctcaggtggcttgggggaaggttggtgcgcaaacattaaaattagatatcgacactagtgagtgtccccgtcaagaggtctgtgaaataaggttgagcctacgatgcagaagttaatctcacaagttgtcagattccctagttgaatttgctttggacatcagtgtgaagcagaactgatatgccacttgaattaataaaggaagtcaatggggtgcctgaagttcagccgctgagtaaattacataaagtagatttcggatc

SEQ ID NO: 10091 - DNA, 67 bp, Homo sapiens
ctttttgttgctgcsgccgccgccgagtgtcactttcagcgccgccgcctgcgtctcccaggccgta

SEQ ID NO: 10092 - DNA, 476 bp, Homo sapiens
ctgaatgtttatgtccctcccaaaactaattatgttaaaatcctcaccatcaatgtgatgttacttggaaatgaggcatttgggaggcaattaggattagatgaggtcatgagagtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaacccgtctccactgaaaaaaaatacaaaaaattagccaggcacagtggcatgtgcctgtagtcccagctactcgggaggctgaaggagaagaatcgcttgaacccatgaggcggaggttgcagtgagccaggataacgccactgtactccaccctgggcgacagagcgagactacgtctcaaaaagacatcagaaagcctgcttgctctct

SEQ ID NO: 10093 - DNA, 445 bp, Homo sapiens
  misc_feature 237,264,326: n=a, g, c or t
aggagggtagatatgttctacttcttgacatgtagtatgaacataaaccacagttgattcctgakctgtgatgactttccactgaccatactactgcaatgatgttattctgggccaaacttcggaatcaattcttgtctgctgcctgattcaattatttatcatgcaccctgtggatttttacttgctaaagtagaaagaagatcccaacatttgatgagaaaatatacagaaggnaggctgatcccgggtgcactgtggcangtggcartatagatttttgtgaagcagcagtgtgctgtgatatgagtagcagattaagaaknaaggaaattaagtcactcaattcttatatggcataattactcttatatctggaatcaacatgtggaatttctagatagatggagtctcaatatgtttcccaagctkgtcttgaactcct

SEQ ID NO: 10094 - DNA, 227 bp, Homo sapiens
agaatagcttgaacctgggaggcggttgcagtgagccgagattgtgccattgcactccagcctgggcaacggatrgactccagctcaaaaaaaaatgtatataggggcacacatttttacctctggcctttggattctatatggcttagcatggcactcctgaatcctgtctttatttaaatttgtgttttttttcgtcatggaccttttttttttttttttttttt

SEQ ID NO: 10095 - DNA, 398 bp, Homo sapiens
  misc_feature 121,125,315: n=a, g, c or t
aaaaccggctggagttccgttttgcgatgtggtttcgttcttctttcgctctttgtaataaatcttgctactgctcactgtttgggtctacactgcctttatgagctgtgacactccccangaangcctgcagcttcactcctgaaaccagcgggaccacgaacccatcagaaggaagaaactccaaacacatcccagtatcagaaggaacaaactccagacacgccgcttttgagaactgtaacactcaccgcgaggtctgcagcttcattgttgaagtccgtgagactaagaatcctccaattccgggcacangattatgctgcagtaacaaacaacccaaagtcccaggagcttaaaacaagagtttatttttcaccaaaattatctatttaata

SEQ ID NO: 10096 - DNA, 424 bp, Homo sapiens
aaatgctttgttttagaacatttgctgtkkagctctgcragttaagcaagaccaggcatagccacagagaatgcggggtctctgaaggtcctctttggcaccccagaatttgtggctcctgaagtgatcaactatgagcccatcggctacgccacagacatgtgagcatcggggtcatctgctacatcctaktcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcmstttcagcatccatggctaatgaaagataccaagaacatggaggccaagaaactctccaa

SEQ ID NO: 10097 - DNA, 502 bp, Homo sapiens
  misc_feature 463: n=a, g, c or t
aactggactggcggvcggggagtgaagtagtgaaatcggacctacgcctctccaacgctcgcgtgatcacgtggttggcacccaggcggaagtctgcggcagttctttgcggtgaagaacttgcaaagcgttgctggaaaagacgggagttctactgacactccagtccaaagctaggtgggaccgcctcctgtcgcacgtttccgcctggtcccgcgctttaggagctaggaaatgtgacagaggcggtgcctactgcctcgctaggaatggccgcggaggactggtcacgtggcgtggcttccggcctctggcgcgttcctattcgggaaggttttaaatgcggaktcatctcttgatttgtcagcgaggctttgactgtdagcttcgcgcgttcggcctcaccgcctcaccgagggtrggtctttcgcgcgcagaattgtgtaggattttccaaagggantaaaagccgatcggggcctactttttaacattccacaat

SEQ ID NO: 10098 - DNA, 445 bp, Homo sapiens
aacgattgtaaatatgtatttgcccaatgttggaacacctaaatacataaagaaaatattaatagaactgaaggatgaaacaaatagtaacacagtagtagtaagggacttcagaccccactctccacaatggataaatcatccaggcagaaaatcaataagaaaaacagctgacctgaacaaaactagtgaccaagtagacctaacagacatatgtataacattccattcaacagcagcagaacgcatgatatttttgaatgcacatggaacattacccaggatagatcatatgttaggtcacaaaacaagtcctaacaaatccaagaagattgacataatattaagtatcttcttttacctcaatgctatgaaactataataacaggaaaattggaaaattcacaaatatgttgaaattaaacaaaatactcctgaataacca

SEQ ID NO: 10099 - DNA, 339 bp, Homo sapiens
ggatgctcagggacggtgggggtggcagggcccaccggcttgaggctgcctttcccggcgttccctcgtttattggctcactcttcctttcatccatccatcctttgcgcaacaatatttgatgggaagcctgccaagttttcagattactccatttgattctcacaagaacatcgtaaatggaaaagactagaattgccctgagttcacagattggtcatcgaggtcaaagaaatcaagtgacttctggaggccacacagctaataaacagcaaggcaacgacttgaacccaggtcttctggttccaggtccagagctcttttctctatattctaaac

SEQ ID NO: 10100 - DNA, 456 bp, Homo sapiens
tatttttgaaaaaattaaaaaataatttggatattattgttttttatattttttaaaagtttgtagtaaattacatttctgaatgagttataacttctaacaaattataaattaagcaattttcaatattaaatattactgtggcctattacaaccacatttacatgcaaaattaaatagttaaggaaaggggggtgggacctggggaataggagagtgagaacttgacacatcctctcccaaaaaaagcaagaagcaacaataaactagaaaaaaattattaaaatgtttcagaaacctaaaaatcaactgaaggcataaaactaaataaaaagtaattactaaaactgagaccacaacaaaaaaggagagactacagagggtccatcttatcgacttgtccttgtttgagtatgagactttaaaccagtgaaagtggggacagctttgtacact

SEQ ID NO: 10101 - DNA, 208 bp, Homo sapiens
agaactagaattgcaaaagcacaatgcagcactccctaatcaattcatagggtgacctcacagcatcagtcaatggagaaataaaaagcagaggttaaagaatgtgctcaaggttactctgtaaggaagtaatggagccagaatgcacggaccatctgggaccctgataccatcaggaacacaaaaatggatgctaatcaaagaagcc

SEQ ID NO: 10102 - DNA, 126 bp, Homo sapiens
  misc_feature 76: n=a, g, c or t
agaatagcttgaacctgggaggcggttgcagtgagccgagattgtgccattgcactccagcctgggcaacggatrngactccagctcaaaaaaaaatgtatataggggcacacatttttacctctg

SEQ ID NO: 10103 - DNA, 146 bp, Homo sapiens
  misc_feature 25: n=a, g, c or t
tagaatagatgtttggtttcttttnggggtgtctgagtgtatatgtgtgtgtatatacacaaagaacacacatatttatatactatacacacacattttaatgtatataaatatttkctacattctgtgtgttatataatgtggta

SEQ ID NO: 10104 - DNA, 203 bp, Homo sapiens
actcaagactgctctgcctacagagaagccattcttttagtttcttctttttaaaaaaattagagacagggtctctctatgttggccagtgtagtcttgaactcctggcctcaaccaatcctcccgccttggcctcccaaagtgctgggaggtatgagccaccatacctgacattctttggaatccttttttttttttttttt

SEQ ID NO: 10105 - DNA, 466 bp, Homo sapiens
  misc_feature 445: n=a, g, c or t
gtcgtttgactaacaccaggggcggcagggggcgctccactcgtcctccgccgggtgggtactcgcagatttttcagttcgtaacttgtcttctggacataggtttctctgtccggtggtctctacgaakgggtaagggtgggagattgccattgacattcccgccctggacgggactctggtctgtgggctttgacaggtcactgcattcctgccaggtcgacgttttgcgtttattggtgagattgaaatcccttcatttgtgttttcgccatttgtatttctttgtgatttgccagctcatatttttttccatgtatgttgaaaacatgcttctcaatttgtcttttgactctgattatggtgtttgattctggtttgggctttttcaaaatataaaatttaaaatttttaggagtcaaatattttgccttaaggcattttnggctttgtgctgtgttttaaa

SEQ ID NO: 10106 - DNA, 441 bp, Homo sapiens
atttaactgttggccggaaattgccggtastgccgtggcctgaccctactacgtgcacaactccgcagcattaggggaggggtcatctgctctaattaggtaacaggggcaagtgggattaaagttttaaggcagttatattaagaagctgaggaaaggattccggaaccagcccccagaaagcaagaaagaaaagaaatatgctctttaccgtggccgatcagcaacgaaccaacactgtcctcatctaattctacgtcttccacactgcccagtaacacaaataaccagagcgcagacgccaagaatccttccaagtaacgcagctaacagaccaagcccaggagccaaagctcagccagcccgaagagccaggattagagcctgcatggatscaacagtcacgcttctctctattacgtgtcttgaaacttggagtca

SEQ ID NO: 10107 - DNA, 324 bp, Homo sapiens
ataaaaaatgttatattaggttggtgcaaaagtaattgtgttttatttatttatttatttattattttttcctttgagacagagttttgttctggagtgcagcgtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcmcccatcctggcgacagagcgagactctgtctcaaaa

SEQ ID NO: 10108 - DNA, 103 bp, Homo sapiens
agacctggggcaaggccctgtggacgaccatctgcsttctctcgttccgtcgattgggaggagcggtggcgacctcggccttcagtgtttccgacggagtgaa

SEQ ID NO: 10109 - DNA, 379 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaacccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaagkttskggtttt

SEQ ID NO: 10110 - DNA, 375 bp, Homo sapiens
gtttaacggccggtcaggaacccaacaattagtcccttctcgtccgagaggaaactctgtgagaagatgggaccgtgagcactctctttaacaaggacatttccttttcagcgaaasagcgctctgatttaccaagtctggcggaccgcagcgctttaaaggaatgaggttccagcggtcgcgccaagcagcgtacgcagcctattttaagttatgctaccttcgccacagaaaccaagaacgttgtaatggtccggcaagtgcccacgtgtaattgttctccatcacttasccactctagttcgggaacacccttgtcgccgccgttccggtaacacctctccaasgctttcgatgcttctacttcttsgggaa

SEQ ID NO: 10111 - DNA, 417 bp, Homo sapiens
cctaaacactgacctacataacctcggaagaacaagcggtggttttagatgaagggcttcctattcaaattttcctgtaggccaatggttattagtgctgtatctactgtagtgctgtgtctattagtagtgtgtattactgtagctagttatcagtagtgtgtatctactgtagctagaggagtctttctgagatccacgaccccgggccttccccctctagtctgtctccttccctccttcccctgttgcttagattgttgttagctgttatgtaggttgtaaacttttcatcctaccaaaccccatactggatcttatggtgtccatacatttcagatattggacagttgatatttttggagtaatatagtgggtaagatgtggagtactccaagaagcttttgcttcacatat

SEQ ID NO: 10112 - DNA, 81 bp, Homo sapiens
attttccaaagccatggtgaacatctctgtgctaatttcttttgttttgtttcctaatttttttttttttttggmaggtgg

SEQ ID NO: 10113 - DNA, 467 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagctctacaaac

SEQ ID NO: 10114 - DNA, 475 bp, Homo sapiens
aaaaacagttagttactcagtatatctccaggtttgcatcttctacttcttatgtattcatttagagtcctcttccagtgtgtggacctctgcagattctagataacttttcaaatatgctagattttgagctgtatattttttctcaagcagagacatctgcgcatagtgaaaatcaattctcagagaccaaaattgccaagcatacgtgacggaactgtagggaaaaagggcataactttaatcttcaaagaagcttaaaaatagctccacagttattatgcatgaggcctgacaattgacatttctcattttggcagcattcacctacagcaccctatcagcaactgaacacattcatctctggaataaatgattaatgagctgcctatcatttccactccttttgtaccaagtggtggaggcttcagttgatcatattgcagccatcaacatcattactgaaattgattct

SEQ ID NO: 10115 - DNA, 432 bp, Homo sapiens
gcaaatcatttgggtcccgtcagtattgtggaagctttgttcttttactttttgcagtaaatgttggtgctggtcactctttgggtctgtgctgcctttatgagctgtaacactcaccacaaaggtctgcagcttcactcctgaagtcagcgagasatgaagccaccgggaggaaagaacaactctggacgcgccaactttatgaactgtaacactcaacgcaaaggtctgcagcttcactcctgacgtctgtaagmcatgaacccaccagaaggaagcaagtctggagatgtccgaacatcagaaggaacaaactccagataaaccgtctctaagaactgtaacactcactgccagggtccgcggcttcattcttgaagtgagcaagaccaagagctcaccaattctggacacagcaccattattcacaac

SEQ ID NO: 10116 - DNA, 289 bp, Homo sapiens
attctggcggctgggcacagtggctcaagcctgtaatcccagcactttgggaggccgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctca

SEQ ID NO: 10117 - DNA, 423 bp, Homo sapiens
ctaaatgtatggtgtgtttagtgtacagtagtgtatacagtaatgtcctaggccttcgtattcactcaccacttaatcactaactcacccaaagswactttcagtcctgcaagctccatttatggtaagtgccctcttaggtgtattggtttttatcttttatattatatttttactgtaccttttctatgtttagatatgtttagatacacaaatactattatgttacaattgcctgtsgtattgagtacagtaacatgttgcacaagtttgtagcckaggaacaataggctgtaacatatagcctaggtgtgtagcaagctgtactctccagctttgtgtaagtacactctatgttgtttgcacaacaaactcaccaacaatgcatttcttagactgtatccctgtcattragtgacacat

SEQ ID NO: 10118 - DNA, 89 bp, Homo sapiens
tagtagagacggggtttctccacgttggtcaggctggtcttgaactcctgacctcagttgatccgcctgccttggcctcccaaagtagc

SEQ ID NO: 10119 - DNA, 62 bp, Homo sapiens
acaaatatctgagagtgactttgttgtatggctacccttgtgatctacagtaatttattctt

SEQ ID NO: 10120 - DNA, 341 bp, Homo sapiens
  misc_feature 170,292: n=a, g, c or t
awcccgctggggtccccttcaacactgtggaagctttgctctttcactctttgcaataaatcttgctacttgctcactctttgggtccacgctgcttttctgagctgtaacactcaccgtgaagatatgcagcttcactcctgagcccagcaagaccacgagcctagcgngaggaacgaacaactccagacgcgctaccttgagagctgtaacactcaccgcgaaactctgcagcttcactcctgagccagccgagaccacgaacccaccagaaggaagaaactccgaacanatctgaaaatcagaagggacagactccagasatgccaccttaatagctg

SEQ ID NO: 10121 - DNA, 201 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagctcccaagtagctgggattacaggcgcgtgacaccac

SEQ ID NO: 10122 - DNA, 436 bp, Homo sapiens
atacacagatgatgacctcacaccaacaagaacatgcagacacccaaaattctgtatgattgattcattctaagttgatgcaagattttaatcgaaaactgccttattttgcagaagattaacaaagaggatgcggtgcagaagtgagtccctcagcaggagaagcttctctcacaccaacccatttatggctgggggaaaataccccgttagttcaaggatagcaaataaatagatggtgtgcagcctggtacagatggtagaacaaggactacatccttcacaaaagggatgtgccaacaaaaacagcctgccctcaacagcaagctgacccaacgccctgctcgctgactcctttatgccggcaccggaccgagtgcacgctgcgtttgcaagctattgttcagcaggcagattttctgctgggggttaacag

SEQ ID NO: 10123 - DNA, 405 bp, Homo sapiens
  misc_feature 312,359: n=a, g, c or t
attggccgggtcacaagcccgcccgcccgctgctggagccgcgaccatggaggagtctggcatggctcatgaatcagcagaggacttgtttcatttcaacgtagggggctggcatttctcagttcccagaagcaaactctctcagtttccagactccctgctgtggaaagaggcttcagcttgacctcttcagaaagccagagstatttatcgacagagatggttccacatttaggcacgtgcactattacctctacacctccaaactctccttctccagttgtgcagaactgaacttgctgtatgagcaancattgggtttgcagctgatgcctttgctgcagactctagataacctnaaggaatggaaacaccatctacgcgtacggcctkcagacctacctg

SEQ ID NO: 10124 - DNA, 343 bp, Homo sapiens
gccccggatggagaaagctaggaaatggtacacaggccttgggctacttaactaaaatgacctaaaaratcagtgaaaaatcaaggctgggtctttgcttgataaggaccaaaaatratgaaaattcatccacccttgtcaacacatcttcctgccttgaagctactcaagaggctgaggtgggaggattatttgagcatgggaggtcgaggctgccatgagccatgatcacktcactgcactccagcatgggcaacggagcaggactctatcccccrccaccctcaaaaaagaaggatgtcaaattagtttaaaattcctacatcaatacaaattgcaagtc

SEQ ID NO: 10125 - DNA, 473 bp, Homo sapiens
ttttctggacattattttactcttgacaattggtgggttggatttcatgatttcaaatacctgttcacatcttagtatcctaatattctttctacagtgaagaggaagggtaaggtgaagggctaaaggaagataatgtgtgtggtaaaaatactggcataaaaacctctattcttcaggccacgtggtgttacttatgaacatagtgaccttgggagcattttctgaaaatactcttccccctccttgttttgattctggaacagtttcctttttcctcacaattctaccttccttcaacagttgcatttacagataatatccttcaccgtttgtttctttatgcatcactagtgtgtgtataaagcagagatggcaagagctgccatgcattttggctgtgtgattttgcaaccaggagacgacctagtaggtatgcagcaatactgacatggagagatccctcctccctc

SEQ ID NO: 10126 - DNA, 451 bp, Homo sapiens
acagcaaatctagaagggaggaggcattatcccattttacagataagaaaacaggaatccagggaagttaagcaaattgcccaagattatacatctagaagtaaaactcattcacataacctctattcccaggatatchtgactttttggttcaggaggatttcctagtttctacccaccttgtctttcttgcctttcattatcgcctttctacttgttcttaattggtgtgtccatttgtttctttgccttgaatgtggtatatgaatgcatctccacttcagactgttgaatagatcacacttaagcaccaaagaacatgtgtattcacttatccattcattcaatcaaccagtaagtgtttattgagtattcattatgtgtaaagtcccatatttggaggagcataaagataaagatagacctgcctccttttgcttatatcctcttt

SEQ ID NO: 10127 - DNA, 342 bp, Homo sapiens
taggatagagcagccactaatttttcccaggagagggaaaatattgatacaatctgatatgaatctttaaggataagtatgattttgtcccaaaaagaaggtacaagagaagaggtaacatattccaggctctaagacaatggaaaattatatgagaacaaggggtcatgatttctagagtgtggaaggaaccatcatttcagaatccactgtcatccttgaagaagtcaggccctcattcaagatcatttgttatcagagactgctgaagagaagtacatggtaccttgaagtggttttaattaaatcaagaaactttatgaggcagtggggtagaaactt

SEQ ID NO: 10128 - DNA, 228 bp, Homo sapiens
acccatttccttgaaaatgttcttttaaaagtgaaacaaatgagcaaaaagcaaccaccaaaaatattastagatgctttasatacttgcaattcaaacagtggccccagrccagccacattcccttcacctgggagcttgttagaattgtcscacccagacctgctgaatcaractttrcttttacacaagatccaggtgactcaggggcacatcasagtttagaaa

SEQ ID NO: 10129 - DNA, 414 bp, Homo sapiens
  misc_feature 69,92,157,175,212,264,333,337,349,353: n=a, g, c or t
agtaggacgccgccgccgccgcgggggacgggggccgccgggctattattgaaaatggtggatcgcttngcaaacagtgaagcaaatactanacgtataattataatggaaaactgttttggagcagctggtcaacctttaactatacctggacganttcttattggagaaggantatttactaagttgtgcaggaaaaagcccaaagcaangcagtttttcttgtttaatgatattcttgtatatggcaatattgtcatccanaagaaaaaatataacaaacaacatattattcccctggaaaatgtcactattgattccatcaaagatgangganacttaaggaatngatngctaatcaagacaccaactaaatcttttacagtttatgctgccactgctacggataaatca

SEQ ID NO: 10130 - DNA, 107 bp, Homo sapiens
  misc_feature 106: n=a, g, c or t
gaggttgagacaagagaatcacttgaacctgagaggcagaggttgcagtgcagcctgggtgacagagggagactccggccccctcccaaaaaaaaaaaaaaaaaanc

SEQ ID NO: 10131 - DNA, 89 bp, Homo sapiens
tagtagagacggggtttctccacgttggtcaggctggtcttgaastcctgacctcagttgatccgcctgccttggcctccsaaagtagc

SEQ ID NO: 10132 - DNA, 223 bp, Homo sapiens
agattgggaatcaccggcttcaggaacttgaactcatttgcccctgagcctcccgtcagacacacctcgtactggtagctctgggatagggtcccggtgccgctcacgtctaccagatgccctggaaagggacactcgggcaccgacaagcgacccatcgaggccgccctgctcctcctgcacagccgcaccgccacgaacaggaacaccgagaagaggaaga

SEQ ID NO: 10133 - DNA, 78 bp, Homo sapiens
attttccaaagccatggtgaamatctctgtgctaatttcttttrytttgtttcctaattttttttttttttkggmagg

SEQ ID NO: 10134 - DNA, 125 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaa

SEQ ID NO: 10135 - DNA, 440 bp, Homo sapiens
caaaaagccattcttagaactagaggatttaagagggtaggaattagggtttgtatatatgtatatatgggacattttatctkctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttaagtcttagcatcatcatattgtgctgtttttggataacac

SEQ ID NO: 10136 - DNA, 437 bp, Homo sapiens
  misc_feature 220: n=a, g, c or t
agactgaatgaaagatgagcttctgcctttatatccttctctcctgctacccaactcattgtggttaaagaaaaagaaaacgcgggtggagactgcactatatgcttaggactgaaatgcaactgcagaagcaacatgtgaccttttagagatgcttgtgggactgcataaagtgaagagggaaactggaaaaaaacaatgaagtaaggaaaaaattggntagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagca

SEQ ID NO: 10137 - DNA, 257 bp, Homo sapiens
attctcctgcctcagcctccagagtagctgggactacgggcgcccgccaccacgcccggctaaattttgtgtttttagtagaggcggggtttcaccgtgttagccaggatgttctcgatctcctgacctggtgatctgsbcgcatcggactcccaaagtgctgggattacaggcgtgaaaaacagggcctcactccattgcccaaggtggagtgcattgacacgaccatagatcactgcactttgggagtccgatgc

SEQ ID NO: 10138 - DNA, 429 bp, Homo sapiens
aatcacatctcctgcgcctgcccttgtgacctgctcactggaaaggaagaaatgaccgagggagaagggagggcatttgagaggggagaagaagaggacggagaaaaaaactggatcatctcgtgacatggaaagaaaggtctgagctctgacgatcccctcacgtgattataggcatgaggactcactcttcgaattgtttgaaaattgaatggactggctcacaccttctgaaatttcttggaagctctggagtaactattccactaaagaacagcgtgtttttggctgaaatctgtgactgtttgtttttgagttattttaatctctgtgtcaagcatgaaaacctcagcagcctgggatttataattagatcccactggcatgccctctcacctctcaaacatgccacagtgctttggctctctc

SEQ ID NO: 10139 - DNA, 337 bp, Homo sapiens
ataaaaaatgttatattaggttggtgcaaaagtaattgtgttttatttatttatttatttattattttttcctttgagacagagttttgttctggagtgcagcgtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaatt

SEQ ID NO: 10140 - DNA, 476 bp, Homo sapiens
  misc_feature 462: n=a, g, c or t
aaaaaaagtcaactattcttttgaaacagggaggctaacaatctgagcaggctcatttataaccgactcaacactctgagaaaatgagagagccaaaaactctacattattaaagcaatgcttccaaggatgttatagaataataataagcaaaaaaacaaattcagcagtttatcggatccaaagagccatgtagaatgtcttgtggctgagaatgaatgaagaaagaaatgaatgaaggaagaaacataagcagctgaaaactgaaaagaccaaactccaaaaagggttcagtagaaagggaacttgatctagatgctggttttatagaaaaatcagagttacagaacctgtatcaccccacagacactgtaaaaggcctaattaatatttaagaataaaggagagatgaggagcaaatataaaacagtttaggtcagctatataacaaaaawtcaccangccagtgataatcc

SEQ ID NO: 10141 - DNA, 308 bp, Homo sapiens
  misc_feature 168: n=a, g, c or t
atttacgatgcacaaaggtcctgggaggtctcccttggcagttaactctacccaccaggaagatccagtcacacacaagcagggagggaaaaagggaagaatgaacagggttgactggaggagacattaggatggggcaagactacaagtacagcataatttcaaaancacagagcaaccagatgagggggagtggcagggatgtgcttggaaagaccggaaggagagtaagctcctgaagggacctgaatgctaagctcaggagcttgaccttcatcctaaaataaaaggcagcccaaaaagttaaa

SEQ ID NO: 10142 - DNA, 61 bp, Homo sapiens
  misc_feature 6: n=a, g, c or t
tggaanttcctctactccgtgcgtttacggggtcctggaggaggctcctgggacctcgagc

SEQ ID NO: 10143 - DNA, 173 bp, Homo sapiens
  misc_feature 111: n=a, g, c or t
atggatttcatggggcatgcaaagcaggcaggttccaagcggctaacaaggctgcttgtttgagctactttaagaataactggatgtgtaaaaatttgaatttkaggccantgggcttttgagctgatggttcccagcctgctgtgaagaaataaactaccaagtggtcaata

SEQ ID NO: 10144 - DNA, 310 bp, Homo sapiens
  misc_feature 72: n=a, g, c or t
agaattagctctttcccttttggtttgcaagcactgcctgtaaagccctcgcatgagaggccagcctgctanggaaatccaggaatctgcaacaaaaacgatgacagtctgaaatactctctggtgccaaccttccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagagggga

SEQ ID NO: 10145 - DNA, 72 bp, Homo sapiens
aaaaaaaaaaaaaaaaaaaaaaaaaaaaaaaaaaaaaaaaaaaaaaaaaaaaaaaaaaaaaaaaaaaaaaaa

SEQ ID NO: 10146 - DNA, 368 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaaccccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaa

SEQ ID NO: 10147 - DNA, 357 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatc

SEQ ID NO: 10148 - DNA, 145 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaaaaaaaaaaatgcgaaaagc

SEQ ID NO: 10149 - DNA, 444 bp, Homo sapiens
  misc_feature 71,150: n=a, g, c or t
aagggagcccagagccgctgttggccctgcccaccaactggccagagggaaggtgagctccagaagggaanggagttctttcacagctttctgtctctgtatctcctgtgacttgaatggactcagcacacagcaggcctgagtgaagkntgcttgtggttgctatggcttacatgacaacgaattgtctgtaatcctacaggactatggcacatgaaagctggaacgcttctttccgactgcatcgcccagcaccagagcccgagttctgtaaagctctgttaaaggcacatkagctgtgctggcttcaactgccctgaacttggataagctgggccgctgatggacccttcccaaccggttgttgctgccttggtttcccgacagtccactgtgctgaccctgcagcagggactcccagctttgcatcaactccattcaaca

SEQ ID NO: 10150 - DNA, 434 bp, Homo sapiens
taaaatatggaaaattatcaggtgactcattacatgcaaaaatacgtctgataacactacccaaacaagcaaatcaactgtatctgacagtcgcagctcatctcgaggcaaagtgcaataacattaaaacacttgagattttggccgggcttggtggctcatgcctgaaatcccagcactttgggagtacaaggtgggcggatcacttgaggtcaggagttcgagaccagcctggccaaaatggtgaaactcattctctgctaaaaatataaaaattagccaggtgtggtggcacacacctgtggtcccagctgcttgggagactgaggcaggagactcacttgaacctgggaggcggaggttccagtgagctgagaacataccattgcactccagctttgacaacagcgggagactctgtctcaaaaaaaaaa

SEQ ID NO: 10151 - DNA, 142 bp, Homo sapiens
aaatatatgttctttctacatcacccctctttctactaaaaataatctcagtaagattattattattattattatttttgagacagagttccactgcactctagcctgggtgacagagtgagaccctgtctcaaaaaaaaaa

SEQ ID NO: 10152 - DNA, 443 bp, Homo sapiens
agttgcgaatsagcatcggcgcttagctgcctccgcggtgcagctaaggttcgtgtcgctaccccttggcccttcgctcttgctgccttaaccccgccggtggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgasccctcagctcggctttcagcgtaagctcaacgtcaacgccaagcccttcgtgcctaacgtacacgccgcggarttcgtgccgtccttcctgcggggcccgactcagccgcccacctsccggccggctccggcagcaacgrtgaaacctgcacc

SEQ ID NO: 10153 - DNA, 496 bp, Homo sapiens
aattagaactaggagcaaggagggtgtgagagggaggtgagaaagatgtctaggacagagaaagggaggttgcagtattccacattccagtgcaagcacgaggaggcgcaggagagggagacacttaagtcaaacacctaccacattcatatctactgacacgccagcactgatttcaaggagaatatatccataccgcatacaggaagaaaatcaacaccatgtcaaagttagtattacagcccaagacgcagttattttcataattaatacatagagatcattattttcttaagtcagctctacaacatggttaatgtgagctcacactgccatatgtaaccaataggaatatgctgataattcaatctttgagctagccggggtcagttcttgagccaaggaatacgagccaatgtaatgctaccccagaggttgatttctcacgtgcagactgctttttccaagtaataatgatatgtcatgtaactgtttt

SEQ ID NO: 10154 - DNA, 119 bp, Homo sapiens
acagcacagtactgcactgaatactgaggcaactggagcatggtgataagtatttgtgtatctacgaataaaaaacgtgcagtaaaaaaaaaaaaaaaaaaaaaaaaaaaaaaaaaaaa

SEQ ID NO: 10155 - DNA, 330 bp, Homo sapiens
  misc_feature 105: n=a, g, c or t
ataaaaaatgttatattaggttggtgcaaaagtaattgtgttttatttatttatttatttattattttttcctttgagacagagttttgttctggagtgcagcgntgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcacccatcctggcgacagagcgagactctgtctcaaaaaaaaa

SEQ ID NO: 10156 - DNA, 50 bp, Homo sapiens
  misc_feature 16,30: n=a, g, c or t
acaaagcctccaaganatatgggactaggngaaaagaccaaatctacatt

SEQ ID NO: 10157 - DNA, 347 bp, Homo sapiens
  misc_feature 338: n=a, g, c or t
ctggtgagtcacggaaatgggtctcatgcttgggagggcctcagatgtcacctaggccacctccaccccagtgcaggtgtcatctgaaatctttctgttagttgggcacactcagttacggggaagcacatgtttggacgctgcatttttaacatgagcagttcaggcttttaaaatcaacatttttaacgcgagcagtttgggccattaaagatattacagtatattttaaataaataaaatggtgctggtgrdtccttaaggaagaaatggagaactcagcatctgtggctgctggggtgttggaggccggcagttctcagctgggtggctctctnggacttctt

SEQ ID NO: 10158 - DNA, 343 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaacccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtca

SEQ ID NO: 10159 - DNA, 252 bp, Homo sapiens
gccattcttgagggagtaaggtggtatcatattgtggttttaatttgcatctccctaatcattagtcatgttgagtactttttcatgtttttggccatcttctagacattggcttaggcaaagatttcatgaccaagaacccaaaagcaaatgcaacaaaaacaaagataaataggtgagacttaattaaactaaagagcttttgcatggcaaaaggaatagtcagcagagtaaacagacaacccacagagt

SEQ ID NO: 10160 - DNA, 66 bp, Homo sapiens
tttcctttatgccattttttgtttttgttatttgcaaaagatcttgtattcctttttttttttttt

SEQ ID NO: 10161 - DNA, 67 bp, Homo sapiens
attcttaagtttgttctaattcagcatatatcatctcagaatggatccccagcaggaaaaaaaaaaa

SEQ ID NO: 10162 - DNA, 323 bp, Homo sapiens
atcctactatgtgtctctatgaatttgcctattctagatacttcttgtgcctttttccataattttttcttataaccagcccttctcatccaaaggccacaatgaagtcgaagaaacctatagatgacagctttcacaatccttctcttgccttttcctgtactgacgtatgttagagatctggctggcagcttcaagacacttggaagcaagagggccactctattaaggatcgctgaagtatgcccacatgtcaggtttctctcagatgtggtatcaaaacatcattatgggccgggcacggtggcttacgcctgtaatcc

SEQ ID NO: 10163 - DNA, 486 bp, Homo sapiens
attataattttacactcaaatatgattgtagctgacattttgaacaagagcacttgcagctcttttgaatgtagtttcatgaaccatcacttgtagggttatatttttcattttctttactttttaaatttttcattttttattgtcatttttgttttgattaattgattaaattttgcctgtagccacatacccttgttattttccactactaagattaatggggatcacagttaaaactattggttgtattggtgtacatgaatatgtacatgctgaaagattactttttggtatcttaaaaagtgagagtaggctcttccaaactcatctcaaataaagctattctgctaatgtgaatggaagagaaaatgttgtagtgattcatcctgattttaggatgattgttctggcaaatagacctggatttcctttcctaggcaatgatttcttcggtaccttaggtgatatttttagctgccatgc

SEQ ID NO: 10164 - DNA, 452 bp, Homo sapiens
agagtttcccgggcactcaccgtgtgtagttggcatctccgcgcgtccggacacccgatcccagcatccctgcctgcagactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcagagctgaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaa

SEQ ID NO: 10165 - DNA, 484 bp, Homo sapiens
aactagtatctagctctctaactgccttgggccatcaaaactcccaaatcaaatattgttgacctggcttgtgtcaagtgcccatcactgaattagtcactatggccaggagcagatgggccctcactagacagaactggtctgtggccgcccatggtgcccggggtgagggcagctccacctgaacacagagagtggcaaaggcaaagtttcctgacatagacgttcctgttccatttgtcccgcaaacgtttaaacatcacacatacttggttaaggcacactacttctacgtggtggagaaaatggcacttggaaaattcagtttcaatggtcctttcagagctacagcatctgtctctcaatgtctatgttaattcctctaaaaggactcagacctgatgtggctcccagccttcttggacccctcctatctgtggtactgatgggtacagaactcacacaccctaccctgggtgtgagt

SEQ ID NO: 10166 - DNA, 375 bp, Homo sapiens
aaacatcatatgatctgtaccagggtataggcaggtgctatgatccccacttttcatcctcaactctaagttgagtcatacatcaacctctagtaaaaagtggcatgctctcaaaggggcgaatctggattgggaaagttgacattaatcaactcattattcctcccagatttgtattctccagagtatccgggtccttctcagagaattaaaaagcctgtacaggtcaagatattggtatttttaattgatgataagctggaataatattaatacacacaaagcacgtgttgtaacttttattatgcttccttagaggagtttgaaaaatcacatttgagaagaggattggatcctagccataacataaatata

SEQ ID NO: 10167 - DNA, 476 bp, Homo sapiens
accttcttggtctttcacctctgcggcgtcccgtattgcggggaaaaaggctaaggggcagcgtccccatctgccaggtcaggggaagaagactgttaggaacttaatccctatctccgccgcttgccgctgcccctgcttctaagggcatcatcaaaaacagacttggagcagagactgcggaactgggcagaggcgctcttgggattggggaggaaattggcagttacggaaggaaggggataattgccctgggtggagctaaaattcctaatacagatttttctcatttcagctggggtattccgtttggtcttcccaaaagtcatagttataaaatcgcgatgctttcgttagatggaatgctattgagatttgctcccaagtatattgtttagataattttagatcacaagtagctccatcctgtttcgctgcaatgtgcagtagtatgcagtgtttaagtcatacgtatg

SEQ ID NO: 10168 - DNA, 59 bp, Homo sapiens
atccaggtgtttgtttctaacttctgtaatacatacaatgcaaaaaaaaaaaaaaaaaa

SEQ ID NO: 10169 - DNA, 355 bp, Homo sapiens
catttagttctgctctgatctttgttatttcttttcttcttctgggtttgggtttggattgttcttgtttctccagttccatgaggcatgaccctagattgcctatatgtgctctttcagactttttgatttagacattttaggctatgaacttttcctcctagtactgcttttgctgtgtctcacaggttttgataagttgtgtcactattatcattaagttcaaataatttttaaatttccttgaaatttaaattccaatgaagttccaatgaaatcttgatatcattgttgatccaaccattacttagaagcaggttatttaattttcatatatttgcatagttttgagggt

SEQ ID NO: 10170 - DNA, 472 bp, Homo sapiens
atggtgtccctatagcaaagaaaaatttggacacagacatagacattgggagaacaccacgtgaggaaggcagagatcagaggaatgcttctagaaactgaaaaacataaagattaatagcaaaccaccagaagttaatgaagaggcatgaagagattctttctcacagagaaggaaccaactccgctgacccctccatcttggacttctagcctccaaaattaaagactttgcaatctcggaaagcctcagagcaaagckccatcagcaacactgtggaagttgaagatatgtacaagtattccatggaaaatacaaatcgagcaactttctttggggataacattgatagctgatctttctaggcttactaaggaaaataccattcctctcttctgagctcctctctggccaactttaactcatcgattggttctgccacccgcaacgttggctccaaaggcctgtagcg

SEQ ID NO: 10171 - DNA, 467 bp, Homo sapiens
tggagggaaaaacatatttaagattatatatttcttaaaattgcttattaaatcaattgttttaaaataatttaaaaggtagaagacgatatcttccaacacttctgtgaagaaattggcgtggaaaatattcgtgaatttgagaacaaacatgttaaacggcaacaagaaattgatcaaaaaaggtatttttataaaaagatgttggtaaggagcttacatatttaaaaatagttattatttcataatttagaggaattatgcctgagtttcatttcatcaagaaacagctaggccgggcacgtggcttacgcttgtgatcccagcactttgggaagccaaggcaggcggatcacgaggtcaggagatcgagaccatcctggctagcatggtgaaacccgtctctactaawaatacaatatwwwttagccaggcgtggtggcaggtgcctgtagtcccagctactc

SEQ ID NO: 10172 - DNA, 327 bp, Homo sapiens
  misc_feature 71: n=a, g, c or t
ataaaaaatgttatattaggttggtgcaaaagtaattgtgttttatttatttatttatttattatttttknctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcmcccatcctggcgacagagcgagactctgtctcaaaaaa

SEQ ID NO: 10173 - DNA, 326 bp, Homo sapiens
ataaaaaatgttatattaggttggtgcaaaagtaattgtgttttatttatttatttatttattattttttcctttgagacagagttttgttctggagtgcagcgtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaa

SEQ ID NO: 10174 - DNA, 369 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcgg

SEQ ID NO: 10175 - DNA, 488 bp, Homo sapiens
aagatatgtcctgatctcctaaagccacagaatcccagagactcaaagtaaattttctcttcggcaaatcagaaggctctgcataaatactgccaattgttaaacatttacctgcacatactgggctcatcttcattattggtaaaatgagctagatgctattttccattagctcacactccaattccaatcgacctgaccatcagaagagacaaaaagggaaaatcctggccagttctcccctacctaatcaaccagtagcataatcagatttgcaagacctcaagaaaagaaacctgaaaatgccactggaggtgtgtgttttgccaaagaaaaaagaatcaaaaacaaaacctgcaggatgaggacaaacaaacaaagagcagggacagagtctcactatgttgacaccctggacaacactcttgaagtactcttttcccagggaggacacagtcatggcatgcaaggaaggggctcagcatgaa

SEQ ID NO: 10176 - DNA, 81 bp, Homo sapiens
tttcctgggattggagtctcgagctttcttcgttcgttcgtcggcgggttcgcgcccttctcgcgcctcggggctgcgagg

SEQ ID NO: 10177 - DNA, 433 bp, Homo sapiens
  misc_feature 394: n=a, g, c or t
atataaaaccagggcacttgagccagcagcagcaacctgctcaggtgcccttccaccttgttcttccgctctttgcaataaattttactgctgctcattctttgggtccgcactgcctttatgagctataacaccgtgaaggttggcagcctcacttctaaagccagcgagaccacaaacccaccaggagagacaaacaactctggacgtgccactttatgaactgtaacagtcagtgcaaaggtctgcagcttcactcctgaggccagcgagaccaggaacccaccggaagggacaaacaactccagacgcctcaccttaaaagctgtaacacttacagtgaagctctgcagcttcactcaaacccagcgagaccacgaacccaccagaagknagaaactcggaacacgtccgaacatcacaaggacaaact

SEQ ID NO: 10178 - DNA, 246 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaa

SEQ ID NO: 10179 - DNA, 108 bp, Homo sapiens
atttaggggcggttggctttgttgggtgagcttgtttgtgtccctgtggaggacgtggttggtgattggcagttttcgcattttttttttttttcsttttttttaaaa

SEQ ID NO: 10180 - DNA, 492 bp, Homo sapiens
aggttccagcttgaatggtaactgagcagaagagcgttattactgattgcgattacagaagactatggaaagccaatgaagacaaccagatgatgtgcaaagttgctaacacatgaaggagatgtaatttctttcatatgttagaaatttcatattagagatattcatgttatagatactcacatgcagcaaacttgtttggagcacaacatatacactaagtgacaactgggactactaacagaatagaaggctcatctgaatatatttttaatattagcgggtttttagaaaaaaatacgtccttgactccaacttgccagttacacatctcatctggaccagagtcggtaactacacggcagaaaacttgtaagaatttagtcatgatcaggaagattttcagcttattgatgtttcctcacagttcttgtccaaaaatgcgggtttccactgtattgaatcacttcttaaataaatattgattatgtg

SEQ ID NO: 10181 - DNA, 77 bp, Homo sapiens
tttcctttatgccattttttgtttttgttatttgcaaaagatcttgtattccttttttttttttttttttttttttt

SEQ ID NO: 10182 - DNA, 188 bp, Homo sapiens
  misc_feature 151: n=a, g, c or t
gagattatgcatctggagtgggaagaagcaacacatcaaaaatatgaccagaccatccacggcggctcatgcctgtaatcccagcacatttggaggctaagtgggaggatacgtkgagcccagagttcaagactaccctgggggctatatngcgagacatctttattaaaaaatgataattaaagttc

SEQ ID NO: 10183 - DNA, 116 bp, Homo sapiens
accgtctctgtcttttcctccttccagtgcccggcgttcctcccttccccctcgccgccgaccgagttcttccttttcagaccgggtcgccttgctgtcgtcgcggtgattttcct

SEQ ID NO: 10184 - DNA, 191 bp, Homo sapiens
  misc_feature 123: n=a, g, c or t
acagtggcttctcagcctcccctggcccaactgaggctgttgctagatatgtttttcctgtatcaggtggttcatttctttttttctttttttttttgcctcttgatcttttttttcttttgnccctaaaggaaaaaaaattaaaataaataaataaaaggttttaaaaaaaaaaaaaaaaaaaaaaaaaa

SEQ ID NO: 10185 - DNA, 255 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaaaaaaaaa

SEQ ID NO: 10186 - DNA, 326 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcacccatcctggcgacagagcgagactctgtctcaaaaa

SEQ ID NO: 10187 - DNA, 503 bp, Homo sapiens
agtgcttggacctctacatcagataggtcctaaactcgagttactccaatgacacctatcattagggcagtatgtgtcctaaaaagaatcccaataactgaccccaattcttggcattcagaaacattctcaggaaggtatggtgtttacacggtttctagacaccctccttgaagaattacatctaaaaaatgaagaccttgaaagtctaaccatcatatttagaaccagctgtttaccagagtgatatattccatgaagacaaaatagaagatgaacttctattcaccgtttctggaattctagccgccatgatggtctggtggtgactgataactagttttattccaagacatacctttacctctttaagtttcaatctcccatctcccagtccttcagtccccaactgcagaggatgacctccccagatagaggagaatcattactccaacaagaataaccaagtctttgtatccctagtacaagacatagtattttta

SEQ ID NO: 10188 - DNA, 161 bp, Homo sapiens
aaatatatgttctttctacatcacccctctttctactaaaaataatctcagtaagattattattattattattatttttkakacagagttccactgcactctagcctgggtgacagagtgagaccctgtctcaaaaaaaaaaagaactagttcacacccat

SEQ ID NO: 10189 - DNA, 72 bp, Homo sapiens
caaagatttggctggatctattattggcaaaggtggtcagcggattaaacaaatccgtcatgagtcgggagc

SEQ ID NO: 10190 - DNA, 314 bp, Homo sapiens
attcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacatgtgaagacaatgaaaaatcaggcagaaatatttagtatctagtcagtatctgtagctacactgtataactgttcttcaataaaatggttcatattttatagaaaaa

SEQ ID NO: 10191 - DNA, 486 bp, Homo sapiens
  misc_feature 71,282: n=a, g, c or t
gcagctccgcgccaacgccttcgcccaggggtagttggagcggtgcaggttcccaggctccaggtactggncgccttacgggctgggaggtggtgcctctcacccagctaattgctctctagcccttggccttcacaggtgttggtgcctgccgtgaacgcattctgacctgggccgtatctgtctcccaagactttgtgcctatggttggggacagagtgaggtcgttgccttgacgacgacagcatgcggcccgtggtcctcctaagtgtgagcttgcgncgaccgaggcccacctgcctccctgcctgcttcgccctggactcgtgactgcgtccgcrtaagaaatcacaacagcgctggaattgctagtttgctaggcagcatcttttggacctgcgaaccatatgcatttcacctcaaatttgtttccaagttgaaaacctttgggtctttctatgcgaacggattgaagaaacgcaaaaa

SEQ ID NO: 10192 - DNA, 337 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcmcccatcctggcgacagagcgagactctgtctcaaaaaaaaaaaaaatt

SEQ ID NO: 10193 - DNA, 271 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaaaaaaaaaaaaaaaaaaaaaaaad

SEQ ID NO: 10194 - DNA, 418 bp, Homo sapiens
  misc_feature 357,394: n=a, g, c or t
cacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataarattttwctatagaaattaaatgatttaaaaactcacctatatgagacatttaatgcttttcagcctgctttctggctgattttgttatttgatgtgctaatttgggcacttaatttacattctggcagtcggtgtagataactanaagcccagttaagtattttataatttcaggctactgnggccatgcttgggatgttgtttga

SEQ ID NO: 10195 - DNA, 130 bp, Homo sapiens
aatttcgcscaragcgaacactgtggctgcacccttaaattcctcagactccctctttccttgtagaaactctgtggctgctgcttgacttcatccctgaaactcaacggggcctctcctgtaccgtaac

SEQ ID NO: 10196 - DNA, 77 bp, Homo sapiens; identical to SEQ ID NO: 10181

SEQ ID NO: 10197 - DNA, 76 bp, Homo sapiens
acatcgctgcgggctcacaaagcggccagacgctcggcggcggcgtgtggcaggagcgcaggggcsagcggcgatc

SEQ ID NO: 10198 - DNA, 398 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaacccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaaattycgggttttaaaaatttaaaaaaaaaaa

SEQ ID NO: 10199 - DNA, 452 bp, Homo sapiens
aaggaggcgctgtcctggcgtcggatggggacggggaacgcggcgagggckctgcgacctctgcccacctggcccggccgcagtctcggagttcctgttcctcacaggagctaattatttatgacagctgcatggttcccctcccccagttactcagtgcttggcmtcggcaccccttactcagcactcagtaccgcactcggcctcaggggacctgggcagagggaagcagggagtctcccgcggaaactcttgctctgccaaagtgtgatgtgatctgactgctgctcagggcctggacagcaaatgaggaagacttattgcagaaattcagagcctagtgacctggaccagggtggaggcagcagaggagagaaacagatgatcaagactctgctagcaggagaaaaagagagaaaagagagatgaaaaagtcttgtgtgaccagaagc

SEQ ID NO: 10200 - DNA, 476 bp, Homo sapiens
aaatgagaggataaatacatcaaatttcttctcaggtcatcctgagttcactasacctggaatggagcatggtgcttattctcactgttgagttagaagtgtaataactagtctgttagatggtgcccagtgggccacatgtcttagtatgtatccttttctcttctctcccgcattgaacctggactggacctgtgactctctttaaccaacagaacttggcagaatctagtgctggtcctggagctaagtcttgagaagacctggaggcttccacttctgcgcttttggaaattctgagcttccgtgttagaagagttgctacccttctggagatactacatggaaagacctcatgaagaggccatatggaaagggagaagccttgtccaaccatctccaccaaggtcccaggcatatgagagagccaacttggacagtctggtcctgttgagcccccagatgccacagtctca

SEQ ID NO: 10201 - DNA, 78 bp, Homo sapiens
agtgagcggagatcgcgccactgcactccagcctaggcgacagagggagactccgtctcaaaaaaaaaaaaaaaaaaa

SEQ ID NO: 10202 - DNA, 365 bp, Homo sapiens
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttccccattaaatggtcttggcattcttgtcaaaaatcaggctggagtgcagtggcatgatctcggctcattgcaacctccaccttccagattctcttggaggctgaggcaggagaatcgcttgaacctgagaggtggaggttgtggtgagctgagatcttgccattgcactaca

SEQ ID NO: 10203 - DNA, 257 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaaaaaaaaaaa

SEQ ID NO: 10204 - DNA, 215 bp, Homo sapiens
attgggtaaacgcaagggaggagaaaaggatacttcctcccaagaggaaagcaaatttaaggagaatgataatatgcttagtttgaattttgaattttaatttaagatgcctgagagcattcatgggggtttttgtccaagaagtcatttgaaaggtctattgctcaagaaagtggcttgtctgagagatcaagatttgagattttttttttttt

SEQ ID NO: 10205 - DNA, 379 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaacccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaargtscgggtttt

SEQ ID NO: 10206 - DNA, 419 bp, Homo sapiens
catttcgtcgggagtcacaagtgtgcctatcaggagagctgaccctgagaggactcctgcagtgcacaggagggcatcaaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgcacatgtccagaatattcaagaatgcttattctcttagatgataccgcacccataggaattgagaattgggagtgggaagawwacctcaaagtggttcatacttgcctgtaa

SEQ ID NO: 10207 - DNA, 487 bp, Homo sapiens
acctaaagatgctccagggccccgtagccaccgtcttccagaggggaacggatcaactgctggtgtgcccaaccaaattcaactcctgagtcctcagtctccggtcccgggaaggtatcaagggagccactcgaaaacccatgaatctgtcgaagmactgaagtggtccaggggcccgatgagtcaccaggagcgtttctagaatgcctccaagaggcctattggacttataccccttttgacctggcagctcccgagaatagccgtgccattaatttggcatttgtggctcaggcagcccctgatagaagaaagttacaaaagctgtagggatttgctggaatgaacaccagccaacttttagagatagcccagaaagtttttgacaattgagaggttaaaaagcaaaaacaggcagctcaggcagctgaaagggctgctgacaaagcatcaaaaagacaggcaaaaatcttcgtggctgccatcc

SEQ ID NO: 10208 - DNA, 51 bp, Homo sapiens
gaataggattggtgaaagagtgaaagagtgttgtgtgcttttgctgagttt

SEQ ID NO: 10209 - DNA, 367 bp, Homo sapiens
atgattcttaggaagaccctggcctccatcttgaaaacggaaaataaaaacagcagacctatgaaggtcgaaggggaagaaaagctgtatcgattgttgagatctggcgacttgtttaaatttcatcagcctcacttctatgaactctcaggcctcacgtgtaccagctctctgctctcctttgccttgggacgttccatccctggaagtttccctgcccacatctttgtagagagtccattctccaagcttcagtgtgtcatctgtgaggaccgtgacccacctggtacatcgcctcagggcattcatttcaggctccttctaaatggccaagtcatctatgaactgactctgtctcaaaaaaaaa

SEQ ID NO: 10210 - DNA, 88 bp, Homo sapiens
aactctgttttagagaagatctcaatgttttagtaaagtacaaacaccatcaaaaaaaaaaaaaaaaaaaaaaaaaaaaaaaaaaaaa

SEQ ID NO: 10211 - DNA, 299 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatmaggagcagcgggaaccaagtgcagaggatggccttaaaagcagtatgggaaccaaatttttgtaaagtaaatattttcaacctttaaaaaaaaaaaaaaaaaaaaaaaaaaaaaaaaaaaaaaaaaaaaaaaaaaaaaaaaaaaaaaaaaaaaa

SEQ ID NO: 10212 - DNA, 435 bp, Homo sapiens
tgcactatagaacaactggacctaatagatatttacagaacatttcatccaacagctgcagaatacatattcttctcctctgcacatggattattctcaaagatagaccatgtgttaggtaacaaaacaagtcataaaatatccaaaaattggaaataatgtcaagaatattctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatataccaaaacctataggatacaatgaaagcagtaggagagaaattgtagcaatatgtgcctacatgaaataaaaacaaaaacaaaataacttcaaataaataa

SEQ ID NO: 10213 - DNA, 77 bp, Homo sapiens; identical to SEQ ID NO: 10181

SEQ ID NO: 10214 - DNA, 322 bp, Homo sapiens
  misc_feature 19,313: n=a, g, c or t
cactcaagtatcttggtcntttcaacctastcaaaaataaatttcaggtaasaaaaasattcagaatatatssgttttcattagatagaaaactgaaaaagttgsttctagctgrsatttgagagagatatacagtaggtatatatgtataaaatggaatgtcagaattgaagtaaacattgttaastggagaaattaatttatattacaaatcatatctgaaaacatgtaaatgctgctaacatataagataaaaatatttgaatacatttcttaaaatgtctgattcctctactgcactgcagatgagggncagttctag

SEQ ID NO: 10215 - DNA, 288 bp, Homo sapiens
  misc_feature 105: n=a, g, c or t
ataaaaaatgttatattaggttggtgcaaaagtaattgtgttttatttatttatttatttattattttttcctttgagacagagttttgttctggagtgcagcgntgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgc

SEQ ID NO: 10216 - DNA, 391 bp, Homo sapiens
aataggactcaatatttacactttcccagacttatcattagtagtacttatcctcttaccagttatctagagccgtcaaaactgttgctcttctgacattaaggaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccwtcagcctcaagcagggagaacaaaaaatcaagaacttggcaagttttctccatttgttgcaagtatgtttactagctgaatctcaataacaatgt

SEQ ID NO: 10217 - DNA, 490 bp, Homo sapiens
  misc_feature 177: n=a, g, c or t
aagacaaagcaaaggagaccggggaagtccaggtagacagagtcaatggaaagcataaggagctgctggcaggctcttggggcatcacctggagaggtaaagaaagaaaagcccagaataccctcttcataacaataacagagcatcttggtagctgcagtccaactgagaaaggantgctcatcattcatttttgttattcagcatataagaaaagatgcagagaataaatacaggtacagcagacctaaaaaaatttgtgattaaagagagtgaaaacagactcccctaatgtggagagcatcaaaattaagagtagcttgtgtttcctgtggctgctgttaacatattataatacacctggtgtcttaaaacaagagatttattctctcacagttctggagtctggaagtctgaaatcaaggtgtcagcagggctatgatccctccaagaggctctagggaaaaatacttccttacatctttcagct

SEQ ID NO: 10218 - DNA, 448 bp, Homo sapiens
tagacttgcctcagttcttaacaagtgtctaaagacagtaggctgtagaagaacaagtattaggttttaaattttataatgtgccccatttattcacattgattgactatccagctgttacaagagcagtcgatctttattttgtgtaagttagtttcatttcatcagatgatctgcacagaactcagaataaaccatcaattttaggtataggctgttttgttgttggcattatcttttagatataaaatcatagctagggtgaactgtagacaagaaagtcttccttgaaacagggataatattcaggttattataaatatttaggcttgaagcatagagctactgtagggtgaaaaatctctgtaggactttctggggcttcagtaccatttacacccacgatgaagggcttaaatagaaaataatggaaaattaaatattactt

SEQ ID NO: 10219 - DNA, 455 bp, Homo sapiens
atcttgggagcagccggccccatcttgggagtggcccacaccatcttgggagctctaagaacaaagacctgctggtaacactatctctggccacctatctctggcctatctatctctgtttcctatctctggccatggcttgagccatttgggtgcagtgaacaggaaactgtaaagagtgacagccctgcttctacaaaatggatgccaagtatctctgactaaatgcaattcacagaggtcttctgggtcaagggagagctatctttcctcaaaatcctcagatgacttgaatgtatgaagatgacctggcaattcatccttgctcactgttccagtgctcctactagtgaaagcacttaggtgtttgaaatgacaccaaagaagctctttctgagttgggaaaaattggtaamagtataasacctggtgaatattatcatcattattattgg

SEQ ID NO: 10220 - DNA, 279 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaaaaaaaaaaaaaaaaaaaaaaaaaaaaaaaaa

SEQ ID NO: 10221 - DNA, 477 bp, Homo sapiens
  misc_feature 395: n=a, g, c or t
acactcctcttgtaagacagcgtaaacaattgcttttaaaacttcattaggtttttgtgtgaacataaactttcgattcatttggataaacaccagggaacacaattgcaagatcatgtgaagagcctttcgcctcctgccatgattctgaggcctccccagccatgtggaactgtaagtccaattaaacctctttttgttcccagttttgggtatgtctttatcagccacgtgaaaatgaaataatagataaataggtagtggagaggtgagaaaatcaaggtagatatgtaaataaaagatatgttaatatgttaatgagtgggcaattgaagcttggttttgctagaaacctcggagaccctaagtcacacctcagaatagctccaaagggncaagaaagtttagatatttgttttccaactcacgcctcttagtggttgagagttgttcctgggggtattcattcctaggcac

SEQ ID NO: 10222 - DNA, 386 bp, Homo sapiens
aataaatatggttttatgaagcaattgtgcatcgtgcattccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcatta

SEQ ID NO: 10223 - DNA, 395 bp, Homo sapiens
  misc_feature 343: n=a, g, c or t
caggaaaattaagctatgtcttttttttggcctgcagttttggtctgaggcgctctgggcaccatcactcacattgttttgttggtattatttcacctagtgtctgagcaaggaagaggctaaggcttcctttcaacattctgttctccaacctcatttattggattcccctctgctactggtgacaaaaagaatggattatacctttgtgtaattgtgcttgttccagtacttcatgtgaccaaatctaggaaagaataggaatttactgagtttgttaaaagtgggaatggcccaattgttttagtctttgcagcatcttaatcctagagagcagtgaccngtkagaagaggtcaggattttctcagaaatgggggcatgcgttacatggctg

SEQ ID NO: 10224 - DNA, 359 bp, Homo sapiens
ttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgactcagtgatcttctcattgcatcttacctgtgaccctacagttttgatttgccctgttactggtaatgttagcattgatcactaacagaggtatctgctgaatttctcctctgtaatgttattttttcaccttgtggttaattagtattttacagggaggtaatttgagactatgtacatatcyctactccccatcgaaccct

SEQ ID NO: 10225 - DNA, 107 bp, Homo sapiens
atctaggttttgctctccaaatggtagaagcaaccagaaataatgtaattaaagttttgaaactgtaaattatctagcatcttggcctasttcaatakactttatct

SEQ ID NO: 10226 - DNA, 283 bp, Homo sapiens
aaaaatagaggcctgtggtttagaaatgagcaagtgggtttgaaatctcccacctgagatatttctgaagtgtttgtagttaaggcttttgcttttcttctccccacacccttcctgccctactatctatggttccacctccccagcgactgctgaacaggtctctggaagcctccttgatgttggaggtatgcctttccaaatgttggagatgaaataccgagaccgagctgcagaaagacgggagaagtacggcattccagaacctccagagcccaagcgc

SEQ ID NO: 10227 - DNA, 271 bp, Homo sapiens
atttttaataaagtgttcagaatggactgagcaggtatgggtgtaggacaacaatttaaacagaaaatccatttaggtgacaattagtatgttagatggctttgtatttttctaagtaaggaatcatcgtgactttaactaagtaggtgccattatgaaaggagatgaagtgataaatgtgattgatatgtatgtgatggttaattatatgtatcaagttgactggactaagaaatgcccagatggctgttaatacattacctataggtgt

SEQ ID NO: 10228 - DNA, 570 bp, Homo sapiens
  misc_feature 524,528: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagattttgtcaccaccaggcctgccttacaagagctcctganggangcactaaacatggaagtgaacaactggtaccagccactgcaa

SEQ ID NO: 10229 - DNA, 252 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaacaaatttttgtaaagtaaatattttcaacctttaaaaaaaaaaaaaaaaaaaaaaa

SEQ ID NO: 10230 - DNA, 488 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaatcctacaagctagaaaagagtaagggccaatactcaatgttcttaaagaaaagaattttcaacctagaatttcatatccagccaaactaagcttcataagcgaaggagaaataaaagcctctacaaaacaagcaaatgctgagagatt

SEQ ID NO: 10231 - DNA, 328 bp, Homo sapiens
agaatccgttccagggattggggtgagtccgacttcgagcagcagctgccccccaacatcatgtaaccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcsagggcctataatgcaagaaccaaggsgagtcacgccctgtctgggcaaaagaggagtaaagacccctcagctgcagmccggmagcgcattcctacccagggtccgccgc

SEQ ID NO: 10232 - DNA, 485 bp, Homo sapiens
taaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgtttctttaagatggactgttctgg

SEQ ID NO: 10233 - DNA, 429 bp, Homo sapiens
agtcgacttgcgccagcccagaggctggggaggcgtccgagcctccgtcccgcctcgtcgttgaagaaggttaaggacaagcgccagctcacctgcgctggggcagggaagggcagagtggccgagcccgggagggcgcgacaggggcgaggcgaccccagtccagaggctgacttcctcaccgccctgggtcccaatcctgatctgggctaccctatctgtgcttctggtgaagtgggcccagaaccatcgtgtgaataatgattgacctcagctagtggttctcatggagtgattgattttgcttcccagaggacatcagcaatgtctggagacatttccagttgtcactacttgagaggaagcgtgatcggcctctagaagggagagaccagggatgccgctgctcaatatcctataatgcacaga

SEQ ID NO: 10234 - DNA, 361 bp, Homo sapiens
aaaaagagctttggagtttgaatcaaatttcagatgcggagattcccctctagaggactgcccaatctcaaggagcaactaaggatttgctctgaataaactgcctttggacagacacagtcccagatataaaggaagaaggatggtagcccatggatcccccaatagcaactgcagattaagccaacaggcaggctgctgatagaacctgctccccttcttaccttggaatgcccacacagggctgtgagggaccaaccaaatatgaagctgttgatttctccaaaataaccatcaaaagtctgatgagataaagagcacactggaaactgggaatgctttgatggaaattctgcaagta

SEQ ID NO: 10235 - DNA, 306 bp, Homo sapiens
agtcacctcccctcttctggcctgggtttccacacctgcacaatgggaacagcaacctcagctgcctgccgtctctgacgtgagggccaaataagaaaagctcttacaaacttaaggaaaggatacctgtttatgtataatcttgtgcaattcttgggattctcctggatctttgtcaacctgactgtgcgattctgtatcttgggaaaaggcaaagtccttttatgacacattccatactgtggctgacatgatgtatttctgccagatgctggcagttgtggaaactatcaatgcagcaattgg

SEQ ID NO: 10236 - DNA, 407 bp, Homo sapiens
aaacttttggctcttttgccttctatttgcagcacattgtggctatgtttattaattactttgtggcctaatactataaaacacacatctatcctgtgagctatgtaccctagggaaagagtccttcataccctccagttggccataaagagaggacagagtctcaagatttgccctgatgctaaggattaataccacctcctccgggagccatcaggttaccactctctagcacagagctaccacgtttaagactccttcagcaccatccccccttttcctgcacgaggacacttgcatgctgtttggtattaaaagccctctgcaactgttcccaacctacagcaccaaagtagccccccaccatgctatgactscactctagccagactgatgatgtagcacaa

SEQ ID NO: 10237 - DNA, 250 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaaaa

SEQ ID NO: 10238 - DNA, 252 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaag

SEQ ID NO: 10239 - DNA, 432 bp, Homo sapiens
accaaggtctctcctaccccggggcctgtgcacctgctgtgcctctgcttggggtgctcttcccagggcttgcccacctcctcagagaggcctcctgaccccagacacggccttgcccttcacctctatcgtcctttagaacagcccccacctcccgcacatcatgcagttgcaggttcaatggctactgcttgtcctccagactcctctccacaagccaacagctctctcctggctttgattttcaaccatttaagttgaaaaaaattcaaaacaaatgaaatgcacttaagagaaagccttgaggagttcagcaggccacccaaagtgaagggactcctttgggggtctttgttgttatcaattatttattgagccctgatgtgttcctggcgccaccaagaccgaaaggagacagggtccctgccctgg

SEQ ID NO: 10240 - DNA, 207 bp, Homo sapiens
actcccactctcactgtgtgacagccctgctgccccttcaccttctgccatgattgaaaacttcctgaggccctcaccagaagcagatgccagtgccatgcttcctgtacagccttcagaaccatgagccaaaataaacctcttctctttataaaaaaaaaaaaaaaaaaaaaaaaaaaaaaaaggaaaaaaaaaaaaaaatgcgaa

SEQ ID NO: 10241 - DNA, 315 bp, Homo sapiens
attccgagattgtgtgctgagggttttcaactgcatctctaaagggaaggccaaagaaagagcaacaggaaaggatggtaaaaagggggtagaaaggaagaaggaagggaagaaaaaagggaaaacagcaagctctctttccagagccacacatttttttctgtttgctcagtggcagtctgttaaagaaatacttcattgtcactgaacacagagtcattaaaggcaccttggaaatttggaccctwttactagaatcagggcttaaatagcaacttaatttatgacacttctcgaggctgatggcgtttttgm

SEQ ID NO: 10242 - DNA, 312 bp, Homo sapiens
aaagaggagacgtttggamttgagtttttaaggatgagttgaagttgatcaggaacatgggcctgttaggcagcgggaatgttggtatcaatcgacatggtttgctcacaatattctcattgctagtttcatggatgtatcctgtggcttctccatgagataatgaagttcttgaaagtgggagtgtcatttacactcctacctgcagacagcacctgatacagagtataaagcattggctgaatgcgtgaatcttagytcccgctttttcaccttagcatcctgactaccgatgccctgaacacacatggt

SEQ ID NO: 10243 - DNA, 378 bp, Homo sapiens
agttcatcggtgaacagggagtagaatatggacagttttgaataatgccagatactaaaggaagaaaacgtgcgagaaaccctcttgtttatacaggatagtaacattttcttagccccatcttcgtatggtgccgtacacctgaaatgaaactagatatgtctttaatttgaagtcaacgattatgttacaaaatagaaaatcagtcgcttaaaaatcaaatgccaaggtcacacagcaggtggagagtcactctctgaaagagaacaaagtaattttctgaagggaagctgcagaatatggaaaacatatattggagctacatggatagaggatcacatgaagccaagagttgaagaccagcctgggtaacacagt

SEQ ID NO: 10244 - DNA, 341 bp, Homo sapiens
attccattcccggccccaggccatgccccaggatggacthactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgag

SEQ ID NO: 10245 - DNA, 247 bp, Homo sapiens
aatataacccagtgacagggtaatggcaacctgggacttgtgactggcatctgaagtgggggacactcttgtgagactgagccctcaacctgtgcgatgcgacactatctcctggtagatagcatcagaattgagttaaatgataggacacccaccaggtcacagctgaagaactggttgttggtgaagagcaacccacacacattttggtgactaaaggkgaagtattgtgttctgtggtgactgt

SEQ ID NO: 10246 - DNA, 331 bp, Homo sapiens
  misc_feature 113: n=a, g, c or t
ttgctatagtggtattctatgatatgaatatgatactctttgcttattcattctcctattgataggcatttggggtgtttccaggttttcactattattaataaagctgctgngaacattcttgaacaagtctatttgtagacatatttttcatttctcttgagaacaaacataggagtagaattgttgggtcataaagtaggtgaatgtttaaatttatcatttaaaccatttttaactgccaaaccatttttaaatgtgattttaccattttatactctcaccaatgacgcacgagagtcctagttgctccacatctttgktcacattt

SEQ ID NO: 10247 - DNA, 318 bp, Homo sapiens
tctcatttttatgaggtcctctaggtctaaacacctgcataagcgatgtctgtgagagggtgaacacaagaaatcacactgagtttgtcatgcttgtggcctacgtaccattctgtggctttctggtttccttcctttttggttctggtttcawttttcttgggtgcgatgcctctttgtttttgcatttgtctgtgctagtttatcctaaataaagttccaaatgcacagggaaaaaaaaaaaawwaaaaaaaaaaaaaaaaaaaaaaaaaaaaaaaaaaaaaaaaaaaaaaaaaaaaaaaaaaaaaaaaaaaaaar

SEQ ID NO: 10248 - DNA, 248 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaa

SEQ ID NO: 10249 - DNA, 460 bp, Homo sapiens
  misc_feature 159,162: n=a, g, c or t
taaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtggngtnctgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtggdacctaccttttcgttcagtaagtttgaactatatataaactgtacaatctgtaaagtttttatagaataaatattcagctgtgaaa

SEQ ID NO: 10250 - DNA, 136 bp, Homo sapiens
acagcactttaggaagccaaagtggaggagcatctgaagccaggagttcttgagaccactgtcggcagcgtagtgagacctccatctctatatacaaagaatttttaataaattrraaaaaaaaaaaaaaaaaaaa

SEQ ID NO: 10251 - DNA, 267 bp, Homo sapiens
atagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcmaatttttaatttttttaatttttttattttttattttctttttggtttggggagggagaaaagttcttagcacaaatgttttacataatttgtaccaaaaaaaaaaaaar

SEQ ID NO: 10252 - DNA, 400 bp, Homo sapiens
  misc_feature 297,329: n=a, g, c or t
atctacctaaggagccccaaagactatgggtgaaaaaaaaaagcaaaaacaaagtcattctaatggtctccaaaaattctgaatatgagatctgattttggagaagagaaacatttgatagaattaccaggggaatatagtcaattgataatggtcataacaaagatacktaatkttatttccctttgattacttaatgaagacagaatgtctggaccagtaatgacctcctaagatactgacactctggtgaggtactatctggaggcaaacaggacttcttgggacatctctttngaccacaatatgggcaccataccaggaatctngaggaagcagaggttccacatgggtttsgctggaaaattcaaggggaaaacaacatctggaactggaaaat

SEQ ID NO: 10253 - DNA, 414 bp, Homo sapiens
  misc_feature 342,380,398: n=a, g, c or t
ttttagaaaagcagaaagtaacaacttttacaatagtatgttttacaataaaaatatagtttttcaatagttttacaataaaagtgtagttttacaataaaagtgttacttttattagtcacctttaaagagtgaatagtaaaagtgtatttcccgaagttacaaaggttaaaaatattaaaatggccgggcacggtggctcaagcctgtaatcccagcacttcaggaggccgaggtgggcggatcacgaggtcaggagcccgagaccagcctggccaatatggtgacactgcatctthgttaaaaatacaaaaattagccaggcgtggtggcacatgcctngagtcccggctacttgggaggctgaggcagaagaatcngcttgaacccaggaggcnggaggttgcagtgagc

SEQ ID NO: 10254 - DNA, 147 bp, Homo sapiens
aactctgttttagagaagatctcaatgttttagtaaagtacaaacaccatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 10255 - DNA, 55 bp, Homo sapiens
gaggtctttgctgtaattccccttgagcaggcgatcagttgggtcttcattcctt

SEQ ID NO: 10256 - DNA, 397 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcgggcagaaaccctacaagctagaaaagagtaagggccaatactcaatgttcttaaagaaaagaat

SEQ ID NO: 10257 - DNA, 425 bp, Homo sapiens
ctttctgttccctgcactgggtcccatcccctccatgtacaatagctgcctggcaggtctcttccttctagcaactccctgctcctgcagtccctccgtgaccttcctgatggggagatcctcaagacttttcccatgagctcggggttcctgaggcccagaagaagtgcgaagatggtcttcagctcaaacttccccaatttattccaacttctaaagcagtagtctaaggcactaggacaagaagcagatgaacatgtatagccagtattgggccaccatgcccgtcccacctagactcataccttgtctcatccactcgacctcgtcctcggtgacaaagctgcacaaggcttttgccattgccagtcgtattgctccagcctgggctgacctcccgccccctgagactgtgcaggtcacgc

SEQ ID NO: 10258 - DNA, 319 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaagaaaaarrgggrgggggggggggggggggggggggrraggrgggggggggggggggggggggggggggggggggtkgggggggggg

SEQ ID NO: 10259 - DNA, 423 bp, Homo sapiens
aaaaaaggaactcgcaggccagtgctgctggtgccggagtccggaagctgacggcgttgcctaggctggattgcagcggtgcgatcaggactcattgcatcctcaacctccccgactcaagcagtcctcccacctcagcctcctgagtagcaaggctacagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatggaatctaattaaactrargagcttctgcacagcaaaagaaactaccatcagagt

SEQ ID NO: 10260 - DNA, 381 bp, Homo sapiens
ccttccggtgggctcctggtctcgctggcttccggagtgaagctgcagaccttcccggcttgattatctcctaactttaaaactttggatgaataattataaagcagcaaattggtgttgcaaagagaagacatgaaaagcagagtttagtagatattttctatgattcactcttgagagagataacagaaactgaagtgaagtatccttgatcttggaactccattcctcccctgctgagtgagaggagtctcagactgtggaaaataaatggctgacagaacaagatcatagagttttcctatattctgtaagttactgacaaaaagcaggttgagttaaaactaagtccatgtaacccagcatgttgagaaagatctt

SEQ ID NO: 10261 - DNA, 433 bp, Homo sapiens
  misc_feature 377: n=a, g, c or t
gttagataaaatgaatatgatctagtatgtgatagcataacagggtgactacaatcagtgataattkattgtatatttaaaagtaactaaaagagcataattggatcatttgtagcacaaagaaaggataaatgcttgaagttatggatacctcatttaccttgatgtgattayyatatattgtatgcctgtaacaaaatatgtcatgcacttcacaaataagtaaataaatctatatctactatccacccacaaataawammtarawaragtaaratawacaaattaatttaagagaaaaaatggacttgttgcccagctgctaggagtgctctcagaagataacctgcagctgtcagtctatcagattwtgtcdnagctgcagttaccttacccacagtcacaaccttcctgggtcgtggatccagtagga

SEQ ID NO: 10262 - DNA, 336 bp, Homo sapiens
agctgtgggtatttgagaaaacatcagggctggggtctagtctattgagctkaacttcactcacatttctatttctagacatttcaaagtcaagggagtcataaacagctgatattctcatacttctggcctctgtacatgctgctgctcctgttggaacactgccctccaaatctaacccattcatcaaaacttaacttagataccagcacttctaggaagctttctgaaatgtgccgtgcttccagtgatggccttaaaagaatctacagcccaagatgctcttttggaatgtgaccctgttgtttcatcatcaagamctaacactgtgatcaa

SEQ ID NO: 10263 - DNA, 110 bp, Homo sapiens
ctgtttaagtttgtaggtacctcttggacttctgaattgatccagttgtcatccassacagacatctcacatcagatacagacagttccaagattgacaacagagaacaa

SEQ ID NO: 10264 - DNA, 170 bp, Homo sapiens
gttaacatttccaagctcctggcctccataacgagcaccctgtgacttttgagacgttatggataatccttctgaagaatctaggttgcagtgagccaagattgtgccactgcactccagcctgggcgacaagagcaaaactctgtctcaaaaaaaaaaaaaaaaaaaaa

SEQ ID NO: 10265 - DNA, 493 bp, Homo sapiens
  misc_feature 280,292,308,321,334: n=a, g, c or t
tccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaatkgccttgttaaagacatgtgatttgtattttagatgcttgtttcctattaaaatacagacatttctaccctcagtttctaaatngtagactatttngttgggctagtacttngatagattccttngtaagaraaaatngctgggtaatgtacctggtaacaagcctgttaatatattgargattgarraagtaacttctatagttactccttctaaaatatttggcttcctaaattccccccacccaaaatctttcccttttgaaaatactaaaaactaagttatgttattataaag

SEQ ID NO: 10266 - DNA, 498 bp, Homo sapiens
tttatctctgcgctctgcagtgtgccatgggcaataagttttgtgtggtctgtttgaagaacctggataatacataaccaaagcaaacaaatacattttgtatggcctatttgaagaacctggactaatacataaccaaagcaaacaaatacagctgactgcatagataaaagaacaagagggtcaaatccattaactgggaatgtcagaagtcataaccatgcctgatgacaacagtttcctttggcctggtgtggtattgtaaattgtcgcttttagaccaactttttagtgatagaccctctctatgctttttgttgtaagctactgcagattcttgccacaggtatgaagtaaattctgttaatagccttgatttttcacctgtgccaccatatatatctttgccatggcctcatgatggatggaatatacttccctgccccttgacttgatacttgaccatgtaacttttttggaacaatgaaagatgatgga

SEQ ID NO: 10267 - DNA, 532 bp, Homo sapiens
atatagctttcattttattgctatttgaagcagatgttcaccartgtcagcaagaactcaacctgaatttaaaggtggcattccatatactaacatcccccaggtcctctcaagtacttctgctgaaacaaatttatttggctaggcactaagttgttttccagtgaatagtaactaaagaagcccctaccttgctccatggattaattccttctgttcattttccaactgcactaattgtgcatattactctgcctaatcttgtgcatgttttcattgatttccctctcccggcttttgcttctcttgaaactgttgcccagtcacttctgctccaattctcttcctctctaaatagtagtttattactgccacatctccatgcatcagcaaaatgttggtgacatttttctagcctggcagaacagattacttaaagctatttcacttcaaagcagactgaatgtgacttcatctaaaggcagcattaggtactgcatggraataggkcattaacttgaaactcttatca

SEQ ID NO: 10268 - DNA, 563 bp, Homo sapiens
atcgcacgccaccgcaccccatctctcgaaatctgcagacatcttgatttttcccacgctgtctgtcaggtctccgccgccactcgacgccagggcgccgggccttgtgggctgtgctgcacctcggacggcttcgcaccagccagcgccctctctctcctgcagcactctgatctgcaccccctgagggscttccactgtccgcggggtgagaatgcccctgggagtgtcacatgactgccgccccatgtgtgtgagaggcgtcctctgggagagcatggatcctgaggtcccaggattgtcagctgacctctgtcctgtgtgcccagtggcaggtgacgtgtcttcaagaagaggctgagctgcggtgcttgtaaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcc

SEQ ID NO: 10269 - DNA, 266 bp, Homo sapiens
  misc_feature 181,266: n=a, g, c or t
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttnaaagcagtatgggaaccaaatttttgtaaagtaaatattttcaacctttaaaaaaaaaaaaaaaaaaaaaaaaaaaaaaaaaaan

SEQ ID NO: 10270 - DNA, 519 bp, Homo sapiens
tttcagcttttctgtggcaaacagggccgagggctggtgaagctgttaaggctaaatgtcgcatgcatgaggcgggctgcaggcctccttaggcctttttttggggtaattacaccagtatttaaaaacatttttttttgtttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccatggcctcccaaagtgctgggattacaggcgtgacamccatgctcggcctaaaaaacaattttcttgaagaatccgattttgtgcatagtaatgacacagcaccattcctgagaaataggaaatatatgtgtgtggtatga

SEQ ID NO: 10271 - DNA, 157 bp, Homo sapiens
atacttacctggcaggggagatassatgatcacgaaggtggttttcccagggcgaggcttatccattgcactccggatgtgctgacccctgcgatttccccaaaaaaaaaaaaaaaaaaaaaaaaaaaaaaaaaaaaaaaaaaaaaaaaaaaaaaaa

SEQ ID NO: 10272 - DNA, 452 bp, Homo sapiens
  misc_feature 375..377: n=a, g, c or t
ttcaaataaatccctaataggtaacaagtaaaatacaaattcttgtctactttcatgtggttttaaatggcagggacttcgctgagtcagtaagtataatcactctagtttattcaaggatgtgtggcaactttcaacttccatacgtatatatgtatgtatggaaggccatgtcaatactagtatcattggatataactttgattcttaatcagagggcaaattcattagagaagaatctttagtagatacacagactaatatttgtgtggaggttcttttgaccaattttattcctaagaataaacaaacccctacagttaaaatgcaaagatgcctgtcatctaagtattgaaagaatttttgcctttcaannndargttttttaaaaatttaataaattcataaaaaagactcatatctttgcaacaaaagaagggcagatactgggc

SEQ ID NO: 10273 - DNA, 352 bp, Homo sapiens
aacccttgtactcaagaggtttcsrgtacactatctaatcaactaatagactttaggacagcgaatatgaatgacatgaaggtgccttgagaaccatcgagtcctacctcttattttgrgactaattgaagatactgaggcccagtaattgratcmtatagattgctaaaagaagttctgagaagaaatgaaatacaaaagcttggtttctaaggctgaatatcatgagaaactatcatgttatcctgtgtgagtgagctccacgaggccargttaaagraattatgraaactgaaagcctgtctttatccaagaaccaamastgcctggacaaacaacttatgaatacatc

SEQ ID NO: 10274 - DNA, 429 bp, Homo sapiens
aagtccttcttaatatcacaaccctcacctccagccagtgtgtgtcttgccagcacaccgatgggagccacttgttcacgtcccttcactggggtgcacggactgccacccaggtgttcagctttctggcattttcctgttatttgcgtgctttatttggtgcacgggattcttttacaagttctatgatcctgcggacaagccactacttccatttcaggtgttccaacctttctagacaagaaccgaggtgtcacaacagtgaactttaataaatgaatccagcgtatttccggagttctgaggatctctggtctctgcctctgtgagctcaaccagccattcatgaaataccctcccaagaccagcagcatcagcatcactgaaaatgcagatgctcaggttatttaaaacaagtaaaatctgaga

SEQ ID NO: 10275 - DNA, 397 bp, Homo sapiens
aattctgactcagaaatgtctgccttccctgtctgccagcagtcttacccttggtttctggtagatccatttccattcttttaactatttacttgatcctgtggagtctttcttaaaaatacagtctttagatattgtcagttctaagcattcacagtgtgcaagagataaaagagggataagacaactgcaattcaatgtagcatcaagacgggaagaaaaacacagcccttgaagattccaaggagaaagatctaactcactggagaaagatcaaactcatcgtgatatcaaagaagcctgaggaaggaggtcgcatttgaaatgggctttgagtggcggatgagcagtggttacaggaaagggaaaggcatttcagatgggaacagcagcacca

SEQ ID NO: 10276 - DNA, 441 bp, Homo sapiens
acttgctgcgtgctgtcaaagtctttgtaaaagtgacgtgaagagattttcatgttggaaagatgactaactgcatcgtagaattaatgtgaaagggtggcccaaggaagcaagtttcttcacagctattgcaataaacagggtctactggagaccttggctttttatttccctgacacaacttcacactgctggagcaatgcttggattgctctggaaacactggcaaatctcaagatgcagttcaggcttctccatgatgagtgtgagtccctaggctgtctctcaaactaaagattccccagccaggcaactctaaagagtcttcgacaaggcaacacaattactctgtgtgcttagaagaagaggggtcataaatgtcagctgwtgctctttgagtcctgctaattcattcattgattcactcatctttcccacagg

SEQ ID NO: 10277 - DNA, 237 bp, Homo sapiens
gagatkatrcatctggagtgggaagaagcaacacatcaaaaatatgaccagaccatccacggcggctcatgcctgtaatcccagcacattgggaggctaaggtgggaggatacgtggagcccaggagttcaagactaccctgggggctatatggcgagacatctttattaaaaaatgataattaaagttcaaaaaaaaaaaaaaaaaaaaaaaaaaaaaaaaaaaaaaaaaaaaaaa

SEQ ID NO: 10278 - DNA, 252 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaaaaaa

SEQ ID NO: 10279 - DNA, 437 bp, Homo sapiens
  misc_feature 49: n=a, g, c or t
attatkctataaaatcccaccaccttacaaacacaaaatgttacaagtngcccagtcaccccggcttctgagatgaagrrdagdattgaagtcaaatctggtggctatcacactccatggaacttggggcaacatttaggtacctctacccaggaaagaatctctgagaaataggtggcagtttctctagcagcataagaagaaccttgataagcatcatccttaagtcctgacagcagtggatgactagtcaggaacctgtccaggaggacattgacatggatctgccagctttctaagactttccccagattcaagtccagtcacatcaagttgccttattaaagggtctgcccactcaaaaggagaaagtgcaaaagatgctcagcaagggtagcaaacgsatcagatgatacttcctgacagcatccaagagc

SEQ ID NO: 10280 - DNA, 438 bp, Homo sapiens
  misc_feature 171,175: n=a, g, c or t
atctgagccgtctggagaccctgtggctggcaggcgacgcgtccccccgcccagggccaagggggagcagggctgtggagagcatgacccccttgttaaaccacgtctgcctttatgcctcgatacaccacacagagagatgacgggagataccaccaagatgagatgcmnaccngggagaggctctgcaggtcccctggtgcccacgtctacctggcttgtccccacaggtgggttttctgagacaagggggcttttggacacaggtctgtccccagagccagccagcagctccagagaagagacagcaggtgcccaggacgatgcggcttagttgccaggttgccacgaaacatccaatatttgaaagtgttctatggacctcaaagggcaagagacaccttaaaatgtttgctggatggctgtaggagggtagag

SEQ ID NO: 10281 - DNA, 343 bp, Homo sapiens
agaaaaagtgtttctttagccctctccctgacttgcatcctcatgagactcttaaaccccctcctgaccttcagagatgtttatcatcagagatgggttatggaagtgatcctatagaacctgagagattgcttaactcaaactctgcttctacattagagtgtcttctgaaaaatgacctcaacaaaatttgctatctacctatttactaacataaatgaggaaaccaaaaaggtcaacggtgaggcaggaaggtttcagttcagtggagaaaagaaaatcttgatgaaatgtcattaacttccatatttggaataagctataaaaggactacgtgtctttc

SEQ ID NO: 10282 - DNA, 402 bp, Homo sapiens
ataaaggcwggttccggctctggttctattgtctctacctgaacatcatcactaaattgtaccgtcttcttctctgttttrsktattcaacttacactattacaaaatttgaatctcacaataacccactgaaaaagccaatgaatcttcctttattacaaaagaagaagaagcctcagaaaaggttgaaatcctaacccccaaagcaatggtatcagaaggtggggactttggaaagcgattaagtcatgaatgagattagcgaccttataaaagagaccccagaggctcatttgcccctgctgccatgggaggacacagcaaaatgacagccttctacaaaccagaaagtgggccttcaacacacagtcaatctgtctgtgagaaataaattcctgttgk

SEQ ID NO: 10283 - DNA, 377 bp, Homo sapiens
aagtgtgtgccacagcctcctttctcatcactttaccagaagatgtgatttgaaaaacatatgaaaatattgccactgaasgsscacaccaattcctgaagagctactgaggattttggtgtcactttagaagtcactctatttgtgaatagcccagcaagagaatcaggtcaagctattagggagagtctatggaaagcaatggaatcaaatttccagccagaatttcagggtaaaattagaagtcttcaagaagtaaactatgagccaaccagcatccctasttggacactgctccagctgcctgaatgacgtaactaacatttagagrtaacagtgaatagaaagacacacacgacaccatctgratcacagta

SEQ ID NO: 10284 - DNA, 386 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaa

SEQ ID NO: 10285 - DNA, 440 bp, Homo sapiens
  misc_feature 263: n=a, g, c or t
gacactatggcaggccaacttactagctttcaagtaaggtaacatctcagaccatcataggttttgacaggggaaactctgaaggaccacaggagttggaggttccacgtatctctaagtagtaacatacgatgggtccaaaacagaagaaagagaactcaagattcccgagccacagagctgttgattggaggctgactcagagaaaccctggattcagtgacatacagagacaacagggacttaatcgccttctggacaancataatctatgcgacctcctccccataaggtacaggatcagtatgggttttaattgaggggctcggcaccaaatgacagacttgacacatccacccccaccatggatgctgtccgtccactgttgcacaatgtccttcagtgtctaatttacagatccagctgtatttcccttccac

SEQ ID NO: 10286 - DNA, 247 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaacaaatttttgtaaagtaaatattttcaacctttaaaaaaaaaaaaaaaaaa

SEQ ID NO: 10287 - DNA, 422 bp, Homo sapiens
tcacgtttctaagtattatgattaaactttatttatttagcatcaagaagcagggaaaataaatataaactggattagtggttactagactaaaaacagagtagattataggcatataaataaaggcttttaaacccttctataagaaattgattactttctacagaataaaatgtktcctatgcttccagtgtagcttaagtgggcactcagcaaacagaggtaaaaattaggtgtttaaaatgaaattctttaaaaaatacattaatttgtcactaaagttttttcagatttattcttggggtggggataaaagacattgaatgccatgtatttcatctcatcccaatacctcaccaggacaaatgcaggatattacattgaaagatacatgcctggaatttaaacaggcacttaatttg

SEQ ID NO: 10288 - DNA, 135 bp, Homo sapiens
tgactaaaaaattagcaggcatggtggcttctcaggaggctgagagatgggacaattgcttgaacccggkdsatccaagacagcagtgtgccatgatagtgccactgcactccagcctgggtgaaggagtgagac

SEQ ID NO: 10289 - DNA, 430 bp, Homo sapiens
  misc_feature 135: n=a, g, c or t
gataagagaataaaagcaggctgtgccagccagcagtggcaaccagctccagtccccttccacactgtggaaactttgttctttcactctttgatataaatcttgctgctgctcactctttgggtccacactgcntttatgagctgtaacactcactgcgaaggtctgcagcttcactcctgaagccattgagactacgaacccaccgggaggaaaaaacaactccagacgcgccgccttaagagctgtaacactcaccacaaaggcctgcagcttcactcctgagccagcgagaacacgaacccaccagaaggaagaaactccaaacacatccacacatcaaaaggaacaaactctggacacgccgcctttaagaactgtaacactcaccgcgagtgtccacggcttcattcttgaagtcagtgagacc

SEQ ID NO: 10290 - DNA, 427 bp, Homo sapiens
aatgttcttgtgaatcttagacaacccccacaacatcattccctgctttatttgcttagtccattcttggtggattttatgagatgtcaacactcctcattaggattccctccttctgaagcctttgggattttctacccacccagcaaccaccagaggtgcagaaacccctgcagacatccttcttgcgcaasgcagttgtaccatgaatgcggtcgtcctgctgcagaccacgcccaccaagggcggggccacatccactgcagctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttt

SEQ ID NO: 10291 - DNA, 422 bp, Homo sapiens
ctcatggctctcggcggccttcccaggccccgcttttgacttttggcagcctcttcaggcgcagaacttgatctccaggcggcctttgcaggcccggcctcctgcctctcgaaggcctgcacgggcccggcctcggcctcggcctcacagcggactctccacgcccagatagctctcgcctcactgcggtctccccagtccaaagctcctggctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaaaaaaaaar

SEQ ID NO: 10292 - DNA, 75 bp, Homo sapiens
attttccaaagccatggtgaaacatctctgtgctaatttcttttgttttgtttcctaattttttttttttttggm

SEQ ID NO: 10293 - DNA, 477 bp, Homo sapiens
aatgcatatttccatctgggtgaaaaaaaaatcacaagcctctctctcttcctactgagcacctgtgaacagtgacctgcagtttgtggctgcagccagtcctcttgcagcctggwgttcttacatttcattctgaggctcacattctcagtcaccatgcagaagaacacccgccccatcctgggtcattacagagtgggtcaatccatctgctgcatctgaagagctgggtccagcttctacagtgaatccatatatttctgtatttcctggataaggaagagcaaaggagctgagctggtggaggaagaagagctaatattaactgactccttattttgtgctagtactgtgctagttacatattttgtctaattcttaccaaactgtaagggggtttcggagtgatggagacaatattgatgttatctccattttagggtgagaaaataaaggctcagaaatgttaaaaaaaar

SEQ ID NO: 10294 - DNA, 469 bp, Homo sapiens
gtttccaggagtgatcttgctctgaaagagsccccagaagtgaatcttccttcttttgaggcccaggaagattgctatcttgctgctaccagactgagtgtgagaccgacacatggaggagagtggattcaagagaatcacaggaggtagattccactggatgaaatcctccccaaagcccatctgactccttgacwkctagttatggttcaaggtttctgggttgatatttacaaaaagagattcttaaaaagaaagatcttcaaagagctacacctagctctgtttctgactgtgtgaccttgataaagacacttagcctctcagaaccgcaatctgctcacagctaaaatgaaggttaaaaaagattactatctcaaacatttctcacagaatttttgggaagataaaatgtaaagtaactgcaaggagttgcaaatctcagtaaagatattattatctttaaaar

SEQ ID NO: 10295 - DNA, 1211 bp, Homo sapiens
tctttgcgtctgcgtagttcgctcacctccctttctaactccgctgccgccatggctcctgtgaaaaaagcttgtggtgaaggggggcaaaaaaaaagaagcaagttctgaagttcactcttgattggcacccaccctgtagaagatgggaatcatgggatgctgccaatttttgagcagttttttgcaaggaaaggatcaaagtgaacggaagaagctgggaaccttggtggaggggtggtgaccatycggaaagggrcargrscarggwtcaccgtgtacatccgaggttgccttttctccaaaagmgtatttgaaatatgctcaccaaaaaatattttgaagaagaataatctacgtgactgggttgcgcgtagttgctaacagcaaagagagttacgaattacgttamcttccagattaaccaggacgaagaaagaggaggaagacgaggattaaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggrtacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatggg

SEQ ID NO: 10296 - DNA, 481 bp, Homo sapiens
tgtcacgtgtaagttcagaaagcactttggtcttaattggtgacttgggggttatttggtataaatataggttgtttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagacacttttgtcactttaatttttagattatctcaagttttcactagatttcaatgtgccacttgtgctatgagtctttaagaagctttaaaaaataaatgcacacctgtagccttttaccattcagacaggtagattatatttacctgtcattagggaccatgtat

SEQ ID NO: 10297 - DNA, 259 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaacaaatttttgtaaagtaaatattttcaacctttaaaaaaaaaaaaaaaaaaaaaaaaaaaaaa

SEQ ID NO: 10298 - DNA, 74 bp, Homo sapiens
cagaaagggctgtgtagagtagggccctgttctccttaggatgttgcttcttgattttttttttttttaggggk

SEQ ID NO: 10299 - DNA, 519 bp, Homo sapiens
aaaagcttctgtaactagggtgaaccaccatcattgaaaaggtggaacctgggaccttcggatatgagggcagaaccttgggccccagcatgctatgtttaggacatttggcctcttactaaacccactcagctatgttcctcctttttttctttgtttcttcagcacttatatattcagtttgcactgtattaatttgcacttgtttgcatgttgctttcaccttttactgtgagagtgggcacacagtatatgttgtggaatgacatcctgagtgatccctccctggctgggcctcagattaaattccctgaaatggaacagtcctaaccaacacaggacaggcgagtctgcggacaccagaactgacctgggagcgagtgagatctcaagttgaccatgtgatatggcctgatggcaagaggatagtactgctggcagaggagaaacaaactgaaggagaagcacaaaaatcatcacagctatggtgaaacctgtctctacaaaaaaaaaaaaaaw

SEQ ID NO: 10300 - DNA, 310 bp, Homo sapiens
gattataactctaagtatgactaggaacacaccccacaacctggatatctacttcagcagacaactgcagaacagtagttcaccatagaaaacgaatttctgatggagtctctctctgtcgctcaggctggagtgcagtcgcgcgatctcggctcactgcaagctctgcctcctgggttcacgccattctcctgcctcagcctcctgagtagctgggactacaggcgtccgcamcamacctggctaattttttgtatttttagtagagacgggatttcaccgttagccaggatgttctcgatctcctgac

SEQ ID NO: 10301 - DNA, 323 bp, Homo sapiens
agttcttaacccatttcctagcctaaggacgttcagagtgtatggattggtcctgttcacatcagacacctgagccctttctaacattccccactttaaagtgacttgaagtttgaatctctgccaaccacaatgacttcttcttagaagtaaatgtaggaagctgctttggtcatttttcatggcgagtaatcaaactgaagatcttaaattcacgactagtctgaagacagcatccccagtggactagatgcagaaataaggaaggagctattaaaatcrrccacttgtcccgatgaagtagaagatagcttcttctctgc

SEQ ID NO: 10302 - DNA, 290 bp, Homo sapiens
acttccggttctctatggtgcgcgggcaagctttgctccgcctccggcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaactatgtcatcagaatcgagcaaaaaacggaagcccaaagtgatccgaagcgatggagccccagctgaaggaaagcgga

SEQ ID NO: 10303 - DNA, 359 bp, Homo sapiens
ctcttaccggccgccacctaagatgtaactttgctcctcactcgccttcctccatgattgtgaggcctccccagccatgtggaagtattaaagcaatgaaaggggtcagaatctattggtgttaagaagtcagcctcagcactaagagaaagaaggaaagaatgaaggaaagaaagaaagaacaatgaaagcattgtaagaaatatttatacagcaaatgttacagagaaaaccccaaaccaaaatgtatttcaaaaaatgttggaggaaatgttatatctttttatgtgcttaagaaaaacagttaaaaagaacttcacagcattgggtctattaagcacatttattccagtgatttc

SEQ ID NO: 10304 - DNA, 303 bp, Homo sapiens
aatcgcgcccgcggagtgctttccgcaccgcctccggtgcgtgggcgggagacataagcctagccaagcccatacagcccggctcgggtggctatggataggcgtactgcagagacacctggacgcgcactgtgacaggcgccattctgacacacgtgctctctcactcccaaacaccacgggccgcaagcgctcacacccacactcacctgcagggaccacgtgggagaatttgaagggctgatactgtcccggtgcattcgcagtagcaatgatgcgagaattcgttttaacctcgtcack

SEQ ID NO: 10305 - DNA, 462 bp, Homo sapiens
aaaaaatctccatacagttttccatagaggttgtactaacttacgttcccagtagcagtctataagtgttcgcttttcaccacatccacagcaacatctgttgtttttgactttttaataatgagaggtgccttatattaaatgaaattcctcttgtaatgaatttcaacttctccwagagaaaatcccttgaaaatctaaagaactgaccagctcttccctacatgyctgttttagggcaaggttaagagaagtttgtttcaggggattgctgaactgwrggmcyctgagaaaactggtccgctttctaactactcctgagtcaggttttcagaggacgagaatgacgtcttkatttactttaacattatgactctttacattcagatgcatattgaaaaaacacaccccaaaagaaattattattgatttatgtaatactttgcttccttgtatgagaaa

SEQ ID NO: 10306 - DNA, 249 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaacaaatttttgtaaagtaaatattttcaacctttaaaaaaaaaaaaaaaaaaaa

SEQ ID NO: 10307 - DNA, 344 bp, Homo sapiens
tataacatacagatttgaamtrtaattcttcctaattaagacttccaatttggctaagtgcagtggttcatgcctgtaatctcagcactttaggaggctgagcttgagcccaggagtttgagacaagcctaggcaacttagtgagacctcatctctgccaaaaaaagaaagaacgaaaaagaaaattaggcacgtctgtagtcccagctacctgggaggctaagttcacgggaggatcacgtgagcccaggaggctgatgttgcagtgagctgtgtttgtgccactgcactccagcctgggtgacagaacaagaccttgtctcgaaaaaaaaaaaaaaaaaaaa

SEQ ID NO: 10308 - DNA, 468 bp, Homo sapiens
caaatgccttatcacagtgtgtccaaacttcttgtagggagcaacggggcctctatttaagcctcttgtgagccgatccaccagccaaggtcatgttgctttcccttaagaatcagagccgcggggatcctgttctatctgttctttccacagcctcctgtctttcagcagggcagatgcctcccagaaggaaaccagatgccaggactgtgggggactcttgagcagcatcagccaaactgtaggagctgagaagaggaagctttgctcagggtaagcgccctgggataatgtctttaatgtcaagaggatgcacgctgtgaacgtggaaagccctccaggctgaaagagggagtcacacaggcggggagtgttgccaagcatttgcgagcactctcttcggtggacagacagccggcttgctcatgattccgccttctctgttattggcaacaagccgtcactgga

SEQ ID NO: 10309 - DNA, 486 bp, Homo sapiens
  misc_feature 141..142: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcnnggcaggccaacattcaaattcaggagatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagat

SEQ ID NO: 10310 - DNA, 391 bp, Homo sapiens
  misc_feature 353: n=a, g, c or t
gtctttctgcgtactgcactaactgagcgaccaattgatacctaagtttagctgaactttttgttgaattaattaaaactgttttgaaatctattctgtaagagcctgagaaaaattgcggccacagaagctgttttgaaatgcgcttggcttccgacttccgcaaggggaggcagctgtttcttgtagtcttgctctgtcacctacactggaattcagtggcacagtctcagctcagctcactgcaacctccacctcccgggttcaagtgattctcatacctcagcctcctgagtagctgggattacaggtccctgaactttagctggccccaaaacttgagcaagctctrngaagcagaacatctcccacttaacagtttattctgaga

SEQ ID NO: 10311 - DNA, 72 bp, Homo sapiens
attttccaaagccatggtgaaacatctctgtgctaatttcttttgttttgtttcctaatttttttttttttk

SEQ ID NO: 10312 - DNA, 367 bp, Homo sapiens
  misc_feature 23: n=a, g, c or t
caaatctgattggttttctactngtttatttttttaatgtagttaataactggaagtattttattttgcaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagct

SEQ ID NO: 10313 - DNA, 426 bp, Homo sapiens
atgatatcaccgttcttgttgtagcaacaagccagtctctgaaatgttttccagaggtttgcatttgttgactccattgactattttcttgataatgtagctgggataaactagaaaacaagtttccccatggtcagctggaaatactcatattgcacttggacggagcagattgtttctgaagagggccagtgatgagcaccagttccctccttgcccaggccaacagcgtttcacaggacccctgggatcgtcctgatggttctcttccaaacaatgatctagaaagatgccccgtgtcaagttgcttgcctttcgaaggtcttcaaatcattgttcctccatatcatattcagagctagtgctttcatgctggtgagctcttgggggatttttttaggactatgaaagaaacaaaaaactarr

SEQ ID NO: 10314 - DNA, 444 bp, Homo sapiens
agtatgaagagtaggaggcactcacagaaaataaacaatgcacagagttatcaaggaaacaccctgatatcaattagatgaagagctataaggaatctatttatcttggagagatttcactccaagggtcccagtacccctcagtcaggtgaattggatggataacatacaccttccttctcactccccgttacagaagacgcgaaacccaacagtgaacccgtacctgaaatgtcaacgtgggaagccaggctaattagagtggggccaacccgcccaaccgcatagctgacatgcacccgctgaascttcttgtaacttgactacccgaagcctcatccctgattaacagagcctagctgcaaactaaaatgcagttaatttattggagaagagaagatggtgaacctgcaaggagaatgggtggagccaagtccagatgac

SEQ ID NO: 10315 - DNA, 348 bp, Homo sapiens
aacttggactcccttgaggccaccaaagggcaactcagggtgcaggccactttctcatgtccaccatctgcctggagaatccagactgcacagggtggccagctcccctcttcacagccgtggattcagctctgcttacgtactcaattccagacttccttgtttaaaaacagctgaaaagacatcaacaagcaatgttggtttcttagttttgacaggtacaccatggcaatgtgggatgttaataactttataggaaaacaggtgaagggtagatgaaaactctctactatctttgtaacttttatgaaaattgaaaatattctaaaatgcaaaaaaaaaaaaaaw

SEQ ID NO: 10316 - DNA, 430 bp, Homo sapiens
ttaaatttattttttaccttgagtgtctgatacataaaacccttttctaggaaaacattggaagtagtacatatttactctaaatgtctcacctgcatgacagtcttttcaaatgaaagacatggtaattgcaatttttttttaaagattgctattaagggtactttttccagccttcatttgagtaaatcttaattgatttcattttattaacatataccctttacctttaatatttcatttgaagtgttcctttcaaacttactgtcttaaatatgaaagtcagctttaagtaatgtcagactcatatgcattttcattctcattagctaaagtaaaatgtaaaattatctcaaatagttacaagttttggaaatacagtataaaacatgaatgtaaagtctattatgtaatatgcttatttgtaatc

SEQ ID NO: 10317 - DNA, 440 bp, Homo sapiens
tcttctttctgatataatccccccactcgctccatgtcaggctttgttctctagcggattgtccttcttactcttcctggaacgaaggcctgcatcgagccatttgcactgatgcttccaaagaggagggtcccaaagctgtaagagagaaaactacttgagcagaggccccagctgggctggtggccccgaggctgactgcggtgtgtgctcctccctcaggaggccattgccttgcttgacatctcctggrcaagtctccacagaacctcttatcaaactccaaagtcatcttcttccacacgttgtgctattagagattagaggagttaatgtaggtgcagcttcctcacagaaaatgcaagacacacaagggctgctttcagcattctgcttgatcgtgcacagctagacgcagagcactcaggagcacacaggag

SEQ ID NO: 10318 - DNA, 433 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctarcaaggcaggccaacattcaaattcaggabrtacagagaaggtgacaaagatactccttgagaagagcaaccccaagacaaataatcatcagattccccaaggttgaavtgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagct

SEQ ID NO: 10319 - DNA, 283 bp, Homo sapiens
atcttaagaggcgttcctttttgcataggccacaaaatctctcctaggaactacatccagaaccatttacctgttggatatgcttcttcctgcacactacctaataagatgaaacttcctgaagttctcctcataattagtcccctgctcaagaacctccaattgcatttaaaagtgcaacctgcttttctagtcacaattcctgcttcttcttgcctttaaaaagtttataataaagccaaactgggtgctttcttcactgaaaaaaaaaaaaaaaaaaaaw

SEQ ID NO: 10320 - DNA, 505 bp, Homo sapiens
atctggttgctgcatttgaagcatggcattaatttgkatttgccctgttctttgacctaaagttgaagggtttagagtttttaacctgatctgtagagcagagaggttgaaagcacttaactcttgtttagtatcckcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccmgggtatcttaaaagcaagttgttctcccactactttcctttccctctgccctgccattcctattacaatgctaaaaaagttctgcttcttaggtgaatgggtactttctattttgtttctaaacgagcaattttgaggatgaaatgggaagatatcattgcttcctttttgcacctattgggtatgtacactctggc

SEQ ID NO: 10321 - DNA, 157 bp, Homo sapiens
atagactacttttctaatttggtaactatactgtagttagagtttgttatttgattttagaaagagacaagaagattaactcgacatttttacgtatttcatttgcttcagtttgaagtgcatagatttgaagattcttgaatcacaactatgtggt

SEQ ID NO: 10322 - DNA, 436 bp, Homo sapiens
  misc_feature 340: n=a, g, c or t
acttctgattctctggatcagtttcttagggtgggcgtttttgttccaagtaatggtgactttaattagcatgagtatgaggggctggtgatgagaagaagtatgaagtatgaagtgtgaggggctggatgatagccagccttccctctgagctacagaggtacatatccaccagtctactcggcttctccacttggatgtctaatagcacatcctgtttaatgtgtctacatcagaacttctgatccagctccccacctgcaccccacctgccagggtctccatttcagctgaagccttgttgttgctcactcggctgtctaggcttagagcgcagganscatccttgtttcctctcctctccacttcatgcctcgtcatccagtccatcagctgtttgcagattttgttccacatccagccatttctcagtgct

SEQ ID NO: 10323 - DNA, 445 bp, Homo sapiens
agattttcctgggtagaccttccacaacattcctccggggcattgtttggttcctgtgatgtcaggggtgtacctctggttcgacctgtcaaatcctgtgcactctgtttgttccaagttgtttgctctgtgcccacagggatcctcccttcagttgtactcccagctttgggtctgcagagtctggctcacacctgtaaccccagcactttgggaggccgatgtgggaggatcacttgaggccaggagttggagaccagcctgggcaacagagcaagaccccgtttctacacatttttttttttaaattagccvggtatagtgatatatgcctgtagcacagctacttggaaggctgaggtgggaggcttgcttgaggccaggagttcaaggctgcagtcagtgagctatgatgattgtgccactamactccagcctgggtgas

SEQ ID NO: 10324 - DNA, 450 bp, Homo sapiens
gatatatccacctcctgtatccaccgagcagcactgagcaacagaaatgtaacccaaacccagcatatgatctgtgtcaagggagagagccatcagtcattctcatctcttgaatttcatggcctcattgcttccttcccacctgtaatcacagctgtgcctgtgtgacaaacactagagtgctagtgatggtttatgggtttcaaggctacagtgttgcagactctgcctggctcccttggattacctagactgggggaagccttaagccctctcatgacgacatggaagtagccgtggacagctacacatggaaaaactgaggttctcagtcaacaactggtatcaacttgccagccatgtgaatgagccactttgaaagtatagctcccagctcagccaggccttcagatgactgcagcccccacatctggcatcaatcacctaagc

SEQ ID NO: 10325 - DNA, 445 bp, Homo sapiens
attctggcaactgaacgttggcagtaaatgcagcttagttgtctcagaggactcacaatgggatgtgtttatagttgttgccttgaagtgtgttgtggcgaggatgaaatagtgtatcctaggatgccaggggaatccaccgtctgccaccgcgagcgtgagaagccaatcacctatcactggtatcactggcatcccggccatatataccctagaattgcatcaatggaagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggca

SEQ ID NO: 10326 - DNA, 342 bp, Homo sapiens
tgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctaaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggctt

SEQ ID NO: 10327 - DNA, 362 bp, Homo sapiens
  misc_feature 34: n=a, g, c or t
cttttggtataggttttaaacagaggttcatacngagtcaaagatcctacctgcggctggcttagcaagagaaggaactagccatacacctgagttccccttacggagtcttctgttttctcaggaggtgggcacagctgggtggtgttcacgaaggctgcaaatgtgagctctgataagatcgcagtgctgcctgccatgagggaacaatccgtttttcatgtgtaactggtaatggaagagagagacagatatgtcaatcttgcacctggaaaggaggcagagcaaggccacctcgaggaggacactttgctgatgcccaccatggatttggtccctgtggcctggccattgctaggagm

SEQ ID NO: 10328 - DNA, 304 bp, Homo sapiens
ttaagtattggttaaactaaaaatrataagcaaaatggacattatctataaaagcttttgtggaaatggctagagctagggtaaggraacaaatttgdttccccatacctgccctccaagaaaataaagctgtcaaggaaaatctgggctaagagtaggatatgagggatgatggataaggcatgagacatgagaaataagggggattaaattattattactattatacaaatgatgcctgagtagatttttaaaakgattaaatmcccaatgrkgtaaaawacatttataggataggaaagtc

SEQ ID NO: 10329 - DNA, 308 bp, Homo sapiens
  misc_feature 198: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccanaaaaaatttagccaggcatggtggcacatgcctgtagtcccaagtagctgggattggaggtcccaccaccatgcctggctaattttttgtactttcagtggagatggggt

SEQ ID NO: 10330 - DNA, 278 bp, Homo sapiens
acaaacttttttgtattattatttttacatctagaataaattatttaaattatttcacagcaagggagagggataggtaatttttatcagatatttttttaaaccatctgttttttaaattacatttttgtttatgttcttgagctgatgtagtggaacttgcctagcacattcaggtcccagccagttggcagagcatgctctcatctccttattccataccctgggcgtcccctttctgttgactcaggaactttctgagaatgaggacagcacta

SEQ ID NO: 10331 - DNA, 259 bp, Homo sapiens
  misc_feature 228..230: n=a, g, c or t
tacctgcggttcatctccgcacattccacacgcggcccaaacggtctctctctctctctctcaaacaccgcctttccgtctttgttttatcttgagtagcttagaaagattggagaagaaagcttacgtggaatgaaaatcaacttttatggatattttgaggactaaaagrataaatagggcgtccgtactgtagcgaaagtgcgactaaggttaggcatctggatnnnvcccgtagccctctttcaccccccccccc

SEQ ID NO: 10332 - DNA, 656 bp, Homo sapiens
aagatgagttcagcccctttcctttctctctcgcacacatatttgctcgcctttttgtctgccaacatgggataaagcagcaagaaagtgcttgccagatatgggtccttgaaccttggactgcccagcctccagaactaaggactcactgctagcagatttatgggatcaaaagatggaatgtttcctatgtgccagtgtatagatgctttgcagcatcccttacgccatactttggtaaatactgttcatggtcttagaaatgccaagcaagcagacagcaggaaactagtgatctagaatcagcaagaaacctctaagccttttagatcaactctagaagacagtctccctttggtgctgggacacatttacttacaaaaatgtgctaagataaagaaactgaagcacagttaagtaatccatccaagatcacacagctaatgggaggagtgaaccccatacactcaagtaccaataccacactcttaatcactaagccaggatcaatctgatcatccacaagtgttctcctggagggactcagaaatgagttgtgcagagcgatgcagaatcattccttggagcacttscagcagaaatwagacmcagaaagaaggttctacttcactgatctcaacatgcatatgtgtaca

SEQ ID NO: 10333 - DNA, 445 bp, Homo sapiens
  misc_feature 65: n=a, g, c or t
aggatgaggtagtggcgaggataggcgtavagcggctcagctaccccaggaaggcgtcttcgcgngagcctcgggtttgatggggtaggcgtcgaccagcgcccccaggtagacgagcagggccaaaagcaccgtggccatgagaggccacgacctgcgaaccgacaccacctgggaaggcgacattggggtgtgggtcattccgagcvtcgaccctccacggcgggaggctgcggctgccgtcggggccgtgctccggtgctctccctggggctggtagcggaccaaggttcagccaccagcttgccatatgttctccggcactgcaccgtctcctgcctcagtttcctaatctgtcagagggacataagccctgcctgacgtaaccccasccccacccccgctgctgtccagagaggtagattaaagagggttgtgctggcaa

SEQ ID NO: 10334 - DNA, 589 bp, Homo sapiens
  misc_feature 589: n=a, g, c or t
atttttaaaggctgttagcatcttttgccattcattgcaattattactttggatctgtctgatctttaatcattcaaaatgtgctgctcagaaaatgtggtattatgaggaagatagaatatgcaaaatgcaatgtttcttatgcaataaagtttttttttaaataaacatagaattccatttcagagattgtaattccatctggtgaagttcctggttctacttgtatcagccttcttaccatgttcttgtttcttagggagaaaatcctccacctccgggtttcataatgcatggaaatgttaatccaaatgctgctggtcagcttcccacatctccaggtcatatgcacacccaggtaccaccttatccacagccacagcgtaagtagtgtgaccccaaagtcctttcagagcagtatttatgatctaatttagtaactttactttgaagccccaaagtcattgtcaaatcaataagtaagaaccattgtgcataggattcctgagtccctgctacaaagagacatgtttttttaggaggtggcctgaatcactatgctaggaagtagctcctttgtcacactgtn

SEQ ID NO: 10335 - DNA, 160 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10336 - DNA, 498 bp, Homo sapiens
taggctgtcctgagagccttacaagaagcacacgtgtgaaggacactgtgcaggagacctgaggcccacagccccgctcctcacctgcacgttctgtctgatgcgctgctcattgtagctcttggccaggaccacaaccccacgctgtagctggtagcgcagggcaatcagggctggggttcgcttgtgcttttttgccaaggcacaaaggactgggtcctccaagagcaccggggagttcgggtccaccctggaaggaaaggcagaaaggctgaggccctgaggctggggatacagtttgttaggcggctccctaaacagactaaggcgtccactctgcaccggagcttctcaagcgaggcccccgaacagcagcctcagcatcacctgggatctcgtcagaaatgcaaattcttccctcaccccaagtcagctgtgagtgaactccaggaaacagcatgatctgattaaattttttttaccaaaaaaaaaaaaaaw

SEQ ID NO: 10337 - DNA, 517 bp, Homo sapiens
atcacaatattcctgaaaggacaaaaggatgaaaggatgacttccatagccctgttttctttagacgctgactcctgctgtctaccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcagctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcamcccamcctctcgatactacaaagcccctgcttgttccctagtgcactcccatgtggtcctgtggagcatatggtatcttcctcttctgggcagtgagcatatgtgactaataaactatctatc

SEQ ID NO: 10338 - DNA, 493 bp, Homo sapiens
attccagatgctctgatcctaataatccttttgatactctgttctaatttactaagaagagtcaccaattttgtttctgtggtttggtatgaaataaggtggcagaaacagcactctccaaatatccatgcactcctgacatttttcagcagcccacattactaattctggctgagggattgggagcagaagagacacgtgtcatctctgagttgaggctgttaagagctggtgcaactttccattcttctcttcccctcttggagcctgcattgctgaatcacaggatgaaggcgaatccctgccagcctccatccatctctggggtgcttagcagaatcctcagctcacaagatgaataaatgcagactaaatgatgcacaaataatcttcacacacaaccatcaacacatggaaagactgcaggacggccagatcccaagctaacaaacaggggaagatgatgtttcaaatgatcatctgaatgctgggt

SEQ ID NO: 10339 - DNA, 525 bp, Homo sapiens
aaactaaatactaccagacatgtatacaaacaggaaaatgtaacttatacttgggaaaaaatggcagtcaatagaaactgatgctgaataaaagcaaatttagtaagaattttttacccaaagttttcaaatcaaccattgtaaatatgtccaaataattagaagaaaagtgattttaatgagttaatatataaggaatttcaacagaagaaaaatgaaattaaaataaatggaaattctacatgcaaaaaggataactatgtaaaattaactagaaatgctaacagattagacaaggcagaatacaaaaccaggaaacttgaagataaatcaataaaagtaaccttccctaaaaaatagcaaaaaagaaaaaaagactgccaacaacaacaacaacaaagccaccaccawcagcaagaagactcaggaacacatggaaaaatatcaagtggtccaatctaagtacacctggattcctagaacattgaaggctgaagacgtaagcaatgatatactgtgtcttct

SEQ ID NO: 10340 - DNA, 293 bp, Homo sapiens
gtttaagttgttctagtgaaaggtatctcaattcagaggtacccgaattagaggtacccacttatgggtgggtaaattactgcaagagaaggaatgctctccgactggaaaaagcctaacagacggcagatcaaggaagtcactcgccatctgtgagggaggcagcggascccagaggcactggggagaggcagctgggcctcgamsttgtggttgcagattggagctggccaggtgctcctgaatgctttcatccatttaaggaacatttacggcactgtgagagaggatgc

SEQ ID NO: 10341 - DNA, 447 bp, Homo sapiens
attgtgtgatttcaggaagtagggcaattgccttgaattatgaattaaatcatgaattgcatcatggattaaaagtctcttattcctttactatctgcttctcaaaggagctactagatgaaaataaacatccacttgaggtgcaatatttctcaagaatcatgatcaaaaagacactttgattggaccaaatattgactgtgttcagcatgatgaatttcccaccgcagatccacatctcaagtgacagctttagaagacatgaagacatggctgaaactttatccagtgaaacctagttcagcagccagaacaagaactaccacgttttcaagagatcttcatggctgatcacaggtctagaaatggcatgtcttcaggtggtagtatcataaattgtcttaaattaataccaaagggaaggatgactaatttgtaaaagttgga

SEQ ID NO: 10342 - DNA, 399 bp, Homo sapiens
  misc_feature 316: n=a, g, c or t
actctttgggtccgcattgcctttgtgagctgtaacgctcaccgtgaaggtctgctgaagccagcaagaccacgaacccacttggaggaaccaaaaactctagatgcagtgctttaaaagctgtaatactcgcggtggtctgcagcttcactcctgagccagcaagaccacgcagccaccagaaggaacaaactctgaacacatccgaacatcagaaggaacaaactctggacacgccacctttgagaactgtaacactcaccgcaagggtctgcagcttcattcttgaagtcagtgagaccaagaacccaccaanttctggacacacttctctagtgactaacaatgttgagcatcttttcatgagcttgtttgccattaaaaaataatcaagctggc

SEQ ID NO: 10343 - DNA, 523 bp, Homo sapiens
agagcacagggagtatttgggtcagtaaaactattctgcgtgatactataatggtggatacctgtcttatacatttgacaaaactcagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtaga

SEQ ID NO: 10344 - DNA, 332 bp, Homo sapiens
ttatattacagcaaggaaaccagagtctttgaatctgctaactgtgcagaaaagaksctgagacatggctgggcacggtggctcatgcctgtaatcccagcactttgggaggccaagacgggcagatcactggaggtcaggagttcgagaccagcctggccagcatggtgaaaccccgtctctactagraaaatacaaaaattagccaggtgtggtggtgggcacctgtagtcccagctactcgggatgctgaggcagaggttgcagtgagctgagattgtgccaccgsactccagcctgggtgacaagagcaaaactccatctcacaaaar

SEQ ID NO: 10345 - DNA, 370 bp, Homo sapiens
aatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaaga

SEQ ID NO: 10346 - DNA, 330 bp, Homo sapiens
agaaatcattggtcattggtgactgaacthcatccctagccactgtccactccctggaggtcagagagtgaggctgaaagttccaactctctcatcatcaatcatggcttagtctttctgatcagcagcctgtatccagaaactatttagggtcctcattaacataagctcaggtaaagtggtctcagaggacatgctgaaagcccatgaacttctcagggacctaaataaatgtttaaaacctgagaaaagtcttggctccaaaatgtaaaaactacagaatcatccaaattaataaatgtttaatcaaatgccaaaaaaaaaaaaaaw

SEQ ID NO: 10347 - DNA, 75 bp, Homo sapiens
atttttttccaaagccatggtgaaacatctctgtgctaatttcttttgttttgtttcctaatttttttttttttk

SEQ ID NO: 10348 - DNA, 557 bp, Homo sapiens
aaactaaatactaccagacatgtatacaaacaggaaaatgtaacttatacttgggaaaaaatggcagtcaatagaaactgatgctgaataaaagcaaatttagtaagaattttttacccaaagttttcaaatcaaccattgtaaatatgtccaaataattagaagaaaagtgattttaatgagttaatatataaggaatttcaacagaagaaaaatgaaattaaaataaatggaaattctacatgcaaaaaggataactatgtaaaattaactagaaatgctaacagattagacaaggcagaatacaaaaccaggaaacttgaagataaatcaataaaagtaaccttccctaaaaaatagcaaaaaagaaaaaaagactgccaacaacaacaacaacaaagccaccaccaacagcaagaagactcaggaacacatggaaaaatatcaagtggtccaatctaagtacacctggattcctagaacattgaaggactgaaagacgtaagcaaatgatataactgtgttcttactaaagcaaaagttgtaaggcagttcat

SEQ ID NO: 10349 - DNA, 428 bp, Homo sapiens
aaaaaaacggatggaaaacggtttaactgcgtgcttagaaggagagcagaggttttcctaatcagctagcactctcttccamaacctacttattagttcagcaaaattatggttattctttcaagcccagcttacatgtcactcctaggattataaattcgaatgtccccatgatatactattttacgttctttgctttttctagtgcatattacggtatgattagttatggcataaaaatcattttttccycatcaatttctgggamagttcctgtatagacaggatttccacatgtcacccaggctgatctcagactcctgacctggatcttcccacctcagccactgaacgtgctgggattacagttgaaggtctggaatggaaacycctattgkgatcttaagggctgtaasccagagaatctg

SEQ ID NO: 10350 - DNA, 445 bp, Homo sapiens
agtgacatcacagactaacccttgtaccttgggaccttgtatctgtctgcctacggaaggctccagagtccctgacgcatatttatatctccacttcactgaagtcacaaggaacaaacacgttcacaggaagcacctggcacacagtaactattattaatttctgcactggaggcatcaggaaagccttcaccctatagggggcccttttaagttaagaagttggagagcaagcctcggggaaagcaaagagataacttagtagaatggagcaaccatacgggaacagtgagagtccatggatctccctgggctaagatcatgtatggatttggcaatctggggtggaagccacatgtgctgttattaagtggaaatgtctcgtgaacatgtggaaagtgatgactggaacttcagatgaaagtcaaagctggagataggagat

SEQ ID NO: 10351 - DNA, 397 bp, Homo sapiens
aataaaacaggatgcagtaaagaggccagccaaaacccaccaagaccaagatggtgatgaaagtcacctctgatcatcctcactgctacttatttgctaattataatgcattagtatgctaaaaggcactcccaccagcatcatgacagtttacagatgccatgcgatgtccagaagttaccctatgtagtctaaaaaggggagggaccctcagttccaggaaatcactttcccagaaaactcatgaacaaccccccctggttttgcatatgatcaataagtaaccatgaatatactccgtccagcagcccatgccacacctctgcctatggagtaactactctcattcctttactttcttaataaactcctttgataaactttaaaaaaaaaaaar

SEQ ID NO: 10352 - DNA, 451 bp, Homo sapiens
cccgcttgggtccccttccacagtgtggaagctttgttctttcgctctttgcaataaatcttgctactgcccactctttgggtccacgctgcttttatgaggtgtaacactcaccgcgaagatctkaagcttcactccagagcccagcgaaaccatgagcccaccgggaggaacgaacaactccagacgcgctgccttaagagctgtaacactcaccgcaaaggtctgcagcttcactcctgagccagcgagaccacgaacccaccagaaggaagaaactccgaaaacatctgaacatcagaagggacagactccagacgcgccaccttaagagctgtaacactcaccgcgarggtccgcggcttcattcttgaagtcagtgagaccaagaacccaccaattccggacacactgggacctctggtcamcctatctctggatctgaagtact

SEQ ID NO: 10353 - DNA, 417 bp, Homo sapiens
taatggatgtttttatattttaatagaatcatttatttctatgtgttatgaaattcacttaatgataatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcat

SEQ ID NO: 10354 - DNA, 485 bp, Homo sapiens
tataagattatccacgttggccaagtaaactgtactgccaatagaattggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcastgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacattttatcttttgtggtattattttattgaataaaattgagttttatgataaaagtgcacctgttctgta

SEQ ID NO: 10355 - DNA, 458 bp, Homo sapiens
atgatttgaaggtgttacatgatggggtaagaagggaaaaacattgaagacttgcaatggccactgaagacacagggtggcgaccattagggagatatgaacctgttgtgttattctttggaagaccttttagacatttttcaacactatctgccctttcagggcatctttcagttgcctgggccatttactgatatcttaatggagttgctgctaagctaagcatcataatagcttatataggcaccaccaactgagaaaccaccacaacaaaattgatcctgttttctctctcgcaattcccattatgatcttatttccttggacctctagaatttgcatatctctgcttcatgcataactacggcaaattattcttgtaaagtaatcagttaatatgggtaaagcatttagtacttctgtcatattcgacaccatgtatgtgtttttttcaataa

SEQ ID NO: 10356 - DNA, 293 bp, Homo sapiens
  misc_feature 293: n=a, g, c or t
attctggcggctgggcacagtggctcaagcctgtaatcccagcactttgggaggccgaggcgggcggatcacgaggtcaggagatccagaccatcctggttaacacggtgaaaccctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaan

SEQ ID NO: 10357 - DNA, 220 bp, Homo sapiens
aaaaggtgaaggaaagctgggatgaacacaagtgatggatgtagtacaaacacctgaaatgtaaacgtgaccctcatgttaagatagaagggaaggacactgatgactggctgtgcgtggattttggcagcatggtgattcatttgatgcttccagaaaccagagaaatctatgaattagagraattatggaccctacgttcttatgatgaccagttagc

SEQ ID NO: 10358 - DNA, 73 bp, Homo sapiens; identical to SEQ ID NO: 9590

SEQ ID NO: 10359 - DNA, 431 bp, Homo sapiens
gagctaactatctgggttgcaataaaatgtcttgatttttatccatggttggacagattgagttttctgataaccccagtccatttccctagaaatgcaggatttctccgcggacaaataatctctacagtggacctcaagacttcatactaggattctgaagatgattgagtcaatggatgagtgtaacgaacttttggaaacttcaaggcaattaaaggaaactgcaggaggaccagaaaagatcaagaccagggcacgagggctgatccaaacaacgggggccggcatttgtgatcttgggtagagccaccccagtgtgggtcaactccacagcattaggaaaaccagtttatcagaattaccttctcaagcaatagatctgttccttgtcacattcttagaactaataaagacttatctttattact

SEQ ID NO: 10360 - DNA, 447 bp, Homo sapiens
  misc_feature 114: n=a, g, c or t
attatgattgttacaggcaaagagtcattaatggatgctggaaccagtgggtgaaattgcagctgtttcaacaggacccctctgcaagactccttcaaccacatgacgccttcnmwrctgtctgcccagacaacttcattgtgtccaccagaagtcagtatgacgcaacttcccagatcacactgtgaaaactgccgaggagctgagactttgcctgtcctcccttcaagacagtgcacgccatagtgcctgctgggtcctcgcatctgcccctgcaatccatccctcctcctgaaccatggcccatcctctgtattatccttgtggcatgagcccacaccgctgggacgtgagatctgttgaatacatttatctttgtgtgtatagccccatttaggcgctgtggggcaggatctaaatgaggtatcttttggcatctcraartaa

SEQ ID NO: 10361 - DNA, 360 bp, Homo sapiens
acaactggcctcatgcttccataacttcactctgcctcccacttttttcagcccaacccctccaaacatgggtctcggtcggtccccttaagccacaatggagggaatacattaggctaagcaaatattccctcaggatttcatggcaaagccctttcaaccaaagaaaggatcgcgactaaggagaaagataacaaggtagaagactcaaaagcgtaccatgaaaccgagaagtggcctcttcgagggtgagggaggctaatttataagatcaagatcactagtggaacgcaaccttgtatgtgcatttgaatcacctgggaaactttttgttaaataaaaccaatactgttgccccar

SEQ ID NO: 10362 - DNA, 460 bp, Homo sapiens
aagatggcggcgcaacagcgggactgcgggggtgctgcgcastggcggggccggcggggaggctgaccccctaggacgcttcacgtgtcccgtgtgcttagaggtgtacgagaagccggtacaggtgccctgcagacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcag

SEQ ID NO: 10363 - DNA, 401 bp, Homo sapiens
agtagttctctaggttggaatgacaagacactagttagtaattctaatccacaaaactaaatgcagtaaataaagagcacagcatctcatgctgkgttacagcatcaattgtgatgaatataggatactgagtccctcctagaaatgacttcaggaacttcaccccccaactccacaatctgggaatggcagacagattcagcaccaggagaacatcacataaaggacaagtgtgtatgtttaaaaatggcaagtttcggcctggcatggtggctcacgtctataatcccagcactttgggaggctgaggaaacctggattagaagcatgtgctgctctcagacctggcctacagagaagaactgacacagacttccttagatgtgttgtcttcstgtcac

SEQ ID NO: 10364 - DNA, 188 bp, Homo sapiens
acagcactttaggaagccaaagtggaggagcatctgaagccaggagttcttgagaccactgtcggcagcgtagtgagacctccatctctatatacaaagaatttttaataaattaaaaaaaaaaaaaaaaaaaaaaaaaaaaaaaaaaaaaaaaaaaaaaaaaaaaaaaaaaaaaaaaaaaaaaaaar

SEQ ID NO: 10365 - DNA, 496 bp, Homo sapiens
  misc_feature 240..243: n=a, g, c or t
aaacccgctggggtccccttccacactgtggaagctttgttcttttgctctttgcaataaatcttgctgctcactctttgggtctacactgcctttttgagctataacactcacagcaaaggtccacagcttcactcctgaagccagcgagaccatgaacctactgggaggaatgaacaactccagatgtgccgcctttatgagctgtaacactcaccgcgaaggtctgcaacttcactnnnnaaggcagtgagaccaggaaaccaccagaaggaagaaactccggacatgtccaaacatcagaaggcacaaactccggacacaccatctttaagaactgtaacactcgtgagggtccacggcttcattcttgaagtcagcgagaccaggaacccaccaattccagacacactagttttgttaggataaaggaccatactgtcatctgctgaaaatttgccataataaaatataaaaatccaaaaaaaaaaaaaaw

SEQ ID NO: 10366 - DNA, 496 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgacactgtgcctagcctgagccaccacgccggcctaatttttaaattttttgtagagacagggtctcattatgttgcccagggtggtgtcaagctccag

SEQ ID NO: 10367 - DNA, 449 bp, Homo sapiens
ccacacttttgaaatttgataagtcaaaacgttttattttgacatttttaacattgtgaattattcgatatttgtaatctatgtatatgaaactctgccatgtttttcaactttgcctatgtgccactgtatataagacaggacagctatttggatcttcatcagcattgccttcagctgamaatttgggaacagttcacagtaaacctctcagtagtttgcaaactgaggtacctgcagaaaccatagctactcaccaaaatacaagattaggtgcatggtatcgtggaaattatttggtaaaaraacacacacacaaatctatgtgtactgtatttkaaggaatatctacaggtgcagctttgattttgaacagaattccaaataatttactgttgtacccaccagaatctagaaaatgtgaattaaagtacatgtttctgcaataa

SEQ ID NO: 10368 - DNA, 337 bp, Homo sapiens
actctgtccctggcttggcacaaacttgaagcccccttcccaaacggtatattctcttgtctctgctctgcttactgccacctctctaagaatctgtgttctttgaggtggggrragggatctcaaaatactcacagctattaatagcccagccagcytcaaacagtccattgaaagctggcatgagtgcctcaaagcagaaaagctttcaggcttttagagtggaacaatccccctacccaagatagggcgggactgatccaggacagggacctccatgttaccgcggttggttagcccctcacagggagctcctgtcaagctgagttgttgtcat

SEQ ID NO: 10369 - DNA, 448 bp, Homo sapiens
  misc_feature 111: n=a, g, c or t
atcctttgaccaacgtctccacttggcccatcccaactgccttccccgatccgttggtaaccaccaatatgctctcagctcattcacattgaacttctctcgattcgwhanrtacgaggaacwattctgtgaaaattattgagacatatttgggacccatcccttgggggaaagtcgtaagtggtaactatcaagtgattggagtcttggcggagtgccagaaacaactttgaacatgtagaggttgaggaacataacaaatttacatgckgtgaacagcccaagtgttaaaattgaaattctggaatggcaatcaaaacgcttaactcatttccacacccagatgttttaggaaaagttgaaaaaaactgaaatagacaaaggagattcttggttgttctgcctagtgctgttctgctttctctccactgttcattgtctttgaacc

SEQ ID NO: 10370 - DNA, 116 bp, Homo sapiens
agaggggatattgtatgtaactggtgacatttgaaagagacatattggacagaaatgacatacgtgaaagctaagatacaatatatttaattttctaagtaaaaaaaaaaaaaaak

SEQ ID NO: 10371 - DNA, 453 bp, Homo sapiens
gcgaagtcaaactgttgctgtttgctgatgatgtaatcatgtacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccasagattcaatgcaattcccaccaaaacaccaccatcattcttcacagaactagaaaaaacaaa

SEQ ID NO: 10372 - DNA, 450 bp, Homo sapiens
gacttggactttgaggaaaatgagaaaccattggccagtttggggtattgggagaaggagaggctgtcaacccatgccactatgctatctctaattctgccatccagaccgagcaaacgtacttaagaccattgtgtaagatcagaaaatcataagacagcattaaaaagtactatacaggaggagatggaacaagatggccaaatagaagcctccagcaatcatctccccgaaaggaattgaacaactatcaaaacaaaattgaacaactatctaaacaaaaaagtaccttcataaaaaacaaaaatcaggacaatatcagaacggcacatacaagtgtccccaagtcatatttggaataagatcacttgggaacacaagtcaaagaaggacacagtgttctgcctctcctgagtaagcagcaacaacgcaccatcttgaaatcagaga

SEQ ID NO: 10373 - DNA, 427 bp, Homo sapiens
aataatgggatggcaacattcattcattcatttatacctctaaccagtctttcctcacatactggttgagtactcaatacgtgccctgtgcttagctgagtactgttcaatggtgaacaaagaagacatggtcttaactaggagttcctatttcaacagagtagcccaaggaacttcaaccacttttgctacaggtgtattagttactgccaagagtctgtaagtgttcatgggcctcattaagctctgccttccttctgctttttggagcctggccttttgttggccttgaatgaagagtggggccccaaaagtaccactgtcagcactctccagaatcatctggctgtctggcaccatcaaagaattgcatttctgacccaagaagagcttatgggtggatgggggtgggatggaagctggggar

SEQ ID NO: 10374 - DNA, 323 bp, Homo sapiens
atattgttgcttggacacgcacacagctgctcctgctttagggccctcacactagctattttctctgccaaggctattctttcctgtcttactcaagtctttgttcaaatggagtccaacgaaccttgggcatctctacttaaaattgcaactgttctccctctctgtcccctaacattctgtactccgtatctcccttcccctctttcttctttttatcttttaaaattatattatatataattaaaaaaaaaaaaaaaaaaaaaaaaaaaaaaaaaaaaaaaaaaaaaaaaaaaaaaaaaaaaaaadaaaaaaaaaaaaar

SEQ ID NO: 10375 - DNA, 426 bp, Homo sapiens
tcagcttgcgtctccttccacgttgtaggagctttgtktatktgctctttgcaataaatcttgctgcttctcgctcattgggtctgtactgcctttatgagatgtaacactcaccacaaaggtctgcagcttcactcttgaggtcagcgagaccacgaactcactgggaggagtgaacaactctggactggaggaatgaacaactccagaggcactgccttaraagctgtaacactcaccgcaaaggtctgcaccttcactcctgaagccagcgagaccacgaacccaccagaaggragaaactctgaacatgtttgaacatgagaaggaacaaacgccggacacgtcacctttatagaactgtaacactcaccgccagggtccgcggcttcattcttgaagtcggtgagacaaagaacccaccaa

SEQ ID NO: 10376 - DNA, 489 bp, Homo sapiens
  misc_feature 441: n=a, g, c or t
aaaaaattatgtatgtggaatcataaagcaggtagtatttttggtctggcttcttccactaagcaaagttcttttgagattcatctatgttagcatcaatagttcattctactttttaaatatttattcatatatacaaagaaataaatttttaatttattttaaattaataaatttcatttatttaatgaaataaatttttaatttatttcattgtatatatgcgctataaattgtccattcacctgatgatggacactttggttgttcgaactttgggcaattacaaatgaaactgatatgaacatatatgtacaactctttctgtggacgtatgttttcattacttctgggtcttccttaatatatgtcagcagtggagtggtgtgcttaaggagagagagacttggaaaaatacagaccgagaacaaggccatgtgnagatagaggcagagactgaagttgtaccaccaaaggcaaagaatatcw

SEQ ID NO: 10377 - DNA, 327 bp, Homo sapiens
  misc_feature 113: n=a, g, c or t
tggaaattattggaagacaaagtgaaattccagttacatgactcatttgtgatattcaaagtcttagaaattatactgcatttattcttttcctccattcttctttttcatgnmcctcccctgagccatcccccataccccctacctatgttataaattagtaaacttttatagcagccaagggagtgaaaggggatgtcgtgaagatggcaagaagaacacagtttcaaatttctggaaaagagcctgtggtggagatctaaagatgtttagggaagagctcgactaaagaacaatgaaataaatggtccaaggggaagtcaaaaa

SEQ ID NO: 10378 - DNA, 444 bp, Homo sapiens
agttgtagtccagcgccggtcgsgggggtcggaggggcgggggcccccaggaatggggaaggccagtactagaagggacaagatctgggcaggacaagggaggatatttgcaaaaacttaaaacttccaggaagatggggggaggggaacctcctagagagatttttaaagtgaggtttttttaggttaatgccattttcttcctgtcttactcgcttatgacaaccccaatgaagttttaagctggactctggcagtaatgttaagtagagattttctcggccaacttcatattatttagggttctattcttccttcaccttgaacacagatgtgccattctctgcttggatgcacacagaatattcttgctcacagaataactcagttgaagccctgagcatgtaaaaggaggcctctcttagcagctgggaagagagagtg

SEQ ID NO: 10379 - DNA, 574 bp, Homo sapiens
ccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggraacccattctctttcattacaagagagcatcacttagcgtgcagtact

SEQ ID NO: 10380 - DNA, 271 bp, Homo sapiens
gagattatgcatctggagtgggaagaagcaacacatcaaaaatatgaccagaccatccacggcggctcatgcctgtaatcccagcacattgggaggctaaggtgggaggatacgtggagcccaggagttcaagactaccctgggggctatatggcgagacatctttattaaaaaatgataattaaagttcaaaaaaaaaaaaaaaaaaaaaaaaaaaaaaaaaaaaaaaaaaaaaaaaaaaaaaaaaaaaaaaaaaaaaaaaaaaaaaaaw

SEQ ID NO: 10381 - DNA, 539 bp, Homo sapiens
aaaaactagcttttctaatgaaaaggaagttaagagagtcagagaaggagatgtgaccatggaagcagagattacagtgatatagggccaggggtcaaggaatggaggcagcccctagaagctaaaataggcaaggaaacagtctctcctagagcttccagcagggcacagttctgccactttatcctcttttttaatttcgtaagatccattttagacttttgacctccagaactataagataataaattcatgttgttttggctgggcacggtggctcacgcctgtaatcccagcactttgggaggcagaggcgggtggatcacttgagatcaggagattgagaccagcctggccaacatggtgaaacccatgtctactaaaaatacaaaattagctgggtgtggtggggcacacctgtagtcctagctactcgggatgctgaagcaggagaattgcttgaacctgggaggcggacttgcagtgagccgagaccgtgccactgcactcacacctgggtgacagagcgagactcgtac

SEQ ID NO: 10382 - DNA, 431 bp, Homo sapiens
attagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaaaaaaaaaa

SEQ ID NO: 10383 - DNA, 147 bp, Homo sapiens
aactctgttttagagaagatctcaatgttttagtaaagtacaaacaccatcaaaaaaaaarraaaaaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 10384 - DNA, 417 bp, Homo sapiens
tactatgtaatgatattattaatataaaatgtataaaataccataacactttgcagctcctgagaggtaagttttgtggtcaccccatctccatgtcccatccagtggctccacagggtaatactctgaagttttttcacagccagagaagacagctaacgaggccaacctcagccattggctgtgacgccttagttttcacaatgggaatttctctcctgctttaatatcagaaatagctgataatcatgcagtggttacctctccctcctgacattggctcctaggaaactcaaatctaaatctgcagccctggccaggcacagtggctcatgcctgtaatcccagcactttgggaggccaaggcgtgacactgcgcccggttggtaagtcaattttaaaaaaaaaaaaaaatgs

SEQ ID NO: 10385 - DNA, 478 bp, Homo sapiens
atagtccatgctcaagatcgaatggcatctctcagactggaagacctttctgaagtcagttccagacatccctggaaggctggataatttgggaaaaggctgactcaatgtaaggactctgcctgagaaattttatacattcctccaaagaggaagaaactaaaatcgagagaggttaataattgtgcccgaggctacacagctactaagcaaaccagatctatgctcaaagcccatgcaggactgtaaccacggtgcaagatcaatcctcctgcttggagaactgatccaactccacacctgtatcttcaggttggactcgcttcttcaacccatgtacatgtccagtattccttcatcattgacaaataccttcctttgactttactgattctctgactaccaccttttcaatgaagaaagacttccctggccaggtgscatccctcggtgcttccacggttactgacgcgtgtat

SEQ ID NO: 10386 - DNA, 583 bp, Homo sapiens
aacacctgtggggcattcctttttgaacagtaccccttcccttgatgtccgcaatatcacctttcttatagattagcatatatgtggccaaaggaacaactccatgtttttgtaaaggcctagagaacatatatccagtgcctttcctttttgcctttgtattcatcattttggcaaattactggaagatgacggttctggccaaaaggctggttttgtttttgggtcacattttcttgcttctctgcgttagaatcttggattagatgatggacatggtgaaggctgggctcaactcttgggctcaagtagtcctcctgcttcagcctcctgagtagctgggactacagacatgcatcaccatgaccggcttaaagatggaaaatatgaggtgcagagaagtgatggaaaaaagagaagatcaggatttcagtttttttctgcatttctcatcatcccatgaagtctcttgataacataagccaagttttcatataccttgacgtgtgtgatacttacgtggtgccmagaacaagatgcatactcaataaatattcatcactataggcaaaaaaaaaaaaaa

SEQ ID NO: 10387 - DNA, 450 bp, Homo sapiens
atataaagaaaattccagggtcgttttggattttgtataaatagctcccatgtttacatgtgaaaaaaaattatttatgaaagaaaaacagagctttcaatatcctattttggttacgtctccataaaaactctaggaaacagtgggatcatctgtgaaacagtggaatcaccccaagaacaaactgtcagacagaccgtcctgtcgtggcatgacttgaacataaccgtcccacgtggggacgcattccgcaccggttgctggaactgacgggggctgcagtgctgaatacctctgggacgcttgggaactgtgcccctgtttacagacggcaagcccttagtggtagggccctgagattctgagaaacataaggtctgctttatttaatttcctctcgtttaccaagagtcacaacctattttagtaaataaattcaggaaattggta

SEQ ID NO: 10388 - DNA, 418 bp, Homo sapiens
tgaagtaacttgtaaggaaaaataatataaagataccattggggcagtggctcacgcctgtaatctcagcactttgggaggctgaggtggaaggatcacttgaagccagagtttgagaccagcctgtgcaacacggcgagaccccgtctctacaaaaacttaaaaaattagctggctgtggtgttgctcacccgtagttccagctactcgggaagctgaggcagtaagatcacttgagcccaggaggccgatgctgcagtgaactgtgattgttccactgcagtccagcctgggtgacagagaaaagaaaaagaaaacattacataatttggctagagcataataatttgattttctggtttttgaaaatttgagttgcaataaaaggatatttcagtgtgcgaaaaaaaaaaaaaaw

SEQ ID NO: 10389 - DNA, 593 bp, Homo sapiens
ttacccatggcttttataaatgggttgttcaatttctcaatatttggaggtttcttaggtatctattattcatttctaatttagtttcaatgtggttagacaacagactctgtatgatttcagtttttaaaatttgagacatctttcatggtccagagtatggtttacccttaagacacatactacatgtccctgaaaaaaatacatattctgcaattgctaggtgggtggttaataggttgttcaggttatctttctcattactgattttatttagcttttctatcaggtaatgaaaaacagttctgccaggtgtggtggctcactcctgtaatcccagctctttgggaggctgaggtgggtagatcatgaggtcaggagttcgagaccagcctggccaacatggtgaaaccctgtctctactaaaaatacaaraattagccaggtttgatggtgcatgcctctaatcccagctactcgggaggctgagggaggagaatcgcttgaacctgggaggcagaagttgcagtgagctgagctcasrccattgcactccagcctgggcaacagagcaagactccgtctcaaaaaaw

SEQ ID NO: 10390 - DNA, 113 bp, Homo sapiens
  misc_feature 113: n=a, g, c or t
gtttgtttgttttagatggagtctccctctgtcacccaggcggaggttgcagtgagctgagattgggccactgcactccaccctgggcgacagagtgagactcggtctcagan

SEQ ID NO: 10391 - DNA, 354 bp, Homo sapiens
  misc_feature 195,280,300: n=a, g, c or t
acttacaatcctgagtcccctcatctcacaggcaggaatgaaggcttgaatgttaaataaccgaaatgtgacaccctgcctgggccaagggacgggtcttctccttaccttggaaggaggtgatgatgctgaaaaggtagaggacgacaagctggaaggtgccagaagcaaaggagaagaagatcaaggcccagngcaggccaaggaccaggctgaggcccagcagtgtcagcacatgtgaccacttttgggtgtgggggcgcacgcaaggatctgcacnaccatggtgctagcatggcnatgttgaacagaaacacccaggctgaagaggcccaggttggtgatgtagctgac

SEQ ID NO: 10392 - DNA, 395 bp, Homo sapiens
aatatttagaactttcttgaaatcatggtgtatttgatgtattcgcttgcctgaagcagggaagttgaagcttttcagacacagagcactttattttaataagggttttaagtgcctaaagtcagggagagaaaaggagacagtatttaaggaatttaagatcytgaaagtggaaaaggcctagaagagcccataactgctgagtckaggaaagamaatgaaacagagtgtctgcatgcagtttccttaaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaa

SEQ ID NO: 10393 - DNA, 586 bp, Homo sapiens
aaaaacttttcctcagcagtggcaggacccaggcgcgggtcctccttcctcctcccgccccctcgcggtcagacaacagaccccccatctgcaaactagggatcatcataatgccctaaagggctgagtagagttgacccagctgcttgtgttccaaaagagagttcagcagtggaatcccaggcatcttcataccgtcagtgaagccatccgaactttggcatgcagaagttccactttcgtaacgaagggaattatctcaggtccccaataatccttcaaggtctacctggagaaaatgttgagcattagaaagagcaaaagcttcggagtcgcccagctgcagatccaaatcccagctcccagctccactgttccattcattcgctcgctgggtatttgttgaacatctgctacataggaggcactgtactttgtgttgagtacatcattgatttggatgaaaatccttgctgtcacagagctcacatcctaatggaacattttatttgctacttgacctcagaagactttatgccgaggagtcctggaatatctccttttctccatcttgggacatctgtgg

SEQ ID NO: 10394 - DNA, 483 bp, Homo sapiens
  misc_feature 154..155: n=a, g, c or t
tacttctctctgaggacaaacwgcctggmaaaccagcagggccaggcaaatgaggccaattggcagcaagggctggratggagatgtcagaratttaraggctctcagggttggaagggggacctcaaatttcatctaggtcaatgctgtgtcnncdkacctgagtcctgtctataatatccctcccaatagtgggctaacctcagcttgaatgctcccgatgatggagcactcattacctcctgggaccacgaactcatcaatgggtggtgctgactgtgcaaaaaccctccttcattttgagcctaaatctgttttccaacatgaagagagaagacccccgcagtgggttcatccttcttctggctccagccctcagtgctgcgaaggagccgcaagtcactcttcatgaggaaacatgcccggtgtcttgggtgggggcagaggcaccactgatccacaaagatgtggtgtgattttttc

SEQ ID NO: 10395 - DNA, 541 bp, Homo sapiens
aaactgaatgcaaaggctatacaaatgccaagaatgtactatgtttactcagcttgttctcctaactcattagctgaagaaaggatgggagagggagaggaaggagctgatctggtaacaaagagcctctgggcatagtgggggcagccaaggctttagtaagaacctgaggagagatttctaaacataaaagtggctgagaatgtgccagagacagactgctttattcaaaaatttatctaaagttgactctgctccaagggaagatgcaggaaactgtaactcctcctgaatagcatgattgctgttctaaatcccctaaatccagctagcgctattgtatgaatgaactgtgctacaggggctgcatcagaacaaagctgcctgccaaagacaggatttttgtttttgagaaaaagtgtactgtgggagactcctattcattcttgaaaaccctgaatagtctttttcttcaaggaagacttccttgatatttactttcactgscccttcactccccatcagatctatttcbgtttad

SEQ ID NO: 10396 - DNA, 510 bp, Homo sapiens
  misc_feature 274: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcntggctaattttttgtactttcagtggagatggggttttgccatgttggccaggctgttctcgaactcctgagctcgggtgatccaactgtctcggcctcccaaggtgctgggattacaggcgtgacactgtgcctagcctgagccaccacgccggcctaatttttaaattttttgtagagacagggtctcattatgttgcccagggtggtgtcaagctccaggtctcaagtgatcc

SEQ ID NO: 10397 - DNA, 535 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagattttgtcaccaccaggcctgccttacaagagctcctgaaggaagcactaa

SEQ ID NO: 10398 - DNA, 606 bp, Homo sapiens
  misc_feature 274: n=a, g, c or t
aagaatggttctaccagtttgcacaggaagacgttacttaaggctgctttccaaagcagtgaaaaaataagtcagaacagctgtgctgatggctgggactctctcaggacagcttggaaggcccgacctggcagctctctgggcccaccggagctctcctgccttgtcttgtacctgcctctctgtgctccagccacactgccatctctccgtttctcaaatgctacgtaaagccgcattctcttcccacagatagaaaatgctgtgctcgccnttgaaaagcctctctctccaatgaattcccactcattcctcaattttcagttgaagcatcattcattcctttgggaaaccttttctagcccctaacaccctgcattggtcctaacataccttggcatgactgctgtagctctgtatctgcgtgggtactgacggatgtgactccaggagggagggtgtgcagcctgtggtcaccacggtatccccagcacctgtctctctgcttgcctattaacttcctaaattagtgcattttcccctgtcatttaaaaaaaaaactttaattttttcatttgtatatatcgacagagcacaagtacagat

SEQ ID NO: 10399 - DNA, 486 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagat

SEQ ID NO: 10400 - DNA, 416 bp, Homo sapiens
ttggagtcagtttggagggtggctgtcacagttttgtaaaccagattaccgggcccacccctagtgtttttgagttgccggagttgtgagaatttgcatttggaacaagttctcaagtgatactgacactgttggtcctggggccacgctttgagaaccattctttcagctttttggaatcttaagaactttagaagtctagtccacaggctccgtactgatggaggtaccagcaaggtgatatgcatttggctcagtagaggacacaggaatcttgaataactactaatcatgtacttattgcaatctttaatcccaagtgggataattatttttatttgtatttagttaaaacaatgtaatgtattactaaaaatataacatttttgtatatttccaaaaaaaaaaaaaaatgs

SEQ ID NO: 10401 - DNA, 503 bp, Homo sapiens
acgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttrrgctttgaaaacacctgttattaatgaaatactcttttattttggatattatgattgc

SEQ ID NO: 10402 - DNA, 481 bp, Homo sapiens
tctaaaaattaagtgattttggaattggcattccatgtgactttaaaagataaatgataaagtaaatgttttattcagctctctctctccctccccacccaccttcttccctccattcttctgtttttaatggggatgtttaaaatccaatctcacattaattttttcttaagtgtaaataatgggaaaacttcacttcgagaggggactcctcagtagacctccataatttcctggcttttactgccagttagtcatcaggaatagccacggctaagagagtaccaactgggcaagccagtgaattataccagtgcatctcagatttactgatttgtttaacttttgttttttgttcttttttttttycagagatagaatctcactatgttgaccaggctggtcttgaactcttggcacccaagsgatccttttgcctggaatcccaaagtgtcagatttactgaagaatatttcattgd

SEQ ID NO: 10403 - DNA, 485 bp, Homo sapiens
aatgtgttagggctctccagagaaacaaaaccaacaggagagagagagacagaaatagagagagaaagggagagatttattatgaagaactaggtcatgtcattacaggggctgggaagttccacagtccaccatcggccagctagagacccaggattacctgttgtgtagctccagtctgagctagaggcctgagaaccggcagaattgatggtgtaagtcagtccaagtacaggagaagaccgatgtcctggcttgacagcagtcaggcagagagaacaatgctcccttaccccaccttttgtcctattcaggcctcagtggcttcgaggaggcccacccactctggggagggacaactgccttgctcagtctacagattcacgtgttaatctcatccagaaagaccctcacagacacacctagaataacgtttgacctaacatctgggcacctaatggctcagtcaagttgacacttaaaat

SEQ ID NO: 10404 - DNA, 293 bp, Homo sapiens
attctggcggctgggcacagtggctcaagcctgtaatcccagcactttgggaggccgaggcgggcggatcacgaggtcaggagatccagaccatcctggttaacacggtgaaaccctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaar

SEQ ID NO: 10405 - DNA, 423 bp, Homo sapiens
tcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgcatatatttaccattttattgtgtgtatatatagaagaccatataggaaattgatatttgtaatagtggatttgttaataatactttttacataacattactgtttaaattgtaaacagattttttctcaggattagtttgaaaaataatctaaattgtcatcttaacatccatatatagggaagtgattagtyctattactcaatttgtttttctcagcattgaaatgacttaatagaacccttgtgtcc

SEQ ID NO: 10406 - DNA, 427 bp, Homo sapiens
gaatttgaatgaggagcctcagcgctttcggcgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggasttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaatt

SEQ ID NO: 10407 - DNA, 478 bp, Homo sapiens
aagacggaaaaggaaatggagaagatggaaaagagaaaggagaagatgaaaaagaggaagaagacagaaaagaaacaggagatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagrtaaatatttttatcaaaaattttataaacacagcctttctttagcattgatttaatttcagaacatcttcatattgattattagccataaagtttctaacatgr

SEQ ID NO: 10408 - DNA, 536 bp, Homo sapiens
ttagaaaatttaaataacattctttttgcaaaaaagtccaataatttaacagttgaagaaaaacttactacctctttaaatatttgagaaacatttttcaaagttatcagctgtagtccaagctaaatatcttttgtaatctgcaacattttccttactgtttttgggcagtgataaatgctgttctcgaaatagactttattcttacctaggcttcagcaacagttttatagagcagttactgtaatacaatataaaggaaatatgctgttgaaattttaaaggtatgcccagttcctaacttttaaacgaattaccgttcttcctcttggctgatcttggcagagatgacaaaaaaaaccccaaaacaacccatgcatatataatgtgtgtatacacatatacataagtatacatatactcccacattataacttagaatatttagttttttacctgttactaggtttgagttacatggttgagttgcaaattatttacatgctttgtttaaattcttcatcacctagcaactg

SEQ ID NO: 10409 - DNA, 473 bp, Homo sapiens
  misc_feature 414: n=a, g, c or t
acaagcgaggagtgtgtcagcagttctgcctgccctcccacaccgatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaactcctgaccttgtgatccgcccacctcagcctccgaaagtgctgggattacaggcgtgacmaccacgtccaactgccttattttgttctgaataaatttacagtattgggcagcaattctggattctagacttgagaccacagaatcaaccatttcatgaggttgtactgtaattatacactggaatattcaggwngtcatctttgatttttcattcaagtaaatatagccataagaaaatatctgctatacagr

SEQ ID NO: 10410 - DNA, 481 bp, Homo sapiens
  misc_feature 169: n=a, g, c or t
ttcccacatatttcctggcccttgtcaacacacctcctgtggccgacaggagatgccagcagcttgctcacccaggacagagaaggagagacagacagagcaatccttaagatgcaggatgatgcaaaggctaaaagccacagtcagaatccaagtcaggaactcagandtgatcttttggtccatcaccaccagagactcttctagaacaggccttctaagactgaattacatcaccagctttcctgggtctccagcttgcagatggcacactgtgggacttcttagcctgcagaatcattgaagcacccattgattgccccttactctagggatttacagctttgtgcttgtcgtggccactgctcccaaagtgactataatccggagattcccacgacccttcagagcaggcaagacaccagcaccagaaactctgaaaacctaaaagtcaagaacaatgcttttgcattttcctgtc

SEQ ID NO: 10411 - DNA, 468 bp, Homo sapiens
taggatcatattcattcgaagcaaagtccgttacaaaggttcaagatttccatctcaaaacactacgctcttttatgggaactgtgtgaactgaagtggaaagcatctaccatgctgaggctaaaagaaaagatgaatcattttagtttgcagatggatcgtaaatataattgttggtatcagctttagctcaaaaccaatattaggtgttttaatttccttttaaggtttggaagacagccctaatctcaggttggggagctcatgttagtagcagtgacttaaggctaagtgtagaagataatttaagatacattttctttatatattagccaacaaattatatttattggttggcttgcttttccgttctgattttgagagtgcccagtttggtttagttgaccaatgaatgtcaaagctacttagttgagagaatttccttgttcataaatgtagagcagtgat

SEQ ID NO: 10412 - DNA, 445 bp, Homo sapiens
  misc_feature 321,323: n=a, g, c or t
attaatgaatgttcaaatatgtttaccggttttttattggatggcttattttcttatcattgaattttgtgatgtttctaaaatatatatacatattttgaatttttggccaggcgtggtggctcacgcctgtwatcccagcactttgggaggccaaggcgggcggatcatgaggtcaggagatcgagaccatcctggctaatgtggtaaaaccccgtctctactaaaaatacaaaaaatatatatatatattagctgggcgttgaattttttatcagataaatcatctacaaatattttcttctactctgtagctgcttntntcactctattcacaatgttttcgaagactagaatttttaaacgtttgattatcttttgattatctgttgattctactaaagataattaaaagtagtatactaaggtatacaagtaaaaaaam

SEQ ID NO: 10413 - DNA, 505 bp, Homo sapiens
agtgcttttatgtgctgagcctttcccttcaacctggactgaaagaggatggcaatctcgctgaagctgtttctttttcttcacaacatataggaaagtgttgcccctttttggagtggtgcataggacgatgactatagattttcatctgtaactcctaaaaacttactcagaaagtaacaacctccaccaacactacttgaatcagtactgaacgaatgtcaggtccttgggaaattctccaatcctgtctcctgtcctggccgggtgtgctcctggtgcaccattcgactaagtcaatttgaactatttgggagacctttgtacctacgtttccttctgcttggaagatcctttctgttttgtcagctcttacttccatgttgtggaaaactgatctgacctcctagtcctgaatcaggggccataaagaaaattgatgaggacaactggcctcccaatatgtggattcagtttccatatgtcaatttaccaaactcccact

SEQ ID NO: 10414 - DNA, 510 bp, Homo sapiens
agatttccccaaggagacgattcagaatagaatgtgatgtggtgcatgctttccttccttccccttctcccttgtttataggcagaggtcactacagagtcaaccatcgtggtttctgacaagccttttccagctctgcagtccagagatcctgaacacgatcatcttctctatgtaatttcccattcccttaaaattcccttggattcactttgcggagggcagagaggtgtgcttgatatggtgttttcttcatctgaggccaaaagatggagcatcagggtagaaggagaaattcttagaggaagcaggaaagaggagtccgagttgaccactggatgtttttttctcctaataatggtgcccaaacttctttttcaccaaggctgaatggccatccgcaaaatctccaacctaagagacggtttcatctacttccaggcaaaactgacaatgtgaaaataccggagtcactgagcaaattcactccagcctgtgctgactgagact

SEQ ID NO: 10415 - DNA, 461 bp, Homo sapiens
  misc_feature 395: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatscctggctaattttttgtactttcagtggagatggggttttgccatgttggccaggctgttctcgaactcctgagctcgggtgatccaactgtctcggcctcccaaggtgctgggattacaggncstgagccactgtgcctagcctgagccaccacgccggcctaatttttaaattttttgtagagacag

SEQ ID NO: 10416 - DNA, 358 bp, Homo sapiens
acttggacttggaatcctggaaggctggccagtaggctggagcagacaagatgagcagaaagtggcctcgtgtcttgctgggacctgagcccttgatgctgtccacacaggtgaccctcaggagtgcagagcagggccaagaagagtggtgtgtcaagaaggtttcaggcacagctgagcagcagtaacatcgacacagagacctgaagactgacaacagactctggcagtaagatacagcaggctctgaaagaaactgaagtattttactatcaaacagatttctttgacatattttgaaatagctctgcaaagctgtctcttatgaggaaaatctacattctgtgaagaaaaaaar

SEQ ID NO: 10417 - DNA, 547 bp, Homo sapiens
  misc_feature 484..486,488: n=a, g, c or t
tagtctttgtggtcaatagttattggtaatactactagtaatatggtacatggctataagatgcttagcttagtgtcagttattattctaagagtttaaatctaaaaagcttccctcttgtgctctgaaaaatgcttactcaattgctttgaaaaatgtttatccttttccacagaaattcaagatgtaaatacaacaaagccttgtcatattagctatcttttttcaaattagacagaaaaaaattcgtgacactatttaatttcagtgctagtgagcagatgttttagggtgcaagagccatgttgctatttcagttatgatgtaattaagcaacaactgtctggcctgggtctacttcggtcccctttgcaggtcagttgcttggtgtttctttgtaaaccagaaaaaactgagcaaaacattcattcatgtagctgtagcaccaatttgctggcatcaatattatggtaaggaaatgrcnnnwnttgaacattagcctaataagctctttgctactgctatggtaagatatcaaatgaaaaac

SEQ ID NO: 10418 - DNA, 522 bp, Homo sapiens
attttatttactctacaagcacccttaaggtctcattgtcctgaggtcgtcaaaataaccgttgctttggcatcatggctgtgcacacctaacttggaattacttaattcattatgatgcttccaaagaaaatccttttggttgatgaaagcaggagataaagataataatggcaaccatcgactgaagtactaggcactgaatgaagtgcctcatatgaactatccacttagctcctgcagtaaacccttaatggcgctattagtatccccagtttagggatagagaagctaacgctcagagagagaaagtgatttgcccaaagccacagtgttagcaggtgacacaaccaagattcagacccagtttcttcgtctaccctaacagtattgccaaagagagattccaaagttaccgcctggccactgggtaaacctccgcagcagagagacctactttatgtttcattttcaagctcctatggagccagcagagagagctgacaaggaggaatactgcgag

SEQ ID NO: 10419 - DNA, 73 bp, Homo sapiens
atttccaaagccatggtgaaacatctctgtgctaatttcttttgttttgtttcctaatttttttttttttggc

SEQ ID NO: 10420 - DNA, 77 bp, Homo sapiens
atttccaaagccatggtgaaacatctctgtgctaatttctttwgttttgtttcctaatttttttttttttggcaggk

SEQ ID NO: 10421 - DNA, 425 bp, Homo sapiens
  misc_feature 310,419: n=a, g, c or t
tacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgsagtgttgcccaggcgtctcgaactcctggcatcangcgatcctcctgccttagcctcccagagtactgggattacaggctcttyctttttaaacataaaagttttaaattggtatwamctctgtactctgccctagatkgtttnagcttc

SEQ ID NO: 10422 - DNA, 535 bp, Homo sapiens; identical to SEQ ID NO: 10397

SEQ ID NO: 10423 - DNA, 357 bp, Homo sapiens
aggtttatgacctggcaggtgcagtgagggcgggggtgggaggttgcgcgcgggaagsgagcgcgcgtgcggccgggggattggtaaggctgaagctcagccccagtggccgaagaggcagaggggcaggcagggcaccggctgggctcaggcktcttccctccttcttcgcggtasacgccgcctcgctacacctgtggagggcccacactctgcttccacattgtcttcagaaatagatcctaccggctgggcgaggtggctcacgcctgtaatcctagcactttkgggaggctgaggcgggtggatcacctgaggtcaggagttcgagacccgccagccaagatggcgaaaccs

SEQ ID NO: 10424 - DNA, 72 bp, Homo sapiens
attttccaaagccatggtgaaacatctctgtgctaatttcttttgttttgtttcctaatttttttttttttb

SEQ ID NO: 10425 - DNA, 441 bp, Homo sapiens
attcctgcttctccccggcctacgggcgggcccgcgaagtatgggacgctccgtgattggccctagctaggcgactggaaaggaccaatcttccgatcgcctcaccgcagtggcccagtctcagatgccgattggcttgcgagagtcgaaggggtgacactcgtttcgtgacagatctggggaacttgcagcagagtcacagtcgcttaaaatttcactgcaaattacttcatcagccatctcagcttcagtgatctgggataactaaagttgagcaccgaagacaagctctaaatgattgaataccctggaagaaaggtcttttatactaatcttaacctaatcaagatttgttaatcttattggtacccaatttaatcaagccaacaaaaggaaatgtgatttttaaaaatggctttgaatcctaaaaaaaaaaaaaaa

SEQ ID NO: 10426 - DNA, 544 bp, Homo sapiens
acacgtttccaagggcatgggccagccactggacaggccctcttcgggtgagcgatggcaaaatatagggtccctcctaagaacagtcattaggagagcagcagctgtgagggctgattagcctaraagggaacatwrgatgtgtcagccaatcctctagcacaacagaattaacataaaacaagagaagcagaggaacagactgtctcattgaaccaccatgacagcagaggtcaatatggactatgaccagttcttcttaacccataactaaagggaagcagatatattgacctgagagagcttgactccaaattatacaccctcctctgagatcctcagacactaacaagaggaacattctgaacatctggaatgagcaggaccacagttaatttgctcaaattgggagcaagtaagggccatgtgttgcaattgcttgatgggagatgtgtctctgaagtcttgttaaatttacagaccttcttcggtgacgaccgccttccctgtggccctagatgagcacaagggcagtctgtgtgtg

SEQ ID NO: 10427 - DNA, 198 bp, Homo sapiens
taatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcggtcaaaaaaaaaaaaaaaaa

SEQ ID NO: 10428 - DNA, 517 bp, Homo sapiens
aacaacgtactgtagttcccttccgtgccgtggtaggtttgttgttttgctttttacaatgaatcttgttgttgctcagtttccattcgtatttccttcatgaactgtaacactcacagggaaagtcagcagcttcacttctagagccagcaagactgtgaacccactgggagggatgaacaattctgccacctttatgaactgtaacactcgttgcaaaggtttgcagcctcacttctgaggcctgcaagaccacaaacccagtagaaggtaggaacaactccagacatgctgcatttgagagctgtaacactcaatgctgaaggtctgcagtttcattcctgaagtcagtgagaccacgaacccaccagaaggaagaaactctggacacatctgaacagccgaagaacaaactctaggcacaccatgtttaagaactgtgacaccaccagggtgtgcagcttcattcttgaggtcaacataaaccaagaatccaccaattccagatacagttcac

SEQ ID NO: 10429 - DNA, 80 bp, Homo sapiens
aacagaatataggacgttatataaacataaatttatagtttataaatactttgaagcaaaaactcaagtaactaggactc

SEQ ID NO: 10430 - DNA, 550 bp, Homo sapiens
atgattttcaccatgtttcagaaatctggatgctaagaaggttatgaaaaaactatgcgtataggaaaatggcaacaaccaaaagacttaaggaatgtaaggagattccccaatccagagtgcttgggaataagagtttctggatggccaagtttacccagatacctaaagtaaaataagcaagaaaagctaaagcagacatttttgtttggtgtttcatcagagactctctcaggaatggggccacctcacagagtcacacacacaacccttctttcagaggttggaatgcagaaaacccagcagcaccagctctctcttcagacaaggaagaagatagagacaaacagggagaacaacatgtaatggcagaggcagagattgcatcgatgcagccgcaagctaataaatgccgaagactgacagccaccaccaggagcaaggaagaggaagtgtactgaagatgcaagtttttttcatctggagttctgcctgaccaagaattaagcctataaatctatcttgccattcaagcagagagcactggaca

SEQ ID NO: 10431 - DNA, 317 bp, Homo sapiens
agaaataactgggggcatggagaatgcggtggctgtaaagggccgctgaggcggtggaggcctggcagagagcgtccccgcggtcgcggcttctggcttctctgtggagcttggttcttccgtggtggtgcagcaccccaggaacttcaggaaccagtccttccttggagagctccccgggacagccacgggggccaagtgaaactagcgcgttttcttggatcctacactttatagtgagtcataaatactttaaatacaaagccaacaacatttgctgcaaataaacgtaaaaatactgttaaaaaaaaaaaaas

SEQ ID NO: 10432 - DNA, 587 bp, Homo sapiens
gaacattcttgaacttcagtttcattcctacaatgagtgctgggataataacctgaagatctttccattctctgtttttaatgcaacataactttttgaaagaatgtgtaaaataggttggattttctattttactaaagccttacagaagcacctctgagactcaatcagtgaaacaaacccaaggccacgctgtaagtgtgctttacagcttacttgaacttgctattcttattagaaccttgatttattagataatagcgaaggcatcctatatgttgcttatacttgtggtatctcctccaggtacagaaaaaccaaacaaaccctacattgtttaaaaatagcccattttcattttgggtcttcataccaggcatgatactgaaaaatatttttttgttttctttttgttgctattattttttagtaagaaaagcagattctttttataaaagctaattaaatcctaaatcttgtatatttttaactggacatagagtggaccaaaggaaataaaaatgtgttcttatatgtttgttttatttctaataaagctctttaatcaaaaaaaaaaaaaatgcgaa

SEQ ID NO: 10433 - DNA, 435 bp, Homo sapiens
cgttaattagagtcttatattcaagtctccttctcagagtgatttattggcttaggtctggataatttaatatggtgtccctaaaacttttttagaaattatggggaatgacaaagggtatgagggggcaagagactttgtactaagaagtgacttagactgagtgtggtggcacacgcctgtaatcccaacactttgggaggccgaggtgggtggatcacaaggtcaggagttcgagaccagcctggccaacatggtgaaatcccgtctctgttaaaaatacaagaaattagctgggcatggtgtcaggtgcctgtaatcccagctactcaggaggctgaggcaggagaatcacttgaacccaggaggcggaggttgcagtgagccgaggccatgcactgccctccagcctgggcaacaacagtgagactccac

SEQ ID NO: 10434 - DNA, 237 bp, Homo sapiens
aatctgttgtttagctcgtggttgtgatgaaggatattggtatcccaaactccagccctgtggaaaactacttgcatttttatgacctccatgttcctcctcttcatcagatgaatctgcagcataagccaccaagccaaatcccttctctgtagttttcatcttcttggctggataatctagaatagagaaaaaacaaccccaaccccatccccgccaagggaaaaaaaaaaaaaw

SEQ ID NO: 10435 - DNA, 333 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcg

SEQ ID NO: 10436 - DNA, 469 bp, Homo sapiens
aatactaataacgccgagagcccattccagcactctgccaggaggtccttctcgttaaagtaataacagcagaaatgggacccttaaagcctgctgatttttgactaagtccttgtcaagggtaatctggggcatgttaaataagccatggctttcctgaaagacgaaaatgatgtgatatcgaaagaatgacgtacagtagagacgggagttcaccatgctggccaggctggtctcgaattcccgacctcgtgatcctcctgccttggcctcccaaaatgctgagattacaggagtgagccactacacctggctctgatgtactaaaatttctatgccaatatggaatatgtatctttaatgcaacgcacagtgctttgctaacagtagttgcccaatagatgttgtttcttttaaagttaactaacaaataaagtccttctaaataatcaacaaaaaaaaaaaaaaw

SEQ ID NO: 10437 - DNA, 306 bp, Homo sapiens
ctatttttcctgatactgtgcctttgccattttgataatgctattttgattgagtgaattttatttcctttgtattcccatagtgaacaatatattaaggtagatgccctttatctgggtactcctggtagattagctgttacacctcccttcccttttttacagtgaacctgtattcagttattgtcactctgagaactctccaataacaatttcttttccacagttaacaacacagctgttacacctcccttcctttttttcacagtgaacctgtattcagctattctcactctgagaactctc

SEQ ID NO: 10438 - DNA, 500 bp, Homo sapiens
atttcctaataagcacgtgcgcaaacatctcagaaacaggattttcatgtattcaaacttgaaataatgttgtgtgctatgatagcaaacactattattatataatcagaactgaaagagttgttatcttcaagacatcttcaaatcagccttccttcaatcctaaggaacttcatttccgtaaagttctttacttcaggatgaagttggctgggagcggtggctcacttctgtaatcccagcactttggggccaaagtgggaagatcatgaggtcaggagatcgagaccatcctggctaacacggcaaaaccccgtctctactaaaaattaaaaaaaattagccaggcgtggtggcgggcgcctgtagtcccagctactcgggaggctgaggcagaagaatggcgtgaacccaggaggtggagcttgcagtgagccaagatcgcgccactgcactccagcctgggtgacagagcaagactccgtctcaaaaaaaaaaaa

SEQ ID NO: 10439 - DNA, 486 bp, Homo sapiens
  misc_feature 381..384,405..406,408,412: n=a, g, c or t
aagtttactaataatggccccaaatcataagaatagtgaagctagcaattcagatacggcaaagagaagccataagcactacccttaagtaaaaaggtgaaagtttttgacttcttatggaaagaaaaaaaaaacttataccgaggttactaagatctacagtacgaacaaatcttctatccatgaaaatgtaaacaaggaaaaagaaattcctgatcgtctgctgtcttgcctcaaactgcaaaagttgcgaccacagttttaaatgcttagttaaggtggcaacggtattacatttgtgggtgtaagaaacgagcagacacatgttccaattgacagcaattgggtttggtactacccacagtttcgggatccactgrnnnntcttggaatgtatccccwdmnndntaangtgggactactgtatatgcaaggatacacttccccattaacagcaaccatgatgcattatgccagcataatcgr

SEQ ID NO: 10440 - DNA, 360 bp, Homo sapiens
cattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctctttttttttcctaaaaaam

SEQ ID NO: 10441 - DNA, 452 bp, Homo sapiens
attattctgtaagattgggcttagactcaccagtcacactgtctgtctgctgtagtctactgtattctgtagtctactgtattctgtgcactgtttaaactttctggcagctgcttacatcttttggatctagaagtaaaaaacaagatgatattcactgaattgaactatttacatatatgaaactacctcttaaagattagttttcctttttatatgcaagttttgtgaacttacagtattacattctttttcattcatgtatttaatatgtatgctttcttcagggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaaga

SEQ ID NO: 10442 - DNA, 75 bp, Homo sapiens; identical to SEQ ID NO: 10347

SEQ ID NO: 10443 - DNA, 466 bp, Homo sapiens
agaatgtggtcaacatgcagaagtagagagcagctggagagacggagaaagagaaagcatactggtgtaatatgagatgatctatcctgttaaccttaaggatgtctatcctggttccacgctgtttacctgtcaaagagaatgaatagagcatccttagcgcttgctatttgcccagaaaaatatgttttcagtggtcatggaaaaaaaaaattactttgagggccttaatgtgattgaaaacaacacagactggcaggtcatccctcctccttactggactatttctaactgggctcattacagagcctctaaacagtgagagtgaaaagcctcgaacacaaagctcgttaaggaattcattttggtcttcccctcactcctcaccacaatgctctagtgattatattcagtccaattatgtatgttctacatgtaattaaaatgtacaagatgatcagattgc

SEQ ID NO: 10444 - DNA, 463 bp, Homo sapiens
  misc_feature 241: n=a, g, c or t
aagaggatttcctgtcgcgtctgtttgcttattgcttctcagataagttttcatttgaaacagtggtctgaggctctaaatcatttgaaagtcttctctcccagtgttcagacaattcccctggttctaacatttggtgattctgcaagaagccttcatgctagggcaaacaactctcccactttgcccagcgccgtggggtttctggacatgggacttctagtgctgaaagtcccaggwnaaccaggccaattgttcatcctctcacattctcacttgagtagcttatattttgagccatgcttgtttagagaagggaaagacaccatttagaaagccccttcaatgcctaagtgtcaagaaaaatgggatccatcacctagtcgaatagtaacactggatgagaagggagggaagctggtgcccatatgttttgaaaaagcagcatttactttaactttga

SEQ ID NO: 10445 - DNA, 474 bp, Homo sapiens
gcaggaatgaaggagagcagagaggagaggcttggaggttccttgaatttctacgtgaattttaggatcagcttgtccatttctgcaaagaagccagctgagcttttgattggaattgcattgaatctgtagatcaatttggagagcatttgcatcttaacagtattaagtcttctcatccatgaacatattatatttttccatgtatttagatctttaattgccttcaacaatgttttgtagtttttagaatataaatcttgcacttcttttgttaaatgtattccaaagtatttcttttgacactattgtaagtgaaattgttttcttagtttcattttcagattgttcactatatgatatcacttttgtggcatagcatgtgattgctcatgaatggtgctgatacactgatttttaatgacttgtttagatagacaaaaacttcaaaataagatctgccttacgcacaaa

SEQ ID NO: 10446 - DNA, 431 bp, Homo sapiens
tcttagataccccagagatgcccttggaaatcacccgtagctttatccagaaagagatgggacttatgagctatttaaatgccctaaagtggaagtagaaagcatagcagaaacctacggtcgtatagaaaaacaaccagtgctgcgacccttggaactaaaaacttttctcaaagttggcaacacttccccagatcaaaaggagccaacacctttcatcatcgagtggatcccagatatccttccccaatctaagattggcgagctgcggatcaagtttgagtatggccaccaccggaatgggcatgtggcggagtaccaagaccagcggscccccttggaccagcccttggaactggsccctctgaccactattactttcccttaaagcaaaacaagataataatcttttgctgcttaatttgcacatc

SEQ ID NO: 10447 - DNA, 483 bp, Homo sapiens
agatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgta

SEQ ID NO: 10448 - DNA, 505 bp, Homo sapiens
taatttgaaattcatctttcttagcaataaccttgagataaccaaagttcttaatttgtccccaagcaggtcatgttctattttcattcatggataatacttaatgtattttaatttgtttaatgaaatttttaattgaatctatgaaaatgtctgagttttatgaagcaaagaggggaataagtatgagtacatgactgatgggcagatttagacaaatggtcacagaaagtgggaaatggaagagaaaacaacaaatggtacagagaagggctcagagggttaggtggagaaactgagtaggatcagatgaccagagattcagaggaaagagttttttaaagtggatgtcgatcagtatcaaaagctggctgcagaaactaccagtagacttggcatttaagaggtgattagtgacatttttggtgatgtttcaagatagtgaaggcagaaaccagtgtactgatttctaaggagtgagcacataaagcaggtgagcattaat

SEQ ID NO: 10449 - DNA, 559 bp, Homo sapiens
actgactgaatgaacccataactcaatggccacaggctggacagggagagggccaaaggggtctgaagctgctgggtgaatgagaacatcctttgactttgatgcaaaagtcaccggcacttcccaggttacgtctgcaaggagtgcattttccactaaggagggcagctggcaaagcacagccttgtccttttgggtttaacgtccttgattttccctcttagcctcctgtggcaccaccaggcctccagggacaccaccgccctctaaagtgctgtcgcaatgagagaaactctctaggtctgttccagagaacacggctgaggccactggagcttgccccctctgtgadkvgctagtgagatatctgactggaaaagtggtccctgtrmgtgtgattctggtgcatgcttcaaaaggctgggacctcaaaagcagcgatgactcgatagcccagggaaggaagaactcactgtacaaaacaagactgagcatggaaaacaagaggactgcacagtcaaccaccaaagtgatttgaaatcaggtgcgttttgtttcy

SEQ ID NO: 10450 - DNA, 226 bp, Homo sapiens
atccacactgctgagtgacgttggtatcacctaaactaataagccctgtctccatgtctccctgccccaggagttcccttttctctttagctttctccatagtggcccctgaaagatccccagctgtgaaggattttccccatcctgaaaccctgtccaaggcccaccaataaagtttgttgtaattcaaaaaaaaaaaaaaaaaaaaaaaaaaaaaaaaaaaaar

SEQ ID NO: 10451 - DNA, 515 bp, Homo sapiens
caaacctgattattcctcttagatactgggaacagaatttcacagtcatcagagaatataccttttgtattttcgtattaaatatgtactcctattacttaacaattgtagtttaactcgttttttaggtaaaattctaatttttctcttctgttaaaaatttccagttccaacacgaagataataaagaatattaattttatccttattaacttgaaggaagtaatatttatttttgtatttctgtacttaagtatatcacaaatacagttttctgtagttggagaattaatataaagtaacatagtattcaataagaagggatttttctttattaaaaagaggtctgaattataaactaaatatctgtgtaactttgaacaatttatttaactttttgaagatatttgaaacttatttctaaaatgagaaaaatacctatcatgaggagcttttgtaaatactaaatgagacataacatgtaaagcagttaacaaaattctaggcatggtatg

SEQ ID NO: 10452 - DNA, 533 bp, Homo sapiens
  misc_feature 366: n=a, g, c or t
acttattctgggtgataggatcatgggtgtattatttttccctgtttacttatctatatttttaattttttctacagtaaatatatattatataattattagctattgccacaataatactgcataacagaccagccccaaatctcagtagattacaacacaaggatttattctcaagctcacagttctgcagatcaactgcaatttgactgacttaggttgggcatggaagggctgctctgtctcagccccgccctgctaaatcagtcaaattgcagttggactaggtctggctcctcactgcaggtcaggctgtatgccccacgtgccttcattctggggctctggctgaaggggcaacagtdngadtagcttgcttcgcttcaccttccagcttgtcagagcccaagagacaagccaaaatgcacaagcatgtataaatcctctgtttacctcatttcctaacattttattggctaaagcaagtcctatggccaagcccaacaccaatggggcagggaagtatatgccac

SEQ ID NO: 10453 - DNA, 77 bp, Homo sapiens
cacagtttctaaagcagccccacaaacactcacctgatttcggcgtcagacctatgaggcaggtagggaggggttct

SEQ ID NO: 10454 - DNA, 474 bp, Homo sapiens
acattccaggcctgtgctccagttctatgggaaacaccattcaatccagaaatagacaagaaagagggttgaaaccttcatgacaatgctagagaattaacagtgagagatgcattaagcaacaacacagttttgccttttacaagctccctgaggtttttatttcagtcagaggaccaagatttcagttcaagtcactggaagaaaagagctgtcatttatgctctctacttacaggtaaattgtcttgtgattatttccacagaactctgacttggataagacttgtatccattttattacgatgttcttcttttttacaatttagttccccagagggcaagaccaagctacctaagatcggaaccctctgataatttgtgctgctattttaagatccagttccattctacaactggctgaagcatgaagtcaactaaaataaactgaattgagtggaaaaaaaaaaaaaaw

SEQ ID NO: 10455 - DNA, 500 bp, Homo sapiens
atatagtgcatggcacgcacagaaagaaacagaaggggccaggaagcctccggggaaatctgagggcagtcattggctaacatggaagggctcacaaaacaggcttcctccagaggttcctttaagggcagtaaaatttcccagaacttgaacccataactccacactctgagacaagaatttcctctactcctttcaaggataaatgaggcaagaaagcttcaagttgagcttttccaatctgattgcgaacttgatgacaactgaagatacaatgcctggtttttctcagtagttctgctccaacagtctaaaacgcaatcacaaaagacacgttgtttcaaatggaaattctatcctgaaatgattcactccagcacaaactgaaaacccatccccgatggaccttgactaaccgtaatgatctcaatgtctgcaatttcctgtcaaatatgagaacaacatcccaaagtgggagaacagatgaaacaagacggata

SEQ ID NO: 10456 - DNA, 418 bp, Homo sapiens
aattctggagaggaaggtggcagcattactaatcagatgtttgactgggaaatgtaaagagatagtcattacatggacatctggagaaaaaaacagcacatggaagtatcaagtgttctggggccgcccaggcagaggacatcttctcctatggatttctcctgggcaagaatggcatctcggtgcaggacccgcagcactttctctggctccgcagacccgtaatgagcctccagaacctcaggcttggttttctctgtcttcagcatgtggatcacatcttctctggcctgtaatagaaagtgcagcaagatcagacgactgacaatgtaaatcgcatactgggctcaaaaaatcaacagagagcttattgaatacatccccatcttgtcagggctattggcaaaaaaaaaaaaaa

SEQ ID NO: 10457 - DNA, 362 bp, Homo sapiens
mywwyygrawccttycaaaawtgtttttggcmctatggttttgaatgtcaacatatcattagacagttgaccacggaccatagctcacgtgctctaggaatggagcatttgcccttctgtatgaccacagctactctcacttggaggatcatcaatagacaagggtcaaccagctccagaggaagcctcttctacagctcagagaacctattcctttaagtttcctcacctctgttccaatgccagacaagacttttactgcaaacacttcagtatcatttctaataaagatagcttcctagctgaatatctctctgcaaaaaaaaaaaaaaaaaaaaaaaaaaaaaaaaaaaaaaaaaaaa

SEQ ID NO: 10458 - DNA, 477 bp, Homo sapiens
agaacaactcgagccgactaggtttacgcaagcaggtgttcaatttcagttcaattcattatgttgaattgtacgtatttgaattccggtaaaccaaattagtttaaattgccttcttccgagttagagattaccatggctgttttcactctaacagattttcaactgtttttgtaatcaataatgtaagtttaattcttcccccctccctccaaataacttcatgaactggaggcacatgtgcgcccatattttccgctctgttttcctttgttggtcctccacagatagtgccctctgttggatgggccggttcattttagcttccaccttcccttaaaacaattagaagctcttaatttagatggtactgatgttaatgatgatgattttccattttatgcaagttttggccctctgcttgtctaaaagccttgaggcaaagagttatatgcagtttctctgcgggtgtctgat

SEQ ID NO: 10459 - DNA, 465 bp, Homo sapiens
  misc_feature 346: n=a, g, c or t
ttcgagtctttgacaccagaactgaggcttggctggactgtcccccgactccagtgctgcctgaggggcgccggagccactcggcctttggctacaatggggagctgtacatctttggtggttataatgcaaggctgaaccggcacttccataacctctggaagtttaatcctgtgtcctttacctggaaaaagattgaaccgaagggaaggggccatgtccccgccggcgccagtgctgctgtattgttggtgacaagattgtcctctttgggggtacagtccatctcctgaggaaggcctgggagatgaatttgaccttatagatcattctgacttacacattntggactttagccctagtctgaagactctgtgcaaactggccgtgattcagtataacctagaccagtcctgtttgcctcatgatatcaggtgggagctgaatgccatgaccaccawcagc

SEQ ID NO: 10460 - DNA, 519 bp, Homo sapiens
aaatgactgtctgacaggtggtatctgtaacaraaattggaaactctgaaggaagaacaagattctgaggaaacgactaattttttaatgtgttgagcttgagggcctgctttggaactaacaggcagctgaagatttcatttcatgtcaaagaaacttaatttaaaatccatcaagtactaaactcagagctaaatgtgaaggactgaaataccaacttgcccaccatgttaggtttatgagagctcaatgcagaaatgcctctgaagtgggaaaatctataatttctccgaagaagcactgtctgtgctctggaggtcagaaaatttctagactcatgtcttcattagggtagatcgagaagccttttagaaattaaattttggacatgcccatgtgtcctctgagcctgtcctttctgtcagaagtcacgcagagacccaaatgtcaaaaagggacacactcttttgttgatgcacaagattgtggcattccaatctctttctgaaaatacattat

SEQ ID NO: 10461 - DNA, 69 bp, Homo sapiens
aaccgatatcgcgatactgcactccagcctgggcgacagagcgagactccctctcaaaaaaaaaaaaaw

SEQ ID NO: 10462 - DNA, 573 bp, Homo sapiens
  misc_feature 188: n=a, g, c or t
ctgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatntactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatg

SEQ ID NO: 10463 - DNA, 537 bp, Homo sapiens
  misc_feature 366,368: n=a, g, c or t
actttttctctctcctgccgccctgtgaatgtgaaggggtgcctcccgccatgattgtacgtttcctgaggcctctccagccatgcgcgactgtgagtcaattaaacttcttttgtttattaattacccagtctcagaaatttcttcatagcagcatgagaatggactartacggccctcaaaaacaccatttattatctatagctgtgctgttcaaaatggaggcagtgccaatgtgtgactatttaaactaattacaattaaaatacaatttaaaaattagtttctcagtctcattagtcatacttcaggttgcacaataactacccgtggccagtggttaccatagtaggcaacatatacaananatttctatcatttcagaaatttctattgcactgtgctacgttgtgctgtgcaatagcacagttttaacccttgataatttggcaaatgaaaaacatcttgtcttaattttcattcctttgattttattcagctgagcatctttttaaacataattgttaactatgttaa

SEQ ID NO: 10464 - DNA, 378 bp, Homo sapiens
acaaagacacaggatgagtcaagaatgaatgataggggtttaacaggccgatggggaaagtggacatgactcctccagctatcaaattagacssatgctgccatgttaattctccaaacgagaaacaaaagtgtaatagagaacttgtatcgtcaataacgtcatcgtgaaccagactagcatgtggatcatttctgcaattaaggctatggcgcggtggctggcttgcacatgtcaaattaacagrcagcaatgctttttaacagacgccgcctagaaccttctcagcaatcagcttgtgaaaattggacatcggatcgggagttgttatgatggatattacatgctcgggccattagcaccccaaaaaaaaaaaaa

SEQ ID NO: 10465 - DNA, 105 bp, Homo sapiens
agattctcctgcctcagcctcccaagtagctggaattaccggcacctgccaccatgctcaatgttttcttgtattggttgaacatttgtattagttctcctggaa

SEQ ID NO: 10466 - DNA, 63 bp, Homo sapiens
atttgscaaagccatggtgaaacatctctgtgctaatttcttttgttttgtttcctaattttt

SEQ ID NO: 10467 - DNA, 145 bp, Homo sapiens
tatgggtaccaacatctatggmtgctcaagtccctgatataaaatggtggactatttgcatataacctgtgtacatcccgtattatttaratcatccctagatcacttataatacgtamtacaatgtaaatgccatgtaaataac

SEQ ID NO: 10468 - DNA, 282 bp, Homo sapiens
  misc_feature 257: n=a, g, c or t
aattatttgactccagtaggacaattcatgcactttatattaagagagattgcaataaatccttccatgttttaactgaaaccatcaaggaagaactttctaatgattgarattcatcatggaatcactgcaatggccgcaaacagaggcgtctaagagactgggaaagtggccggcctgagataattgacgaccttgccaacctagtggagaacacagatgaaaaacttcgcaatgaaaccaggcgggtaaacatnggtggacagaaagtcagcctcttgt

SEQ ID NO: 10469 - DNA, 349 bp, Homo sapiens
  misc_feature 258,275,285: n=a, g, c or t
attgctccgcctagagccgcgccacctccaaagggtagcaccggccacccgctccgcaaagtccactctcagccgcgcaaaactagaagatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccganggatgggttgatcacangaccgattangctgtaaacaggttttcgrrtattttggatatgscaaaaggtcttttgaatctaaaatcttgga

SEQ ID NO: 10470 - DNA, 89 bp, Homo sapiens
actatgtgtgtgttctcgagcaagtttctcagtgcctgagttttcttatctgtaaaatggggcaataaatttacctacctcaaaaaaar

SEQ ID NO: 10471 - DNA, 64 bp, Homo sapiens
attcttctacttagccttgtccctacctctttactcctctgtaggcagtaattcttttttcttw

SEQ ID NO: 10472 - DNA, 558 bp, Homo sapiens
cattcacttgttctgtcacctgagagcacctagacacaataaaacctcaatagccataaataaaactagtgtccagaacttggtttctaaataccagtctttactggaaggcactggacctgcctggagaaatagcagattccagaattgggtcgagcaagggacaagcagacttgtcccttgtcccaaaaggggctgccactggtggaatatgggacaatttgagcaccaaaataaataatgatattcagatagtttggctatttttcccctcccaatctcatgttgagatctgatccccagtgttggaggcagggcctagtgggaggtgcttgggtcatggggacagatccctcatgaacagcttgatgcccccctcaaggtaatgagtgagttcctactctgttacttcgcttgagagctgattattaaagagagcctggcacttcctcgtctctgtcttccttcctgtctcatcatgtgacatacctgcttttcttccccttccgccacgagtggaagtttcctgagggcctcaccagaaacagatgccagtgc

SEQ ID NO: 10473 - DNA, 474 bp, Homo sapiens
actttgggaagctgaggtgggcagatcatttgagcwgaggagttcaagaccarcctggacaacatgctgaaaccccatctctactaaaactacaaagaattagccaggcatggtagcacatgcctgtwgtcccagccactcaggagcctaaggcaggrdaattgcttgracttccccagcttcaagaggaagagtctgcagtgagccgagatggcgccactgsactccagcctgggtgacaagagtaaaactccctctcaraacaarcaaacaaaccrrrhaaacaaatagcaacagcaaccacaatcatcatcaccatcaaggctggaacaaggrtgaggcaggcaggctctgatagcaacaggaggaagcagaccwwggagggagagaaaggaaggcagasaaggggaaawwaaaacwcaaatgrtrataatagatgctgacatttrcggagcacttactrtgtgctgggac

SEQ ID NO: 10474 - DNA, 547 bp, Homo sapiens
gttttacttagactgggccacttttggacctattcagcaattctgaatcatcagctcatgtcatttctaaagccaagtccccatcctttgactcatcaattatcatatatttttactcatagatattctccctatcactttttaaagatgcaatttatgtctactttccagtaatcgtcatatttttatcaaagcttttagctaccatttgtttttgccacctatgcacttttggtggttttacagcaagaaacttccaaataatttctggtgtcatggactgcgtggtttcccattgttgctctaatctgcccttctcacttcaaacctctacttcctaaaatgagtcaaggatggactctgatgttgttgaaggtatttacaaaatctggaaccatcttctcctgtttctggtaaacatttgcctgtaattttgtctcaggttattttctttttctgcaagtctagctgtagctttcattggcccctagggtctaccattcaaatggatcacagactataataaagtgtttccaattatgaagct

SEQ ID NO: 10475 - DNA, 529 bp, Homo sapiens
  misc_feature 320: n=a, g, c or t
ctcaaaagaagttcataaggccagctatcccttattaagctctagccatgtgatgggcaccttagatatacatataggaagatatggacatcttcccatcttctcagcaaacccaccaggaaggtgtaatcccagttcaaacatgagaaaacagagtcaaagctattaagtgtcctgccccaaatgctacagccagcatgtgggaactgtcttaaacccagcctctcctggacaccccactgagcacatctgcagccaccatgtgatccaaaaaccaatgtatcaggtccttttgggaggcttggtaataaccaaactgnmvgcccctgtgagtgaaagctaggccactgattcctgctcaccctgtgtctgactcgtgacctggcatagaacaaagaaaagaacgtgaggttgctgatgtttatacattttgcatgtaattactaccatagaattatacacttaaaaatttttaaatgatgtatgtatatcatattgaaattttaaaaagcaaacaaataggaggtgc

SEQ ID NO: 10476 - DNA, 515 bp, Homo sapiens
aattcctacagaagctgccatttaccagccctctgtgattttgaatccacgagcactgcagccctccacagcgtactacccagcaggcactcagctcttcatgaactacacagcgtactatcccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagccagtgaagccaaatcgtaacttacagcaagcagcatgcagcatacctggctctttgctgattgcaaataggcatttaaaatgtgaatttggaatcagatgtctccattacttccagttaaagtggcatcataggcgtttcctaagttttaagtcttggataaaaactccaccagtgtctaccatctccaccatgaactctgttaaggaagcttcattttcgtatattc

SEQ ID NO: 10477 - DNA, 454 bp, Homo sapiens
aagggacgtaggaggatgtgatctgtgtcctatctggaatatcaaggggatgaaggcaatggaagtagctaccacttggtgacttagasaaactcttaatgtaaaaccaccatcagagccaccctggagttatggcaaggccaccacagtctcctccaaaggccactgatatggaactgggaacctccctccatagaatgctaaatggctgatgtgaacttggttaaggatctataattcttctaacgaaggttaaaatggagttaaaattcacagtgaacagataagaagacctcttcactgatttgtcagagttacaactcccaagcagctggagagcactaacgataaaaggaccaacccgcaactctggctttctgcctacacatccctgaagatctggcagcttctgtttgcatccttgtcataagacttcctcttccgttcagcaaac

SEQ ID NO: 10478 - DNA, 145 bp, Homo sapiens
aaacgaggggcggggctgtagatgacccggtcgggagagggccacggtttgttgggggagcggctcgagattgcgttctagagaggaaccagagagagggtctttaacctaaatataaatgaatgactggaaaaaaaaaaaaaaa

SEQ ID NO: 10479 - DNA, 419 bp, Homo sapiens
agaaagtatgatgtggatgcatcacagggcctctgaaaaactcaaacatctagcccgtgaaaaggccagcatttggattcctgcctcagaggtagtcagagaagcagtcataatgaacagcagactcttgagagggcagctgtgtaaagaaacatatgcctattcccactctttttcccctggcccaacgaattggaggaaccaggtcttgcaaagaggagggagaaccacaatctttgaaccagattttgctctctaattccttcaacatctcaaatagtgaggatcctcattgaagtctgcattgggaaaaaagcagaggagattttaaactatatttgagattaaaattttaaacaacactgaattttaataaacaagtgaccccaaagctgcacaataacacaaagatatatgta

SEQ ID NO: 10480 - DNA, 503 bp, Homo sapiens
  misc_feature 195: n=a, g, c or t
tttactcttcccagtcaggtaagcagttcaaatataacaagactttgtgccagtcctcttctgtgttctgcaactctggctctcataagtagtaaaaatatttttgatgttgcatgctctcagaattatgttttctaaaatatcatattggcttycatttwagtttaataaacttctttggcaacttaattagbnatagggtatatataaactcaattttatctgcattttttaaaaaattgaaataatctgattgcatgtatgaaggactcctgcctcattacccaattacataaatacaattatctataggaaggtgaaattgttgatctattatttcaaagacttgtagactagcaaagattcadtctgattagaaataaggtctatagctaaagatatttttattttaaaaaattacagcccttgtaacaaaaatcatttgtaacattggatatgaagacattattagtatttaaaattattgtagtcatttgatcata

SEQ ID NO: 10481 - DNA, 450 bp, Homo sapiens
  misc_feature 267: n=a, g, c or t
acaggaagtttggctgaccccccacgcacacacccactcgctcgcctcagtgtcgtgtggctgccgcactgctcgggacccagacgtcaagggtgctggcggggcctccccaggcccgcgacgcagggctccgcccggacaggargagccgcrvccgccccgctcccactcactcactcactctcggccttcggaactcctatgtccgcgaasccgaaaaaacaggtcagctaattcgttgacgtcactgccaccccgcagtagcgnagggagtagtttttcccatcagcggaggcgttgcaatggaggcaaacgagaaagaaaagatcactgcttaaacatttatcaaaggtctccatggagaggaccttcgaagtttcaccgcccgagaaaggaacttgcagaatcaagttttgcattatatacgggacggggtatgcagtgagtctg

SEQ ID NO: 10482 - DNA, 398 bp, Homo sapiens
  misc_feature 121: n=a, g, c or t
agttgcggtgtatatctttagactaagccccatccctttcatgggcaaagctatcttcctgtgggctcctgggtgggatattgggatgcctcatggagctggacwrtccactagcaccctnctaggctgtacctgccamctkctgtttaactgaacgkttacgactgtcctgattctktaaaaaaactgcttgaggctgggcatggtgactcacacctgtaatcccagcactttgagaggccgaggcaggaggatcacctgaggtcaggagttcgagaccakcctaaccaacatggtgaaactgcatctctactaaaaatgcaaaattagctaagtgtggtagcgcatgcgtgtaatcccagctacttgggaggctgaggcaggagaatcgcttaaas

SEQ ID NO: 10483 - DNA, 369 bp, Homo sapiens
aacattccctttggttaactgaagatctctagtttcatttctccccaccaccatcccctttgttcattcacttgtgcattcagtcagcagaggagccagggggatatgacgaactttcactggttatatactatgtgctggttacagtttaaggaatacgaagctgtaaggtttgctctctttctgcaggaagctcacagtccagctaaggagacacgtgcaaaaataaacaatggtgatccttaggggtagatacaatactggaggtggtacttggtacaatggtggctcataggagggagagacagaattgcttaattggatccttcacaaaaactgatattcatcatgattcaacttccactgtat

SEQ ID NO: 10484 - DNA, 343 bp, Homo sapiens
actttttgggttcggatttccgttaaaagctgtaacactgggagagtctgcggcttcactcctaaatcaggaagaccacgaactcctcgagagaagcgaactctggacgtgacacttttaggagctgtaacacggcaaaggtctgtggcttcattcctaacgtcagagagacaacaaactcaccgggaaaaatgaacaactccggacccgccacccttaggagctgtaacacggccagggtctgcggcttcacttccgaagtaagcaagaccacgaacccaccagaaggaagaaattccggacacatgtgaaatggaacaaacgactgacacaccatttttaa

SEQ ID NO: 10485 - DNA, 474 bp, Homo sapiens
  misc_feature 455: n=a, g, c or t
tttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacngccattttcctacccacag

SEQ ID NO: 10486 - DNA, 369 bp, Homo sapiens
taattgtaagtttcctgaagmctctcagccatgcttcctgtacagcctgtggaactcgtcttgccctgtcgtccaggctggagtgcagtggcacaatctctactcaccgtaacctctgccttctgggctcaagcgatcgtcccacttcagcctcctgagtagctgggactacagtttcagatttgcaaagggagacgtgacatcaagtttgaagaaagctgaattactgggactaacagagtgaaaagaatatggactttcaaggaatrgggaataggaaggccagaaaaatttccttactccttcttcaaagatgatgaaatacaaaatgaccccaaatgaagcggatagaacaatcagtgttacaag

SEQ ID NO: 10487 - DNA, 439 bp, Homo sapiens
aagaatactgcttggcacatgtgcaccaagtcccctccaaggagagaccctgggtaatgatgatctttggtgtcaactaagattcttaagaactggatcctcgtgattcctatgtgacctgaaggacggatgaaattcaccaaagtctctaccacagacattctcagatggtcctaataaaaagaagaaacccaaaccagaactggtggtccacattgtgagagttsctgaatatcatcacaaagcaataattatccaacagcatgcttggtggctcaacattctgaaaggcaaatgtcaagggcacatagtctcaaccatgttgctgatgggagctcatgtttttttgtgttagggtggtcttgtgttctagcctggtggtctttcttctgcctgctatgacagcactaatgatttcatgtacacagtattcacttgt

SEQ ID NO: 10488 - DNA, 435 bp, Homo sapiens
aaaactgtctcactggttctaggtacacaaaacccaaatctgagaaatccactagattggcagaagcaaagggactcagtaccacaggaagttcgcttttctgtgtcactatatcaaaagctaccacaaatgcagacaataacggctctttaatattaaagggamaagctaacctgtccagctacagcagcaaagtaaccatacagcggatcctgagtttgtccgggaaacgcaggccctccgggagcccctccatactgtgaaacaggaaacacatacacgtcattctgccgaatcaagttttcttctttcaccactgagggcttttgtgcaaggcdggacaactgcccgcctgcccgmccttcacaaggtcacctccccaccaccgggsacactctgccaacactccacccctctcttccattcacaccccgt

SEQ ID NO: 10489 - DNA, 494 bp, Homo sapiens
  misc_feature 180: n=a, g, c or t
atttaggacacttgttcttgscggttaagtccyctgttcamcaatcttccttctggatactttggacgaagaccgcccaccttgtgtattcctcggtgcgccaccaccttctggggtcactgtgagttggctggagataagcctaagtgaagtatggatctgccactgccacacctatsncctgcatgagaagagagagggtccttattgaatgraagtccacaactgaatctctgcacactattttgcttcttccaagtgctgaagtatattggaaaagtctctaaaataataagacttaacaggaaatgtttctgtcagtaacaattatatagcttcgcatcagtagtatctttctcacaatttatttatcataatttccaaaatgctaatcaactaaatgatttactttcttcctggaaatatagvaatagracacttatttttattttgratacttattactttttaataaaacttaattacatgktaaa

SEQ ID NO: 10490 - DNA, 343 bp, Homo sapiens
aagamattactgaaaaacctccacgaacasaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggratgttgaaagtattgctgaacagatggaaaatccsggatttgaagaatgtyggttctagtactggggagaaaaatgaaagaacttcagtcggctggaacagtgatg

SEQ ID NO: 10491 - DNA, 625 bp, Homo sapiens
aaggcggtttgggaaccggtgagtctcaggcgcaggcggtttgggaactggtgagtctcaggcgcaggcagtttgggaactcttggttccacgtgaatccactcatccgctctgtgcctctcacctgtcaaacaagttcctcatcagacacaagcagcccagacgccttttccatcctgggaagaagcgggtgagcctccaggatcctgcccaagataggaccctagtgcggaggccagttgaagaggagccctgagggagggcctctgactttgatccaggtgcccggaacagaccgaaattaccggacagtagcaaccgcagagatgctcagatgcagagatgtcggccagtgaggctcgcccaggtggccactcatgattttcccacttcacaatcattgcatctaagagcacttcatggaaacactgaagccagggtgattactgtcagtgtggttccttgacttgccctccgctgtccactgcccccaggcccatgtgacaaccgcaactgcgggcgcccgggcacacagccgacttagcgccgtccggaagcagagcacgtgcttcgtaaaaaatgaaatgactctctgcactctgaaatctttgaacatgtgcatctc

SEQ ID NO: 10492 - DNA, 555 bp, Homo sapiens
ttaaggtaggcaaagcacctttagaccagagcattcctattactttgaccctgctagtgaacctggaggtcttgtctgatagggaaaagtgtctctgagtagtgtcttgtcttcggaataattcattagcaaagagttttcactcacaggtgaatcccagattgaagtttccggcttagactctgtgaagtctacttgctccttcactggcatttataccttcctgaaacctgtgggaataactttgatgtctagtaatagaagcactgagacagtatcatgaactttcagctccctcttttgagattttagggccattaggctttctttctttggctctttaaggcctggttgcttctgaatctgaaagatgttatcacaaaaatagttcagtggagccttttgctggttaacttcttactgtttcttttacagtgattaaagcttgtttttcattcttcagaataattttttaaggatttctagctcctcatctttaaactcattcgatgatagaaaatttagtgtgacattcacaatttttatgacagtgtt

SEQ ID NO: 10493 - DNA, 600 bp, Homo sapiens
aaccattccttaaaccagaaaaatgaaacagcatcatcagtgtctcaaattgtcaaatgactgggaggaaaacccttggcccaggagagatcacggaaggctggtcacaaaccaagccagatgttgactttcttaagaccagcgaatagagacaggagtttcttttatacttagagaaaccagagagtttcacggtagcgtaacaacacgagtgcctctggccactctggatccactctgcctcctgcctctcagccacacagtatgcccattcttctgtggcatcatttatctccctccggttttctccactgtgaatcctcacacatatcacttaacttagtaagcaagtctccatctgtcttgaaaaaaagaagaaaatgatgatggaatggaagaaagagaactaaaggagagccatcaaatcagacaaaagctatctgtctctttggagagacaacctctgggctcatccactgcattacattcttagagcttgtagaagagcggtcattaaatattttcaaggctacagactcsttcaagaattgataaaagctatagaacttctttcacaaaaatgcatgtattgcacactga

SEQ ID NO: 10494 - DNA, 312 bp, Homo sapiens
  misc_feature 129..131: n=a, g, c or t
accttccttcctcagtccatgataccatgtagagtgcatgtatttaagaagtgttatcagggctggacacagtggctctcgcctgkvatcccagcactttgggaggcccagacggatggatcacttgvnnncagaagttcaagaccagcctggaaaacatggtgaaactccgtctctactaagaatacraaaattatctgggtgtggtggtgtgcacctgtaatcccagctactcgggaggccaaggcaggtgaatcacttgaacctgggaggtggaagaagtaagattccatctcaaaaaaaaaaaaaaar

SEQ ID NO: 10495 - DNA, 469 bp, Homo sapiens
  misc_feature 195..197: n=a, g, c or t
aaattccaccasatgtacaaagaagagctagtaccaattctactgaaactattccaaaaattgaaatcaaggaggagggactcctctatgactcattctatgaagccagcatcaccctgatatgaaaacctggcaaagaaacaacaaaaaagaaaactacaggccaacatccctgataaacatagacacaaaatnnntcaacaaaatacaagcaaaccaaactcaacagcacatcaaaaagttaatttaggctgggtgcaatggctcatgcctgtaatcctagcactttggaagaccgaggcaggaggactccttgaacccaggaatttgagaccagcttgggcaacataggaagaccccatctctacaaaataattagccaagtatagtgatgtgtgcctgtagcccagctactcagaaggctgaggtgggaggatgacttgagcccaggaggctgaggctgcagcaa

SEQ ID NO: 10496 - DNA, 373 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctgvctaattttttgtactttcagtggagatggggttttgccatgttggccaggctgttctcgaactcctgagctcgggtgatccaactgtctcggsctc

SEQ ID NO: 10497 - DNA, 406 bp, Homo sapiens
agttctagtgcctctggttttgtattcgctcagggtgcaggagacttccaattagtttctgagttttcacaaagggagtttgtccttacgctgttgctgaattggtgtgtttgttgtgaggaagggtacttcggggtttcctactctgtcatattgctgacatcactctggttaatctttttaatgtggatcacttatgaaaaatttcctcaattacataatatcttcaaacaaacccattrrcaaccacttgctgcgaaaattaatacatattaagaaacaaagttaggtgtttggcattagtaacagtaaatatgtactatcagtggctgccttaaaatatttttgggagttttcaagtcatagggtatgaaaagcatcatctttcatcacagaacacctttgc

SEQ ID NO: 10498 - DNA, 390 bp, Homo sapiens
ttccatcctttgatctcattttctgggagcaacacaaaaaaaatgtggcttccttgaaagttcttcatgtatttaaagatcactctcaagcctgcagtcaacctggagtaggcagatgaagcagctggggaaaagacctcttgacctaccaacaaacaagacagagcctgtctatgtcattcagactggcctcaaactccagggctcaacaaagcctcctgcctcaacttccccagtagctgggactacagcaaatatcttccactgagatcgtgtggttttaatcatacaaggagagtggcagaagaacagaaagattgaaaccaaggacagagaacacctgaaattggaatggcttcaaatgttcagtggaagtgaacaagttcttgt

SEQ ID NO: 10499 - DNA, 441 bp, Homo sapiens
aatatttagcaactgttgcggctctctactgtgtctgccattaaccctgtggatgctggactgtcagattcaagttgttttggcttttactacaaaaagcatctttacatatatctgcaatttaatggataatttattttccctttccatacatctgaaagaagaaacataattggtatgaacagcacttaattccagactgacttcttttgaactgtagagactggatttcaccatgttgcccaggctggtctcaaacttctggtttcaaactgtctgcctgcctcagcctcccaaagtgctgggattacaggcgtgasmaccgtgccctgcctctcttcaaggactctctttgctacatcggcatcacctgggaacgtggtagggctacagaatcttgggccccaccttggacctacctaatcgtcatcttattcattg

SEQ ID NO: 10500 - DNA, 142 bp, Homo sapiens
acaatgattggactgtcatctcttcccacttgtttgttccagttttagctcgtcaggtcatgtagatttactctaccatatrrcaaaccttkrratacctgaactgatactcatgccctactttctccacctgacctctgar

SEQ ID NO: 10501 - DNA, 467 bp, Homo sapiens
  misc_feature 16: n=a, g, c or t
atttttattsctcadnccccttccccctccccacggagtccccaaagtccattgtatcattctaagatatgttgtctggagctgaagcagccatcttgtgaccatgagggagatgccgagagagatctcagagcttccggccgsctcgscacggctggtcgcagcctccctccagaatgctgagatgggggcgttgttgtgtgagggagaaagaccctgttgctctaagattttttttttaatgtaacttgcaacaaaaaactttcctaaataatatggacgttaaaaggccttcagagaaacacaaccagcccaccagcccctcatgttttctgatttatttataatttttacctcacctgattcctgaarhagaactgacgaagctgagagacgctggtcactgaccctgagcctaaggtttagctggagttttcttgttgacctcacggtgatgcttctggtac

SEQ ID NO: 10502 - DNA, 487 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggcccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagat

SEQ ID NO: 10503 - DNA, 454 bp, Homo sapiens
  misc_feature 107: n=a, g, c or t
aagaaatagggtgaaataatccaagagtggaagctgagataccagcttggaaattattgcagttattcagggaacctaaatttgaggtcaaggatcaaaacgagccntctctctgtcaagagatttctacttagacttatgtcttctgcaatgtcttctgcaaatgatttactgaaggcttatgacaacattatttgaaacctgaagatgggtgtctgcactgacagagagagctccagttttcaaattactttcatacacggtataatttgaccttcatataaccaccctgaaagggccaggaaaatcgaaactatatcttaaattgtgattaaaacaaattcacattttgaagaccttatatattttctcttcaatcttctaaaattcctttgagatgaggaagaaacagtatctccatatatagcattaggagactaatctataagtcagt

SEQ ID NO: 10504 - DNA, 399 bp, Homo sapiens
ttgtcctccagagactgcaccacctgtagcatagaaaaccaccaccacggacctgccagcsatcggcgcasaaaccagccagctgtttgctgccaaattccttcctctcccaggtccagaccaaatacaagatcagcaccacaccgtgtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgttt

SEQ ID NO: 10505 - DNA, 433 bp, Homo sapiens
catgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagccctdcccggscctccccagggccccccgccccctcctctgcctgctgcgtggaggcagccatgggaaggagccbaggggagctggcctgggggagcgamsccatgttcgmttcctgacttagagctggggggggtggggggtggggcttgttcccctgcagtatctgttctgtgaagtttgttaaatgta

SEQ ID NO: 10506 - DNA, 402 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaa

SEQ ID NO: 10507 - DNA, 395 bp, Homo sapiens
acatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactaggggaagtcttaaatgtgtacatgtagttgaatttcagtccttacg

SEQ ID NO: 10508 - DNA, 155 bp, Homo sapiens
attcaaaagactgggccgcaggaccttctagcccacctgtgggcggggtgcaggcagcagagcctgcgggcrtctgccctggccgccccaggctcctggcttcatcacgcctcccaccagctcctggatgacacagcttgtctccctcgggctct

SEQ ID NO: 10509 - DNA, 338 bp, Homo sapiens
tcaagctgtagtaaaattgtgaccttaactttggaggcagctaagggtaatttacctgcgtaattctcccccatctgatgttagaagtaaaataactccttaaaaatggtaaactattctggtcaatgtgaagctaaagcagtttwaaaaactctgactttcatgtattcttgacaaatccgtttacctcaatatggcataaatatgcctttcaattagtctcacatttattccctttgaaacactaggatttcttggcaaagtacctgtttctcagtgaataaagctattatttctttttcttgccattagatatttaargcaaaaatacatagtga

SEQ ID NO: 10510 - DNA, 346 bp, Homo sapiens
ttattggggatacctgtctctgaaaaaaaagcttgagccagaggcaagaactctgggaaattggtttctctgctgctagttgtttttggtatgagtagggttaaagcacgaattgggagctctcagcgacatcaccagtcagcagccmaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgca

SEQ ID NO: 10511 - DNA, 577 bp, Homo sapiens
aaaaatattaggggttaaataccaggtatcattagctttccttatgttaaatctgtgatgagacagaatcccgtattgttgcctaggctggtctcaaactcctggtgtcaagcgattctcctgcctcagtctctcaaagtgctgggtttacaggcatgacccatcacacctagccttgatgagtcacaaaaatcacttcaaaatgtgagtaatcccttcagatggaccatgaatagagaccacaatgctggaccaagttgtatgttgggctttcactggtgaccacataaatcacaaagcttctgaccccttccagtaacgaggacctctcctgcactaacatatacctgcagcttctcacatctaaccaatttcattttggcctcgtgcttctgctaatactctaccaaaactaatcctaattttttcctcttatgactaaggrrataaaggctggacagatgccactgcacatgcccattctcccctccctggcaccttaagcccttttactggctaacattatgggcctctattaaatggagagaaaataaagatgtcaaatgtaaactacgam

SEQ ID NO: 10512 - DNA, 386 bp, Homo sapiens
aaggctggaagaagcatgggggcgggactaggaggtgcgtctgggcgctgaggagcggcgggaacccgggtaggggaaggtagacccctggaaattgaacgggtgtctccacgccgarattcctgtccagtgactgtggggaatgcggatttctttctttttttcttcagarraagtattttaaactaacttttatgttgawaaagtaaaaattttgcgctccactttgggataggggaatcagtaaatcagacaaattgataggatcttgcagtttttaaaatggttattaataagtwaaagaagaatgaaattatgcggtatcccagctaaacctaggtagcgctttaaaaactattarraaacttactcatttttttaaaaar

SEQ ID NO: 10513 - DNA, 151 bp, Homo sapiens
tacttttattccctacatgtctccagagtttagaacaggccttggcacagagtggatgctcaataatgttttccgttaaattaaatatatactttaaaaattacatatttttgtaagttttctgaaagttgttttaaaaaacatgtttgtc

SEQ ID NO: 10514 - DNA, 142 bp, Homo sapiens
catttccaaagccatggtgaaacatctctgtgctaatttcttttgttttgtttcctaattttttttttttggcaggtggtgggaaatawyctttgtcttctttggagtaaaccttcaacacsggattttttcttttaattak

SEQ ID NO: 10515 - DNA, 164 bp, Homo sapiens
agtatttgaggagggtggaaggghgagasagtctaaagagttgcatttataaactctagatgtgtatatttagatacaaaaaaaagctgtggaagaaaatacaataagcagttagctgtgattgcttctgggtggtaaaattctaagtaattttttgtcttttt

SEQ ID NO: 10516 - DNA, 524 bp, Homo sapiens
atgaacatacgcctttgttctgtcattttaaagagtggtgtttactatgtgtgtgcttgagcattttctttcagttacatgggtgtaatttaaaaaacagctcctttttaagacttttgaccatagtgttttccagtttaaagcaataactttcatagtttctttcaaagtttaatacatccaatatgtcaagttaaaccattctgggatttgcaaagtttaatacatccaatatgtcaagttaaaccattctgggatttgcaaagtttaatacatccaatatgtcaagttaaaccattctgggatttgggaacttctttaaaggaaaattgtagtagaggtcatcttgatggaattgtgttttaaagttttgtgaatgagttaaatatcattgatagtcttgtgtgtctcacatatcagctttttcataaggaaaatactttatttgcttttatctgagaatttctcagtatgaaaatgattgtttaaaatttcccctctttttgtcagtgcattgggaatag

SEQ ID NO: 10517 - DNA, 400 bp, Homo sapiens
  misc_feature 400: n=a, g, c or t
ttctttctcataccttcaaacagacttcacattcttcatctgcagtacctagttcagaactttattatattttgccagacttgtaatagtagcagtaaaaataataatagccawwctdggtgtavmrgctcatgcctgtattcccagcagtttgggaggcaaaggcaggaggatacctcgaactcctgagctcaatctgcccgcctcagcctcccaaagtgctgggattacaggcatgagccatggcacctggcaagggttcttcatctttatatttsstgcatctagaaaacacctgataacataaactcagtatgtttatgtggaggagcaaataatatacagttcttacttcttatctccaaccagcttcacactctattgctgtttaaacaaacan

SEQ ID NO: 10518 - DNA, 387 bp, Homo sapiens
  misc_feature 16,225..230: n=a, g, c or t
actctggcctctgggntctcggctcgtcggttgggtacccgaacccagctactgctgcttgaagagaagatggatggggactcctcgccgtcgctgcgccgccggccttccctgggcggacgtacacctttgcgamstcagtgaggacccagggcccctccttggaatagctcttatttctcaagcgctgcagstgaagctcgctctgcggtccgagaggbctknnnnnnhggaagactgaaaactgggaagagacgctctaccctgtgctcctcgccggcttctataggagccgcagtgcctgggattttctcaaactttgtcccaaacttcagctgtgggagtggaggaacaaacaggcctctcccagaattgtgaaagagatcg

SEQ ID NO: 10519 - DNA, 408 bp, Homo sapiens
ttttttctagaaaaaagawaagcagaagtattaagttatttcactggatcaaaatcctttccccaactctttactccaatgaagtgggttcatacagaggcaaagcaagtgcttcatccagctctagaactaaaggtacccatgtgcaaagaaaggaaagaaatctggcctgcaaacttgaagctgttaacataaatgcagagcatgaatatttggctatataatgctcagacttcacagcccactatcaatcagtcagctgtgtaaaatgaaattggtgggagttcttgagctgatggaactcttctrgtgtcctgactgggatagtggttacatgavdctacacatttggtaaaactgaacacatacaaagagaataaattttactgtgtgtaaaatttaaaaatg

SEQ ID NO: 10520 - DNA, 433 bp, Homo sapiens
  misc_feature 70: n=a, g, c or t
atccgtgatgcttccgcgtgtcggaggaccaggtgccacctcaagagagaggccgtggsggcgagcsgynggmgwatwactcttagcagaagctcacctgtaagttttgagaacttagaaaccgatgccttccctctcatcagtcgtgaggcgcagtctcctggccgcggggttcgttcctccttgacatctctggagacgcatcgaggagctattgttctctggcgtcggaggttgcgctgtgtccgcggcgttgagggccccttgctaactggaacacggggaaggcggccctgtraggtttagtgaactcaatcaaagaggtcctgcaagtggagtagactccctgaagcaagactgccatctggaccgccgagtaatggcggtgttacctggagaacgtgaaacagtctctaaacacttactagaagas

SEQ ID NO: 10521 - DNA, 369 bp, Homo sapiens
  misc_feature 227,263,326: n=a, g, c or t
akgarttgtcagcgggctcacccwgaaggaatggttttatcctgctgccactgtgatggatacaattaaaaaacagaaaataagtgtcactacggatgtgaagaaactggaactctcatgcgttgctggtgggaatgtgaaatggtgcagccactgtggaaaacagattggtgatttctcararagataarcatagaactgtcatctgacccagttattccrstcynrgaacacttgtaagctcgtaactaatsgcgacaatngattggagaatygaacagcgatgacttgataaagaagatccctaaggatgactaaaggatatngagacccagagcccccatadgtagatgacagcagattttctca

SEQ ID NO: 10522 - DNA, 441 bp, Homo sapiens
ctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctysratcctttcaacagatttttatatagcaactgctctctgcaavgagttaaactagaaactgggcacatggtagag

SEQ ID NO: 10523 - DNA, 534 bp, Homo sapiens
aaaacgcgtgcgggggaggtggcttcttccggscgggccgagaggtggttacattcgttgaaggacaccagctgcggaatttgcggctttggcagattgaaatcatggcaggtccagaaagtgatgcgcaataccagttcactgtattaaaaaatatttcaactcttatactctcacaggtagaatgaactgtgtactggccacatatggaagcattgcattgattgtcttatatttcaagttaaggtccaaaaaaactccagctgtgaaagcaacataaatggtaagaagttgacatttaaacctttataatttagccattttgatgttaggatttttccctaacatttagtataaaaataaaccattgtcattttgcaaaatttatagcatacaagaaaaaaaaatacagaggcctagtatagtggctcatacctgtaatcccagcactttggcaggccaaggcgggcagatgacttgagcccaggagttcawgaccagcctgggcaacatgatgaaaccccatctctacca

SEQ ID NO: 10524 - DNA, 477 bp, Homo sapiens
tatcaagtttagtaagatgatgacagttgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattgagggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcg

SEQ ID NO: 10525 - DNA, 473 bp, Homo sapiens
aatgtaatcatccacaaatacagtgacaatgtaaattttgtcttactaacggtagaattagagaccacagagcctttaaagaagcaaaattcaggggattggttttattattgttacgttttatcattaacattagataatttattttaaatttttattatagtcgagaaataataaaagtgagataaaatgatgtagtaaacaaaggagaaaatttttatttcttttttgttgttgttgtttacttttttcattcaaacagattctgacagatatttcttaggtagtatatagccaaagtagacctggacataattaagtaattctatcagttattcttttactttcaaaaggaagagaaaggtacctttgagttggttttcagggccacgtttcaagccagagacattgctatgaaggttaaaggaaaagatattttttcctgcttttttcccctttatagtgatagctat

SEQ ID NO: 10526 - DNA, 140 bp, Homo sapiens
aaaaagggcttctgtcgtgagtggcacacgtagggcaactcgattgctctgcgtgcggaatcgacatcaagagatttcggaagcataattttttggtatttgggcagctggtaaaaaaaaaaaaaaaaaaaaaaaaaaag

SEQ ID NO: 10527 - DNA, 514 bp, Homo sapiens
tcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgagaa

SEQ ID NO: 10528 - DNA, 497 bp, Homo sapiens
tcaccactttcattagatctgtagttcctgaatcacagaaaggtttgtaatcttttttatgagcctcttccattaatgtatttctctgtgctcaggaggtcagatcatcaaacccagtctaatctcttggttggaacaagaagagtcaaggacagttcagggaggagttctccaaggtgagtgttcatgaagaacaactctggttgatgagaagttcagtatgtttgaaagcataattaggaaactttttaacatgtactttctccctgcactctaaaccccaaggtttagagaaagttaggaaatatttaacttcccacacgcttttatttacagagcagtccccccttgtctgtgatttcacttttcacggtttcagttatctgcattcaaccatggtccaaaaatattaaatgggaaactcggccaggcatggtggcccacacctgtaatccccacacattgggaggcctaggtgggtgaatcattgagcccag

SEQ ID NO: 10529 - DNA, 55 bp, Homo sapiens
accacagcctccacctcccggcttcaagtgaatctcctgcctcagcctcccaagt

SEQ ID NO: 10530 - DNA, 401 bp, Homo sapiens
acattcagttcccaggggcaggtaggagacagtggccttcctctatctcaactgcaagaggctttcctctttttactaatccacctcggcacagaccctttatgggtgtcaggctgggggacggtcaggtccttctcatcccacgaggccatatttcagactatcctatggggagaaaccttggacaatacccagctttcaagggcagaggtccctgcggctttccgaagtgcattgtgcccctggtttattgagactagagaatgctgcttgggaggctgaggcacaagaatcacttgaacccgggagacagaggttgcagtgagccgagattgcaccatggcactccagcctgagtgacacagcaagactccgtctcaaaaaaaaaaaaaaaaaaaaar

SEQ ID NO: 10531 - DNA, 300 bp, Homo sapiens
aaaacgcgtgcgggggaggtggcttcttccggscgggccgagaggtggttacattcgttgaaggacaccagctgcggaatttgcggctttggcagattgaaatcatggcaggtccagaaagtgatgcgcaataccagttcactgtattaaaaaatatttcaactcttatactctcacaggtagaatgaactgtgtactggccacatatggaagcattgcattgattgtcttatatttcaagttaaggtccaaaaaaactccagctgtgaaagcattttttaatcttaaaaaaaaaaaaaa

SEQ ID NO: 10532 - DNA, 416 bp, Homo sapiens
  misc_feature 181: n=a, g, c or t
atttcctcccaagaaggcagcagcttcactcagctggtatgatggagtattccaaacagaaaaccagctgtgatctctggcacttccaattccaattaagagctttgttcatttaacttaaggatttacatcactttaacatatcttgtcaagtaagtaacacttgaaatgaccccataantgtcccttaagaagaacaaattgcaaatcatctcaaaaggaaacaacagatcatcagacagcaggaaataagaaaggcctgagaacagctgggtaacagcatttcagctcatccaaggaagcctaggatttcttgtcagtgcatctagcacaggccatgacatggaggaaatgatgggtaaacgtccattgagcaaatcaaacttctgaaataaggctcttcaagaaggtttcaa

SEQ ID NO: 10533 - DNA, 481 bp, Homo sapiens
ttcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcctatctcagctcactgcaaccaccggctcctgggttgaggcgattcttgtgcctctgcctcccaagcagctagaattacaggtgcgcaccaccatgcccagcactttgggaggccgaggcgggcggatcacgaggtcaggagatcgagaccatcccggctaaaacggtgaaacccgtctctactaaaaatacaaaaaattagccgggcgtagtggcgggcgcctgtagtccagctacttgggag

SEQ ID NO: 10534 - DNA, 474 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgacactgtgcctagcctgagccaccacgccggcctaatttttaaattttttgtagagacagggtctcattatgttgc

SEQ ID NO: 10535 - DNA, 188 bp, Homo sapiens
aaytcaagactgctctgcctacagagaagccattcttttagtttcttctttttaaaaaaattagagacagggtctctctatgttggccagtgtagtcttgaactcctggcctcaaccaatcctcccgccttggcctcccaaagtgctgggaggtatgagccaccatacctgacattctttggaatcct

SEQ ID NO: 10536 - DNA, 474 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcvtkgctaattttttgtactttcagtggagatggggttttgccatgttggccaggctgttctcgaactcctgagctcgggtgatccaactgtctcggcctcccaaggtgctgggattacaggcgtgacactgtgcctagcctgagccaccacgccggcctaatttttaaattttttgtagagacagggtctcattatgttgc

SEQ ID NO: 10537 - DNA, 428 bp, Homo sapiens
  misc_feature 366..367: n=a, g, c or t
catmtctasattacttataatctataatgtaaatgctacgtaaatasttgttatattgttttttaatttgtatgatgttatattgtwttttattgctttaaaaatatttttgatctgtggttggttgmatccacaaatgtacaacctatggacatgaagagccaactgtactcacatgctaktgaacatacttaagatcgrtgacccgcctttgtcacaaacaaatcccactgtttctatgggtaaattaagatctacctcatggtgaagttttcaggactatcctgcctatgttagcaacagaatcttagacctggccaaaatgggtgagccccagatggcagggtkatgagttawagktggwynnccwgdmttactgaaatgtckccattdcctgkctctacagrggaaacctgcccctatcctgg

SEQ ID NO: 10538 - DNA, 581 bp, Homo sapiens
tttaggccgaatcgcgggggccggctaaacgcgtgcgggggaggtggcttcttccggccgggccgagaggtttacattcgttgaaggacaccagctgcggaatttgcggctttggcagctgtttgttcccaccgagctgtgctttaggaagctggccagccgggcctscwkttaggtgcgctgcagcctttttcaaagcgagtgaatgtggcccggcccctacagttcgccaggcccgctgtaaaagggttagattatcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtacttgccacatattgaagcattgcattgattgtcttatatttcaagttaaggtcaaaaaaactccagctgtga

SEQ ID NO: 10539 - DNA, 442 bp, Homo sapiens
  misc_feature 102..104,367: n=a, g, c or t
camtgtwmacagtctcttcccacttcctgtggctgccagcattcattggcttgtggctgcctcactccagtctctgtctccatggtcatactggtttctcmnnntgctgtgtgtcctctcctctgtgtgtctgtcttacaaggacactgtggtcacattcagggcacatctagamaatccaggatcatctcctcctctcaaaatctttaacatactttaggccgggtgcggtggctcatgcctgkaatcccagcactttgggaggctaaggagggtggatcacttgaggtcaggagttggagaccagcctggccaacacagtaaaacaccatctctactaaaaatacraaaattaactgggcatgvnrgcgsatgctggtatcctagctactcaggagggctgaggcaggrgaatcgcttcaacctgggaggtggagattgc

SEQ ID NO: 10540 - DNA, 294 bp, Homo sapiens
  misc_feature 61..63: n=a, g, c or t
atamccaggatgccatggagacagactagtgagagtgaatgctggtcatagatgattgatnnnmcsatctcagtgtggaraaactgaggcttaagattagttaagaaatttcctaaggtcacacagctgstaagaagtggcagmgctgcgatttgagttgcacaggcagactggagygctcaattgtgggctttaattgcctacttgaaggatgcgatgtasmrtgcatgtagaagagacatctgtttgaasscatccattcatctttctggggcatactgtcactattgagat

SEQ ID NO: 10541 - DNA, 251 bp, Homo sapiens
cccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttt

SEQ ID NO: 10542 - DNA, 493 bp, Homo sapiens
  misc_feature 267: n=a, g, c or t
tcatttctgaaaattaatattgagcatacttattggatgaaacctatttttacctactttacaatctaagtagaatctggaactagtgggtgtgaaaagctgggagcagatggctcatccttatctctgcagagggcggcaaaccaacacccctggctatccatttacctaagaaaacaggagcgatgtgactgcatcttgagtccaaagattagattgtttggagacaggtaggttgcaaaatgtgatttgaggcctcatagcwmnggtgtcccaaagatgtaaaaaaacttggttagctttcatttgactcctagttttgcagttatttaattaaagccaattttaggccatatttactagcatagttataaataagaaaccagtgtaaagggcacctcaaacactcacgatacttgaatgtctcatctaaatttaggagatacctatttacctttagttcctgaatccatgctcccggcatactcattaa

SEQ ID NO: 10543 - DNA, 193 bp, Homo sapiens
  misc_feature 36..37: n=a, g, c or t
agaccatgtcctcctggggaaaaagtttccctagtnnccccagcaccgcgccccaccctacgccccgctggaaaaaaaacagcaacataaaatcctaggcttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10544 - DNA, 396 bp, Homo sapiens
  misc_feature 115: n=a, g, c or t
aaatccttgttatccggcagataaccgcggccgsccasacccggcctgcctcctccgtctggctgcgggcggggagtgcgcctggctcccgagcccctgacacggatttggggyntgcaatgacgatctaccccacaccatccacattcctgggaccctcggggcaaggtcctacagtccttggtgaccaccacgcctgcaaaaagcggtgggaaagttgttacgcttagaaaactaccaacacgcgcatgcctgtaatcccagttactcgggaggctgagacaggagaatcgcttgaacccgagaggcggaggttgcagtgagccgagatcgcgccactgcactctagcctgggaaacaagagcgaaactccgtctcaaaacaaaaacaaaaaca

SEQ ID NO: 10545 - DNA, 506 bp, Homo sapiens
aaatagamcatcctaatcaaaatatacaaacaaaagtctgaagatgtaaaatacataagtgaggaatcattagctgctgccatttccctttgatgaccttttggtgatgtgttttcataaactactgcaattggatgtaccacctagagaatcctcagatttctttcaaggcacatcatggataccatatttaatgagactgcaggagaaatagattactgctcttctactctctggaaggtcgttgtgaatttttttttcactgaaaatgttttgggactgataaaaacatgcccattctccatctatgatggtaatgagtaatcaggtgtgcatttgattaaatctggtatgcttagtgttcagagggtagaactgaaagcaaaagaagaatgcaaattatataaatggaagaagtggaatatacaataatatacaatacaagaaaggaaatcagaaaactaggaccttttagccaaagaaaaagaaaattttgactgggtgtg

SEQ ID NO: 10546 - DNA, 504 bp, Homo sapiens
  misc_feature 401..403: n=a, g, c or t
aaaatatcaattaggtcaaagtggttgataatggtgctgggaacatttcacgacctgtcttccagctattttgaaatatacaatacactgttgtaaactacggtcaccctgctctgctactgaacactggaacttattccttctatttaactgataaaaagattgtggattttctattgagttctagccagcccatgtggcaccaactgtagcctgccctcatgctgaaascatacaaccaggaaacttacccaacgctgttcctttcttccaagtgactattcccatcaggatctgcttttcattggtccttagtacttttcagggctttcttgtcaccttctgaagagctcaccagcagcctctctgattcaacagtatcatatcaattatttaagmmnnnaaatgggatggatatttggatcagagtatgagttgtggatgaagagggaaaatttctcctactggcactgtgatgactagtgcaaacctacgctatctaca

SEQ ID NO: 10547 - DNA, 154 bp, Homo sapiens
aaaccttggggtctcagcctgtgagtctggtcggggggcacacacattccaactgtatcacctgcagtaaccatcagcagaaatcgagaaaaaatactcaagtagatttcttaaaaaaaaaaaaaaaaaaaaaaaaaaaaaaaaaaaaaaaaaa

SEQ ID NO: 10548 - DNA, 501 bp, Homo sapiens
tcagcttgcgtctccttccacgttgtaggagctttgtttatttgctctttgcaataaatcttgctgcttctcgctcattgggtctgtactgcctttatgagatgtaacactcaccacaaaggtctgcagcttcactcttgaggtcagcgagaccacgaactcactgggaggagtgaacaactctggactggaggaatgaacaactccagaggcactgccttaaaagctgtaacactcaccgcaaaggtctgcaccttcactcctgaagccagcgagaccacgaacccaccagaaggaagaaactctgaacatgtttgaacatgagaaggaacaaacgccggacacgtcacctttatagaactgtaacactcaccgccaggtccgcggcttcattcttgaagtcggtgagacaaagaacccaccaattctggacacagaaatactgaggcaagatagttacaactatatgtatctcatcaatttaattaaaattggaattaa

SEQ ID NO: 10549 - DNA, 127 bp, Homo sapiens
agacttggtaacgcgagasckgcggggagggtgtgtcacgcctcccgagactggggctgtgcggcctcacggagaaactgaggcaggcgcgaagtcgaagtgcgcgcgtggccctgcaggcaggcgg

SEQ ID NO: 10550 - DNA, 439 bp, Homo sapiens
agatcaaagaagaaaccctgcctcacactgtctcatctccacagaatccctcttccaaccttcctatcttttctatttcccattgatagagggaaacttgtagactcttctcatcaacaaaagataaaaaatttatttgttggccgggcgctgtggctcacgcctgtaatcccagcactttgggagcccgaggtgggcaggtcacgaggtcaggagatcgagaccatcctggctaacacggtgaaatcccatctctactaaaaatacaaaaaaaattagccgggcgtggtggcgggtgcctgtagtcccagctactctggaggctgaggcaggagaatggcgtgaacccgggaggcggasttgcagtgagctgagattgtgccactgcgctccagcctgggcaacagagagagactccatcccaaaaaaaaaaaaaaat

SEQ ID NO: 10551 - DNA, 409 bp, Homo sapiens
  misc_feature 330: n=a, g, c or t
atacttaatttctgttagtctctgtttccttgtctataaaattaggaagggtggactaggtgaccagtaatgtcccatataaaatctaaaatttttatagtaatgatatatggccgggtgtggtggctcacacctgtaatcccagcactttgggaggtggaggcaggtagatcacctgaggtcaggagtttgagaccagcctgcgaacatggttaaaaccccgcctctactcaaaatataaaaattagccaggcatggtggcacatgcctgtaatcccagctacccaggaggctgaagcaggagaatcacaccaacctgggaggcagagnttgcagtgagctgagattgtgccactgcactccagactgagaaacagagcgagactccatctcaaaaaaaaaaaaaaar

SEQ ID NO: 10552 - DNA, 72 bp, Homo sapiens
aatttccaaagccatggtgaaacatctctgtgctaatttcttttgttttgtttcctaatttttttttttttt

SEQ ID NO: 10553 - DNA, 494 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgacactgtgcctagcctgagccaccacgccggcctaatttttaaattttttgtagagacagggtctcattatgttgcccagggtggtgtcaagctcc

SEQ ID NO: 10554 - DNA, 409 bp, Homo sapiens
  misc_feature 52,54,165,235,360: n=a, g, c or t
aaaacgcgtgcgggggaggtggcttcttccggccgggccgagaggtggttanbntcgttgaaggacaccagctgcggaatttgcggctttggcagattgaaatcatggcaggtccagaaagtgatgkcgcaataccagttcactggtattaaaaaatattdmaantkcttatagctctcrcaggtagaatgaactgtgtastggvmcakcatatggaagsattggcattgattgnttatatttsaagttaaggtccaaaaaaactccagctgtgaaagcaacataaatggattttaaactgtctacggttcttaacctcatgctgttaagttcccatgcctggagaagctaatgkccaantcatcatgtgataattgcaatttgtagcaataaattatgaacccaaaaa

SEQ ID NO: 10555 - DNA, 306 bp, Homo sapiens
aaaggagatcctgaacaatagccagtgaaggttcgaccccctgtgggsccacagagagtcacctgcagctcagtcttaccccaggtgctgggcccaagtctgctcttagaggaaatggagtgaacattgttccagcttgggtcaggtggctgtttgttgacattgaartccctggaagaagaaccatgtcttattcatctttgtatgcctggcctctcatagacacatacaataagtactcattgtrtcaaagaatgaatcaatgttcccgtaagtgaaaaaaaaaaaaaraaaaaaaaaaaaaar

SEQ ID NO: 10556 - DNA, 491 bp, Homo sapiens
  misc_feature 341,344: n=a, g, c or t
agttgggctcctcaaaagcagaccctgagacaaggttttgggcttatgtaatttatttaggaggtgaccccaaggtcaagtagagcacgtttttaggaaaaataaaagtaagaaaaggaagctaaaagagccagtaaatggcatattaatatgaagtttctactgtaggcaactgggactcctttggaatcctctgataaaactcacttcagaaatgagtgagtttctgaactcactcccaggtgtgggaaggctgaaccctccaactccaccaaatctccttctttattgattggggataagggggaagtggcttaaacttctcctccacttcggcathnbdncttcaggaagagaagaagaggtgcaggtgcttgaggtggaaaactgtcagagtgctagaaactattgcagcagcagatcatttcaggatggcaaagaagatgtgttggtgcatcagcagactcttctacacatctaaatagggataa

SEQ ID NO: 10557 - DNA, 437 bp, Homo sapiens
tatttttgaatactttttaatagcctttatttaatactcatttactcatttaataacctccgtttaatacttttttaacagccattatttaataccctgagcttcacttgtcctcgagaaacatggaagacataatgtaaatgagttgccttagttaatttgatggataaaattcaagccaagtcccttctctctgcagagcattcattgcccttaccttgactatgaaggagtgaagatggagtagtgtaatggttaaacacacaagctcgaaagtcagattgcctgaggtcaaacctataccatttatcttgtatgacctcagccaattaacccccctttctcagttctccattggtaagatggggataacagtatctactttatagagttgtaaagattaaatgagataatggtaaaaaaaaaaaaaaaaaaad

SEQ ID NO: 10558 - DNA, 337 bp, Homo sapiens
aaaacagcagcctccacccgccaccccaggaacctcgtgcttctaggttaccctgatggcaggacccactcccatcactaagagaacatcaaaagggcaggtgtgggggtggataggaagatcaggatctctgaaaggatgtttttcagaaatttgcattgtggtaacctacagactccacctggacccatgattcatgactcaaccagtccacccagaagctgactcagagcataaggagcattttccacacccctaggatttcatctccaaccaatcagcattccccattctctagcccctgtccaccaaactattctttaaaaaccttagctct

SEQ ID NO: 10559 - DNA, 403 bp, Homo sapiens
attgagccatgatgttgattgttggatgtcaagagtagataatgttgatgactaatggaagagtagtttatacagcgtggatacstgggcaaagagatggttcacattccacttggagtaggatggtgcaagatttcatcacacttctcagarcaacacacagtttaaaacttaatgacttttttatttctggaatttctcatttaaaatttttggaccacagttgactgcaggttgtaaagctctctgaaatagtgaccttagcgamsaagcacatgtggatgtgaaatttcagttgccaatatgatctgaaaacccagtggatggctgaaggtgttaaatgtgctataatcattaagaatactgtgttctgtgttattgttctktttctttttagtgtgtg

SEQ ID NO: 10560 - DNA, 319 bp, Homo sapiens
agtgtaattcgagttccctgtccatcgactgcaagtcctctctcctgcgccgcatgctgcctcgcgctccctttccttccccctctrcccccttccgcgatttactgtttcctcgcgcccaacagaaatgggcgaccgcaagtcttactctcgccggcgttacaaagaaaggaaggaggagacctgaacagtacatccggagaatccagcaaagcatactacggcatgaacgtgcaagtggacagaattaaaacacatgccagaaacactaatggattctaaacaagatgcagtttcatttcccaaaaaaaaaaaaaaw

SEQ ID NO: 10561 - DNA, 142 bp, Homo sapiens
atttggcagctgagtgaaggtgaagctcagaggtggatccaaacccaggctgggtttcctcgtgggtcggagatgtctgctttacttttattaaaacatcgtcccgatctggcacacctaaaaaaaaaaaaaaaaaaaaaaw

SEQ ID NO: 10562 - DNA, 385 bp, Homo sapiens
attacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcaca

SEQ ID NO: 10563 - DNA, 249 bp, Homo sapiens
aaagatgctccctggttctgtttttttgcttttgatgatgaattttgctgctgctcagtgtttaggtccgcactacctttttgagctgtaacactcacgacaaaggtctgtggtttcattcctgaagccaacaagaccatgaacccactgcgaggtaggaacaactccggacgtgccatttttaagagctgtaacactccagtggcaaaactctgcagcttcacttctgaaaccagcaagatcaggaac

SEQ ID NO: 10564 - DNA, 349 bp, Homo sapiens
gmctgtttcctaggagttctgctggagctacatgcctgaacaccaaccaataaccttttcatgtggctgagacctttcatatggccacagtcctcagagacagcatcccaagagtgatccttttaagaggctcaggtgcaaggctagtctagcctgctggacaatgagaggcctacggaacagggcggagtcaccatatcccactgaaactggcctaggttagccaacagcccacctctcccaggcacgtgaaagctcagcggactctgaacagatggacaataaacatttattgtgtttgccacaaaaaaaaaaaaaaaaaardaaaaaaaaaaaaaaaaaaaaaaar

SEQ ID NO: 10565 - DNA, 443 bp, Homo sapiens
  misc_feature 356: n=a, g, c or t
aaccgcagctcggkttccttccacgtggaagctgtgttctttccttcttcacaataaatcttgctgctgctcgctctctgggttcgcactacgtgtatgagctgtaacactcactgcaaaggtctgcggcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcganggtctgcggcttcattcctgaagtcagcgagaccaagaacccaccagaaggaaccaattccggagaaacttgttttaagcgtgagaa

SEQ ID NO: 10566 - DNA, 419 bp, Homo sapiens
  misc_feature 175,341,364,387: n=a, g, c or t
atacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagaccnrgcggcctacatcgaggagtttctacagcagtataatcactacaaatccaatgtggagattttcaaattgcaaccaaataaacccagcaaagaactagcagagctggtgatgtttatggcacagaacatcctaaatgtatgcatctgaattataggagagaaayrngagcaacttcagaagagcctttnsctttgttacagattagtcactngstacccagagtacctaagtaattttcctcaa

SEQ ID NO: 10567 - DNA, 328 bp, Homo sapiens
atcctgaagcacacagccatgagaaaagggctaagaactggaacaaaatggatttctttggagtagaaaagagggggtgtaccaatgatctgtcaagtgatgcgacactagaatcaggctggaatttggcgtcttacggctacaaaagtgtttcatcagtcttcaggtctctgtgctgatgttaatgctggtcagctgtgcctgaattccaacgggaggaaggaaagatgatgtgcagagacacagggagaagacggccatccacaagccaaggcgagaggcctggacagatctttccctcacagtcctcggaaagaaccaatccttt

SEQ ID NO: 10568 - DNA, 106 bp, Homo sapiens
tatggwtaccaacatctatggatgctcaagtccctgatataaaatggtggactatttgcatataacctgtgtacatcccgtattatytaaatcatccctagatcas

SEQ ID NO: 10569 - DNA, 575 bp, Homo sapiens
  misc_feature 259..260: n=a, g, c or t
atgattgtcccactgcattccatcctgggcaacagagcaagagtctgtcaaaataaaaaagaagaaaaaaagaagaaagattttaattatttttatcaacaattatacattttcagtctactgttatgaattgccacaacttggaggcttagaacaacacaaattagtactctcacagtcctgaaggctacagctctgcaatcaagatatcagcaaggccatcattccactaaggctctaaggaagaatccattttwtnntcttcctgcttctggtatgcatccactttattagacggcaaactagaaaatgcttcctacagtcgccacataaaaagttgcaaagactttgattcatttaaagtacatttgaatgaatgttcatttatagtgcttaactgacggcaaataatctgctgggctgcactggtgcacgggctgcatgcactctgtgatttggaacccttagtagttaggttgattttctcttccttcaattttctctgcttccctcttcttcgtgagcaaatgtaaaaccacttgtaagtttaatcagaaaaaaaaaattcattgtat

SEQ ID NO: 10570 - DNA, 523 bp, Homo sapiens
aagtgcagtggcgcgatctcagctcactgcaagctccacctcccgggttcaagcgattctcctgcctcagcctcccgagtagctgggactacaggcgcccgccaccacgtccggctakhttttgtatttttagtagagacggggtttcaccgtgttagccaggatggtcttgcactcctgacctcgtccaccctccttctcctcccaaagtgctgggattacatgcgtgascaccgcgcctggccctggtgcccttttaaaaacaggaagagggagagagtgatcttgctctagcaacacatgagaagaggcaacgtgagtacacagtgaaatggtggcttcctacgaggcaggggaagaagatgcggaaagcactgtcccttgccggsaccttctcaactggactccagatctgtgagaagtgaatttctgttgtgtacctgtccagtctatagtagctgttactgcagcccaargtgactggtacatgtggtttcccctaagacagttaagagctacgtgt

SEQ ID NO: 10571 - DNA, 559 bp, Homo sapiens
  misc_feature 488..491: n=a, g, c or t
gaggascatggttccggtggcttcaggcacagacttctgccaggcctgcagacagagctcaggataaagagccaagggtgtggcctgtctcgaggcccatagatgtgcgctctgcaggtggaatggccgtccggtgcttactttgactgtcctcgggtcccgagtcttctggtggttaactgaggaaactgctgccttatgatctagcagaggatgataattgctgttgcccaggacaaccacaccagttcacaagaaatccgtgaagagagagcatctctcaaggtgaaaacataaccatgaggcccctttccttggggtttacggagcmtgatgtttgtggagaggcatgacaggtcaggggttacgtgcaagaactctggaactcgactacctgaattgaatgcaagctcaggcattggttaggctggatgcycttggsaagtyatttagtatccacatgactcagtttccccatttgtaaaadnnnnktgataataacctctagagthattgtgaaattttaaaaagtgaatgtatgtaatagctggcagtagtg

SEQ ID NO: 10572 - DNA, 354 bp, Homo sapiens
attctgccccttgaaaatggactgtgacataccacaggcccaagtacttagatgatatgattctcctcttctgcctgggtcatggcaacaggaggatgaattattttagcaagcccagattacagtttcagatatgacagtcaacacatcctgaatgttgggtccaactacatgaggcacgtctcatcagtgaaccagatctatgcgtcatagcctcaattcctattgcatgttgtgttgacttaatggagtccagttttcttggtgtgctgaatcctggtctgagagtcacccaacccacctgtggaccacatttatgtataagagcytttttaaaaaaaatcttctgactgc

SEQ ID NO: 10573 - DNA, 296 bp, Homo sapiens
gtttgagacccagcgtctctagatctcgtatttgaatttgtggcgcttggtgtccgcgagttgccgaatgaagctgagcgtctcagtggaaccagggatctcagggaggggaaggtataaaattttcaaatggaggagtatacctgaacctaatcatggatgtgattttatgtaagtaatatgtgagatacagataagctgattctaaaacttacaagaatggcaaagaaacaagaagagcttaaactgcaatcatcaacagagaagctttctgcaaccaaagtgaagactgaagc

SEQ ID NO: 10574 - DNA, 271 bp, Homo sapiens
tttttttttttyccccyccacaagggycawagrawyctgttgaaaaatttactgtggcttgtaacacctcctcggtacccgttttcgtgttggctatgttggctaagcaaaaaggagttcgtraaaagaaaactggaccacaggaktggaggaagaggtgaaratgtggaaagcccagagagttggagatttgagagaaggaagaaagcagttaaggtcagaaatctgacagaggtcccactgggctaaaatcaacgtgtcttcagggatk

SEQ ID NO: 10575 - DNA, 90 bp, Homo sapiens
aaaaacaagcctgccatggccacctgtcggcagtgatgcaactgctccccggtacagctatttccaagattcsagatttcgcattttttk

SEQ ID NO: 10576 - DNA, 353 bp, Homo sapiens
  misc_feature 353: n=a, g, c or t
tacggccaagatccaggggatggcaagttcttggaaaagcaagaaagccctgtaagctcattttacactgagaacatttgcccattcagaagaaataaagctgaagaaaatagcttgtgtttgacacctctgggaacaagcaagtggaaactcaagaccaccttaaggagggcagcttgataaacacgactttacttgcatgtgcctgcagcgcttaagccaacttggaatcaggcaaaagaacaggggatgaagtttgtgattcaccgattaataaggctgaattaagtggaagaaaagagtggagagatggtaataaatgagatgactgtccaagttcttcaaaaactctn

SEQ ID NO: 10577 - DNA, 314 bp, Homo sapiens
atgttgttgccccattctgaccstgagagcacctggcaggtatgtggaaaaaagaaatgtgcattaaaacagagacactgataatcaagttatgggaagctctggggtggtagaagattgttacgcaaatgcatgagacaaagtggaagaaagagagagaaagacaagatcattccatcccggaaatagacagggtatgatataatgaaaagagcatggagtttggagcaagacctaagatcaagattctgtttctctggagaaccttgacttatgaaataatgtcacaccttcttcagaatgttgttatcctt

SEQ ID NO: 10578 - DNA, 119 bp, Homo sapiens
agtagcgtatgaagtgcgacgagsaaggaatatagataaaaatgaggggtagaaggtggtcaataggcagcaggcaccaaggagatgctatacacgtataagcaagataaaagtcctch

SEQ ID NO: 10579 - DNA, 351 bp, Homo sapiens
actttctagtcaaaactctaccaattgccagtggtgaagctggtataagccacgtatctctgagccaattttcttatcatcaaagtgaagacaatagcaccagccataccttccttagggcgttttgcaggctaaatgagatagtgggcaattgaaacttgttgtcatcaaacaaggtgaagagactgggcctttgagaataattgcatctctatagagaaatcatgcttttacagaaaaatttctgtaggatctcacctatcaggtccctcgttggctgctcgtcagattdctctcttcaattccaagcgcatcttatgtaacaatagtgtctatgatagtggatgtgat

SEQ ID NO: 10580 - DNA, 80 bp, Homo sapiens
  misc_feature 26: n=a, g, c or t
tttggcaacccgctcgagtccccttncacgctgtggaagctttgttcttttgctctttgcaataaatcttgctactgctc

SEQ ID NO: 10581 - DNA, 361 bp, Homo sapiens
aaaccaaagtacaagatttagactatgctatccttcatataagaaatgggcaataagaacatatacatatatctgcttatttgtacaaaagaaatacaggaaggataaaccagaaactaaagagatcagctacctacaggggataggtgggaaagggataaaacgaaatgggaatggatggtagggataaggaaggagtgatatttctctgagtatatctttgtgtatagatgactcaaaaccagagtaatgtagcgcataccaaaaaaattaaagaacccagaatacaaacagtaacaagtgaatctaactgcgttacaaaggrrtaacatraccacactgaagggcatgaggaagaaac

SEQ ID NO: 10582 - DNA, 306 bp, Homo sapiens
gacactaaccacattctaragttcattacatagagctgtgtctatggttttgatgtggacaatggcacatctgcgggacggagctttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaa

SEQ ID NO: 10583 - DNA, 535 bp, Homo sapiens; identical to SEQ ID NO: 10397

SEQ ID NO: 10584 - DNA, 57 bp, Homo sapiens
tacttgtcgaggtttgttctcccttgtgggtgttttttaaatttttttttttttttt

SEQ ID NO: 10585 - DNA, 511 bp, Homo sapiens
aaaaaatgtcgttcctgtgggaaatctcaggagttctgtctcaactctagagagaataaaaaaccttaggagcaaattgaccatcatacagaaactgttaagacatgtggcaggcaatttaatctagtggaatatgcaaataggatttctgaatttggcatgcaaatgaatttgagagcttctgggagcatctcttccaagattctggtaagcctttcttcctgggcgaaacttagcagaggaagttatagagaagacctaagaaagaccaaggagaatttgtgtcactaaaatttgaagctttgattccgaaattttactcagcctgagttggtcatttgacttttactgctatcaacttgggagttaagtcttaaagaagaggaacagtgctgtttattaaaaggatcagacaaggagtaaatgtggaatgatcactcttcccagacctaattgactgcaggaggaacagtctgaaattggggaaaacatcacactacacctatacctt

SEQ ID NO: 10586 - DNA, 116 bp, Homo sapiens
attgatcctttggtgtaaaatcaattgagagtatgcttgataaatttaaaaaatgcaaatatggctaataaagtgaaaaaataataaaaaaaaaaaaaaaaaaaaaaaaaaaaaaa

SEQ ID NO: 10587 - DNA, 312 bp, Homo sapiens
agaaacaggggtcttgctatgttgcctaggctggtctccagctcctggcctcaaatggtcctcccacctgggcctcccaaaatgctgggattacaggtatgaaccactgagttatcctgtcccacagcttctgaggaggggtttcctgcaacaacatttatcttaattctggagtttccagggaatggtccctggagctattttcagagcagcccctgtgtgaatgcctttacacagagaaggcctgcttttccttaagcctatcaaattgcttcattaaaattttatgtvrccgacaaaaaaaaaaaaaaw

SEQ ID NO: 10588 - DNA, 591 bp, Homo sapiens
attgggagctcatttcttgccaggccctgtactaggaattttccttatcctgtttcatttactcttcctaactaacctattgcataagaactatcattatcgcaattttatggatgagagagctgaacacaataggtgaagcagaaatttggtgactgcaaagtctatgattgtaaccaaaatatatatatttwtwtawtgcaagtgtgagtcartggttcaaggattgtgcaataggctagaaggaaagatattgaatgtaggtaatatttaacagggaattactgtttccaacaatagaccttagcagcattagcaagaggaagagcagtggacccaggagagcttggagaggggctcagtggtgggagactgaggttagggttagggttgaagtgcaatctgacagaagggtgggtggagacagtgttgagtctgagcttctcctcccccacaatttctctttcttcatcccccctctacccttcatctgtccacttacacaaattccaactaagaagagataaccgaaacttagaaaaacactgtatttcatatatttgaagcatacgtgatttctctctacatctc

SEQ ID NO: 10589 - DNA, 503 bp, Homo sapiens
cagctgcagaatatgcattcttcacctcagcacgtgaaacactcttcagaaaagaccatatgttaggccacaaaacaagtctcaaaaaaatttttaaatagtaattatatccagtattttctcacaccacaatggaataaaactagaaatcaataacaaggaactttggaaactgtacaaatacatggaaattaaacaacactctcctgaaagactgttgggtcaatgaagaaattaaggcagaaataaaaaaaattattgaaacaaaaacagcaacataacatactagaacctgtgagatacagcaatagcattgctaagagagctatttatagcaataaatgcttacatcagaaaagtagaaagagctcaaataaacagtttaatgatgcatctcaaggaactagaaaagccagaacaaaccaagccccaaatttagtcgaagaaaaagcaataaagatcagagcagaactaaatcaagtagagactgtaaaaataataca

SEQ ID NO: 10590 - DNA, 572 bp, Homo sapiens
aaagagaataaaacgaggctgcccccgccagcagtggcaacctgctcgggtccccttccacactgtggaagctttgttctttcgctctttgcaataaatcttgctgctgctcactctttgggtccatactgcctttatgagskgtaacactcaccgcgaaggtctgcaacttcattcctgaagccagcgagaccacgaacccattgggaggaacgaacaactccagacgtgccgccttaagagctgtaacactcaccacgaaggtctgcagcttcactcctgggcttgcgagaccatgaacccaccggaaggaagaaactccgaacacatccgaacatcagaaggaacaaactccggacacgctgcctttaagaactgtgacactcaccacgagggtccgcggctttattcttgaagtcagtgagaccaagaacccaccaattctggacataatatgattgaaacaaactcgcaagttgaaggacagtagggagaactgtggtcacctggctagacagcactctagctgctactcaaggtgaagcacattgctgtcatatgagatcaggagc

SEQ ID NO: 10591 - DNA, 491 bp, Homo sapiens
gtatttctgctggccagagacgtcgcgtccctggctgggcattcagtcacccccaggaaaggaggtgtgcctagattgatcggtataaggctcactctcccgccccccaaagtggttgatcgttggaacgagaaaagggccatgttcggakgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttgga

SEQ ID NO: 10592 - DNA, 127 bp, Homo sapiens
gttgtccctccaggagggggtccggggcgtggggactgatttccgacctcccgggcccaacgagccgtgctgaaacgtggcgcctcggaggaggctgagattcctgcaggtagacaccaaggatctc

SEQ ID NO: 10593 - DNA, 370 bp, Homo sapiens
atcctctaattctgatgctaaagttctgattccatttataagccatcatctcatctcatcttctatgcagtgcacgagactctctgaaatggatggagtctctccctgtcgcccaggctggagcacgatggtgcgatctcggctcactgcaacctccgcctcctgggttcaagtgattctcctgtctctacaaaaaataaaattagccaggcatggtggtgcatgcctgtggtcccagctacttgggggctgaggtgggaggatcagttgaggctgcagggaggcgtgattgtgccactacactccagcctgggtgacagagagagaccctgtcacaaaaacataaaataaaaaaaaaaaaaaatgsgaa

SEQ ID NO: 10594 - DNA, 607 bp, Homo sapiens
atctgtttatagaccaatggtagggttgtagttgctcttgtctgatgaaattggagakawacatgaggtggaatactttccttagaaagttctggatggtaggwagtccaagatgaagatagcagaagatgtaacatcctgtgagcgctcactctctgtttcaaagatggtgacttttctgtgtgtcttcacatagtgaaaaagactaccccaaactggattatttataaagaaaataaaatttctcacagatccagaggccaagaagtccaatatcaaggtgccagcagctgtcaaggggcctcttgttgagtcatccatagtggaaaggcagaagggcaaaggcacatccatgagagagagaatggaaacagttcaaacttattcttctatcaggacccactcttgagataactcacgcctatgataatggtgttaaaccactcatcagggcagaggtttcatgatgtaatcaccctttaaagatctcacctctcaacactactgcatcgaggattaagtttctaacacatagactttgaggaacatattcaaaccatcacatataagatagagtatgtgtgtgtgtatatatatgatgaatata

SEQ ID NO: 10595 - DNA, 447 bp, Homo sapiens
caaacgtrdcwraaaagtatttcttccctgtatcccagagccttctcttcattctctacatcataacttcttatacgccatgcagatttatcaacaggaatttatgatctgcaatattaaaaatgttccgtttgtggctgttgaacatggaaagatgtggatactcaagatttctattggggaaaactgtggtccttagtaaagatggagaaaatataatgttgaggctccattcatgtgttccattagctgtatgctgaacaggattaaggaattgcttatttaggtcgggcgtggtggctcatgcctgtaatcccagcactttgggaggtcaaggcaggcagatcgcctgaagtcaggaattcgagaccaacctggccggcatggtggaacccgtccctactaaaaatataacaattagcctggcgtgatggcaggcacctgtaa

SEQ ID NO: 10596 - DNA, 532 bp, Homo sapiens
  misc_feature 246,351..352,457,475..476: n=a, g, c or t
tgaaatatgagctgagattgtgccactgcactccagcctgggtgacagagatcctgtcatatgaaataatgaaatgaaatgaaataaatgaaatgatgaaatgaaataaaatgtgagctgagattgtgccactgcactccagcctgagtgacagagtgagatcctgagtgagatcctgtcatatgaaatgaaatgaaataatgaaatgaaataaatgaaatgaagaaatgaaatgtgaactgaghntgtgccactacactccaggctgggtgacagagtgagatcctgtcgaaagaaatgaaatgaatgaaatgaagaaatgaaatgtgaactgagattgtcccactgcdnnccaggctgggtgacagagtgagatcctgtcgaaagaaatgaaatgaaatgaaaaatgaaatgaaatgatgaaataagtgaaatgaaatgaaatgaatgaaatgankvaaatgtgagctgaganngtgccactgcactccagcctggatgacagagagagatcctgtcatatgaaatgaag

SEQ ID NO: 10597 - DNA, 445 bp, Homo sapiens
ttttttctaaataatatgttcagagattcggactgaatgcaattgcaaccttctccaccagtcagcaaacactgagaaagtttcctcatagtctacttggcagttgcagctgtccctagaatgagtcctgaaacctagatctgagttgcggtagaaagcctattacttccttgcttgtttgaagacagcctactgtaagccctatggcttggaggtgaccaggctctccaggagaacacttcgagccctctttgccctccttccctgccccctcttctaggggagtcagatcgagttgtaaggagaacatgcccactgtctcgatggctgcagcgtgcaatccatacagacggtgaggatgcaaagagaaagtggctgcctgcaaaccaggaggagagccctcaccaggaaccaatctagctgacactttgaacttggacttcaa

SEQ ID NO: 10598 - DNA, 50 bp, Homo sapiens
aatctggwcggtccgaccgcctcgtgmttgrtgggtttacaaactctgac

SEQ ID NO: 10599 - DNA, 453 bp, Homo sapiens
aggacaccagtaaatggcgtttcttccaggggtacagtctttctcttccatttactctctgcccctccacccagtatctgtcggaccaggagaccgattccttcagcgtccaarctttcctgactgctagtcctctaaccaaggctgggacgtaaccagcggaatsgtgagaacggggcttcccgtttagtcgggtctccaggatcaaaggttccgcgcgctgagttcgcgacctcgagttgtaatctggcggggcgcacttaagccggcgcaggccttcgcaagatggcggctggaggcaagggcataggcctttcagagcgttttcttttttccctttcctcccttcctgcaaacaatacagccctttcaaggagcagtaagatccttccagcgctccgtaaccttccgcctgcccccgggaagtacgaaagtccggtctcttggagccgc

SEQ ID NO: 10600 - DNA, 425 bp, Homo sapiens
  misc_feature 307: n=a, g, c or t
atcccctgaagatgcatcccaaaccgatctgccgccgctcctcatttctccatgtttaatgttcacggttcacatggaagtcagaggatgattccttcaagcccttccccacagccattcctatgaagtgattcattcttttgtcttccagccctcaccatgacttagtattttcgatgtctcacctcaaatcccccacgctagktggctacatttatttattggcggagatgtgaattatcccatttccctcctacagttccttcacatgcacctcgaagaccatttacttttgggctactgccangcaaatttcaacccacgttcttttacccaatgtccatgtagttcttttaagtttcctatctccaatctgaaataatggccttcagtctgtcaaaactttagtgaataaacattcttta

SEQ ID NO: 10601 - DNA, 443 bp, Homo sapiens
  misc_feature 239: n=a, g, c or t
ttgccatcagctattgaaatcactcctgactcgttcctgtcacaccagtgtatttaaagtttcatgaagttagttcacgtcattagcatgtttgatatggtggagcgtgtggagcctggtggattttaatatttcacagcatgttctgtgaccttgaagtagacgccttaagatttagcagttagttcactgtggaaagatgctcccatgagtccccccaaagacactgatttgccctnggttatgcttctkagccactaattcttkggattagtttgacctaaagcattgctgtctgtcagagtatacctttgtgcatttccttccctcaccaaagtgccggcttkacadawggcttcttaattggtgtggacaaaaagtaatatccctgccatagtagtctacacatttcacaattcacgttcgatttcagcatatggatt

SEQ ID NO: 10602 - DNA, 482 bp, Homo sapiens
cagaaacaaagcaaaaagcaggccacagccttaccaacaccaaagaaacatccaagcaataaagtggaagacgaaccaagatttggacattggaatgtttgctgttattctttaagaaacaactacaaaaagaaaatgtcaacaaatttttccagcaaactgagaacctgggaattcctgcacagaagacaagagagcagcctccccagtttcagcaagcgctaggtttatatttttttcctggtttttactgtttgggtaatagatattgaaacaagtaatattaataccgcatggggagaaccccaaccaaagaaatctgaaatataaaataaatgcttttttttccgtttttgttcattttggatgctggcgctaagctccaagtgtcatgattaaaaaaaaaaattatgtccttatttatttctaggatgaggggaggataacatttttgctttcttatgtgactctcttggaaaatg

SEQ ID NO: 10603 - DNA, 494 bp, Homo sapiens
aaggtcsaggctraggtcggkctcagatggagatgaggaacttggttgggagctggrgcagagacaagacttgctcctccttgcsttccaccatgattgtgaggcctcsctagctacgtggaastgtaagtccattaaacttctttttcttcccagtttcaggtatgtctttatcaacagcatsaaaacaggctaacataccatctcgactctcattaccactctcttgtcggtatttactcacatcatgcttgactgattyaagttgcctatatgtattttattctcactcagatcttgctcctttacctgggtaggtcctactcactctacccatatgaagcaatgtctccagcaggagttcttcccagasttcctcsaggctgggttagaatcctctcttatagcctccaaaagcactatgtgattctctctctcatagtagttgtcttactatagcagatcaatatactttcattggtagaaccaggtta

SEQ ID NO: 10604 - DNA, 480 bp, Homo sapiens
  misc_feature 474: n=a, g, c or t
aacagatatagggtgaatgtacatgttttcatttcacatataaataagggagtataggagagaagctaaaaacaggctgtggatgcaaaatgcctgggttgaaatcctacctgtgactgtgggcaaatctcttaatgtctatgtgcctcagcttcctcacagggtagagtgaaatactgctcaaaatatttgccastgcatcctgggagagaattatcgtctcctgccccattgtattcagacttagatgtgtgccttgctttggctaatgatgagtgtcagagtgacgtgctgcttcaaagctgtagcattaagagctgttctgtagtgccatgatctctcttgcctctgcttgaaaactcagaatgtcctggatggaggccatcccctctacctggtcccatggaacaagactgctgctcacccctggtggacacagtgtgakcaagarataaacttctgtgtgtattagcnctaaaa

SEQ ID NO: 10605 - DNA, 407 bp, Homo sapiens
  misc_feature 255,364: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaagganaaaatgttaagggcagccagggcgaaaggtcaggttacccacaaagggaagcccatcagactaacagcagatctctcggcaggaaccctwcaagctaggaaagagtaanggccmatactcaatgttcttaaagaaaagaattttcaacctag

SEQ ID NO: 10606 - DNA, 472 bp, Homo sapiens
  misc_feature 399: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtganactgtgcctagcctgagccaccacgccggcctaatttttaaattttttgtagagacagggtctcattatgttg

SEQ ID NO: 10607 - DNA, 303 bp, Homo sapiens
  misc_feature 91,143,150,192,270: n=a, g, c or t
cctccaggccgcagcggatctggaacgactttctcagctgttcctccacggccttcgcagcatcaaagtggctcccggctgcggcccgcmntccaggcccaaggcaggctgctcttcagcacgggcatctccagctcctgcgncaccgsnctcggctcggaccgcaccggggagggcggcgtcaggcggaangggacctgggagcagagggcagtgcagtggaccaaggaagtgctgtgggaacatcagatagaatgggwtagcacaghngcaaatttttacaaaaaaggattttaaaggaag

SEQ ID NO: 10608 - DNA, 250 bp, Homo sapiens
atatagaatcccagccttatttcagtgcagggtagggtgtcaaatatgaaatgtaattctacagggcaattctattttggtaaaagaagtggggagaaaagcatcaccagccagctttttraatttttaccacaacctattttgtgatccctacgtgtcatttcttcagtatattttttaaatgttttaaaatatacgaacatggtgagatttttaaaaaaaaaaaaaaaaaaaaggaaaaaaaaaaaaa

SEQ ID NO: 10609 - DNA, 87 bp, Homo sapiens
atsttkacccaggactgctactctcccaagcagtgagawaaatccatttctgttgtttaagccactcagcctgtggsattttgttat

SEQ ID NO: 10610 - DNA, 464 bp, Homo sapiens
aagaactgcttgaaagtagcacccacgattttcctgcaggcatttttgttctatttgatactaatgagttggctgtgtgggcagtgagttgataaaggaacatgaactgaatcattaagcctccattttattgtctccactgtacagatttcacaactgacttgggtgaggaaattccaccaaaaactttaatatggaaaaaaagagaaggaaaaaaaaggcaaggtatctctaaatagctctgcaaaggtcaatgggattaatgtatcctttgaacatggttattttagctgaaataagaaaacagcatgagggaacttcacagactacttgtgtaatagaaatgtaatgtatttgccccttttttcttcctttgtggcaaacatgtgattacatgaagcaagttggtagaataaataaaataaccaagaaattgtgctctggaaatgtgttcattatctgta

SEQ ID NO: 10611 - DNA, 391 bp, Homo sapiens
  misc_feature 315: n=a, g, c or t
actatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctstcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgaggcccatncycctcasccccacgccccgcccctacaacctaagtcataaatcctcttcctccctcctttaaaaaaraaaaaaaa

SEQ ID NO: 10612 - DNA, 447 bp, Homo sapiens
  misc_feature 112: n=a, g, c or t
actcaggggtcagggcatcactggtctcgcgtgcgcgtgaccaggcccggtttccggtgccaggacctttccgaagcgtcgagtagcctaacggtcacagctgtcgcccaanggagaggcaggactactgcgagcagttttaccgkamcctccggaggccggcgtgacaggctctgtcactaaaataggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtgcaggaaccgaatattgtatctgacgcatcctgtaatactgaagagcaactgaagacagttgatgatgtccttattcattgccaggttatatatgatgctctgcaaaacct

SEQ ID NO: 10613 - DNA, 338 bp, Homo sapiens
ctaattccctgagcaataggagtgttaggaacaaagaacattttgtggccaggtgcagtggctcacgcctataatcccagctctttgggagaccaaggcaggcagatcacgaggtcaagatatcgagaccatcctggccaacatggtgaaacccgtctctactaaaaatacaaaaactagctgggcgtggtggtgtgtgcctgtagtcccagctattcaggaggctgaggcaggagaatcgcttgaacccgggaggcagaggttkcagtgagccaggattgcgccactgcactccagcctggtggcagagcgagactccatctcaaaaaaaaaaaaaa

SEQ ID NO: 10614 - DNA, 437 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaagaattttcaacctagaatttcatatccagccaaactaagcttcata

SEQ ID NO: 10615 - DNA, 480 bp, Homo sapiens
  misc_feature 462: n=a, g, c or t
attctggcggctgggcacagtggctcaagcctgtaatcccagcactttgggaggccgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaaaaaaaaaaaaagaaacwttctgtaatctgycaaggtaatggaawttawtscaktgacactgacaatawtttaaagcattttaagggctcttaacgttcatctmastcgytctagaktgaaggagagascagagattacagascaggtcstaggtcstcccccagatatanaaaaaccgcatttggaga

SEQ ID NO: 10616 - DNA, 503 bp, Homo sapiens
attctaacctggaaaacagccgcaacggtaacagcaaacaggactgcttccctcgcgccagtcactgttctgagggcttcgtgtaattaattcatttaatttggaagtctgactaacttatttttgccaagtctcatcaaatttcagttggaaatcaaggattccagatgaaatgtttggctttagtctgtttatttcacctctaataaattcaggcagaggaagagaactaccagacccgaagaggaggcgtgtgtttatctctccgtgttcttaaccttgtttttcctcttgacgttttcccccagaggagtgtgcttcagttgctgcactccacgagcgacgtgtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttagggccc

SEQ ID NO: 10617 - DNA, 556 bp, Homo sapiens
attgtatggggcaattttaagtcagctaaggcaataaccttatgcatgaacatttcccagactttcatgaagctgttgaggtcctataaaaatttaaaaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaatgagtgaaaatgtttaata

SEQ ID NO: 10618 - DNA, 563 bp, Homo sapiens
tagaatcctattattttttaagaaggaaaaattggacagcctcctgagccagagtaggctcggagactcctgttgtttctaactgaaatagtaaataatgtatttccaccatttacccagagtaggctcagagactcctgttgtttctaattgaaacagtaaataatgtatttccaccatttagtagcttttcaagagtccttaaaaatttttggacagcacagaaacatggattacttagccctttagttctcagattgagttatatacttcccagcaatttctgttatttaagattgccatctcatttctggtgtaatacttacatggaagtctttctctatttgggggtggtggggttctggcacataggaatttcttaatggcagaatattctgaaattctcggcattaaagtatacttgataattagttcacttaatattaaagcatgttcattcttttcttcccaggtcgctattaaagcatgaagactttctgaacctgccctagagctgggatattgtttgtgggcatattttttattgtctcttgttaaaaagc

SEQ ID NO: 10619 - DNA, 454 bp, Homo sapiens
ttatcatcaaaaccaatcacttatttgcaccaaagtaataagtaagatggtctccaggattaaagtcatcagtggccataaataaatatgtttaactttcacatccagatatacttcattttggccaatgtgatggaggataccaatcagagggagagaactactgtttgtaaactgttcagcttccgtgatggtggtgttcacctaggctgtggtgcaccttgacattggaaatatgcttgatgtgtcgtttgtgttgtcactcacacccactctccaaggcacttaaaaagatttatttagctcttaagttttaacgtctatattgagatgtaattaacatgctgtaaaattcattgatataatgtaatgatttctaatatattcacaagagttgtacaaccattaccactatctaattctagaacatttttgtcaccccaaaaaaaaaaaa

SEQ ID NO: 10620 - DNA, 536 bp, Homo sapiens
agacttttaaaaatctataaattgatcatctgtttataaattggcagatggttgtgtaccatcttttaaaataaagattgaatttcacccagtgtgatggttcccattgcttatatttctcctgctgaggccggacctgatatggccctggtctgtgttcccagccttgtttcctcattaccactaaaatctttcccctgtatgcccgcccaatttttctggctctgagtccttgttcatactgttctctccaattctaccttccaaaggcctttcttaacaccttcggattctttctttgagaactttccagattcccatgcctttttggaatcaatctctatcctattgtcatcacatttaagtttctacttccatcatcctcactcctatccctttggtcctgggatgacagggatgctgtgttttatttactcatctttgtaacttccacataacctaaccccggttcttgcttatgggagatgctgattgtagggtctgagttagatactgttaactaaatgcttgttgat

SEQ ID NO: 10621 - DNA, 470 bp, Homo sapiens
  misc_feature 230,364,371,455: n=a, g, c or t
gggaagaggcacatgtcacacgtgcaagaaggtccaaggatgagattaaaaattccacaaaggtccaaattctagggcccagacagaagagaagagtcacatcatctagatgatgaatgaaaagatatgtcattattctcctttgggcagtgcttctgcagaaaagttgcaccttctaggtgttggactcagcaatatatcacaatgtctgcagtattttggaaggagangagagtcaccattacttaggtgctaggcccagcaatacatctcaagcacttcttgggcaaagccarcagtaaaaaagagtcacattacctaggttctgggtatagcaatatgtcacaaatgcccctaagaaganggcccangaaaagaagagtcaccttggtgagaatgtcagagatattccatttttgggtattcacaaaaaagaataaagtcccataacctanaaaaraaaaaaaaaa

SEQ ID NO: 10622 - DNA, 438 bp, Homo sapiens
agctaggccccttcctcctccagtgcctgtctacctatgtttgatgcttggggctagaaagactgaccttgtagcccctcaccttctctccccaatgcactgggctggttcagcagctgaccaatgagggtcatgcttgcatactgghcttgggtgagtggctcaggaacagtttgcaagaccgtgttgaagctacttgtaactagaccattttcccagcttgaccatgagcttcttcaaggcatctcttctcagtctccactgtagctctgtggggatgctaaccctggcttccaaggatctgaagaggaagctgcggctgtggactgtcccttttcggtctgtcttcatcctgcctgactcacgggtctcctgtcctcctgcatagcttgcggtggtgaggtgatggcagccatggacacaggcccagagagstga

SEQ ID NO: 10623 - DNA, 451 bp, Homo sapiens
aacccactccggaacccttccacgccatggaggttttcttcgttcgcttgctgctgctcgctctttgggtccacgcgacgtttatgagctgtaacacttactgcaaagatgtgcagtttcactcctgaagtcagtgagaccacgaagccacccgccgcgagaaaggaacaattgtggatgtgcaacctttaagagctgtaacactcaccgtgaaggtctgtggcttcactgctgaagtcagtgagaccacgaacccagtgggaggaatgaacaactcccgacgggctacctttaagagctgtaacacttgccatctttaagagctgtaacacttgccatctttaagagctgtaacactcgctgcgaagaatgaagaacgtccgacgtgccacctttaagagctgtaacacggctgggcgcggtggctcacgcctgtaatcctggcactttg

SEQ ID NO: 10624 - DNA, 529 bp, Homo sapiens
tcacacaccccaacacacacgccctgtcccctttctccaccctgcaagctagttgcatttagctcacagacctgggctgcgacttgaaagagtttaggcagcaacagagtgaccctgggggtgctcttgaccgacagccgcacccccggcgtctaggacctccgagcagggatgcatctgtaggtctagggaagcacttccaccccctcctctcctcaatcctggcaggatggctactgctgcttcaagacagtgacgtttctctccggtcagctgtcaggagckctggtgagcttcctactgtgccacaagctgggtcttactggggatctggccagccttgggggcccttggagccctggcccagtggaagctcgtgcctgaggaacatggaggccacgctaatgagacagggtctccctatgttgcccaagctggtcttgaactcctgggctcaagtgatcctcctgcttcasctcccaaagtgctaggattatascaccgaacctcgtcttkaatarccttttaa

SEQ ID NO: 10625 - DNA, 512 bp, Homo sapiens
  misc_feature 14..15: n=a, g, c or t
gctctctccaagtnnsccctcagaatcgbcccacccacttccaacccctccccatgtcagggaaaaaaaactccaaaacaactagggcgaggcttgctgtggcagtgagaagctgagaaagagctggagggtctggtgagaagtagagaacattcaaggccttccttccactaagataggaactgtggctaagacagaagaaagaaggtcagatgtttgaatggactttctggatttgataaaatgtgacactagtggaaacatttactagggacaacttttgagtgtcagaccctgtggacacaaagaaaaagcttgggttcctgccttcaaggggctcacagttgagtggggaagacagacacgtaaatgaagaacaataacagactgtgctgagtactggaatggaagtgcagcaggaactcagaagaggtcatcactggaggggccacctctgggaaggcttcaccaaggaagtataattggagctctgtcttgatgttcaaataaga

SEQ ID NO: 10626 - DNA, 562 bp, Homo sapiens
tatgttttaggattttttgactttatgatgggtttatagggatgcagccccatttcaagctgaggagctccttagggcttaggaatcatacctctttcacaccatggtaaagttggaaaattgttaagtcaagctgtcattaattaggagactgctgtgttgctaacgttatatgcatttttaacttatgatgggtttattgggaattaaccacaatgtaaatcgaggaccatctgtatattgtatgatttttgctaatgcattgagagagatctgtgtaaattatctatgacttcagaatatgcatattacctccaactgtgttaactcaacgtttttcaagagagtaagggtactttcaccctatgtggatgtactgtagaatttttctaagctacgaaagtctataaataacaaatcaacttaaactttttgggaaataatttctactaaagattcataatcggcgtattccttcaatgactgtacaagttcatccagtagataatctccttgcataaaagttcaagatcaaaaaaaaaaaaattcgaaatttcgwtcs

SEQ ID NO: 10627 - DNA, 337 bp, Homo sapiens
  misc_feature 310: n=a, g, c or t
ttccggtgccaggacctttccgaagcgtcgagtggcctaacggtcacagctgtcgcccawcggagaggcaggactactgcgagcagttttaccgcgacctccggagccggcgtgacaggctctgtcactaaaataggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtgataaaaacaagaatacctacttacngatgaagatgacaacactattctttat

SEQ ID NO: 10628 - DNA, 501 bp, Homo sapiens
attattagtacttcagaataggttcaatactgtctagtttctaggagtggaggaattgaagggcttattaatctttttaatctggatgagggaagtaaggacttaaagagttagtaagggagaaatataaggttattgttttatgatatgcaatggaaggtatcagtgaagattaatctgaggggcagtgttattatctgagagaacagttcaaattaattatagttgtcacttcccataactcaactgaatgtggttcagtttcttgtgacaggtacatagcttacttgaaggggactgggccctggagttataaccatcctttggctaggacaggtgttgaggaaacagctgaagcyttaagtactatataggtatagacttccaccaccattccccccacaacatacctctcaaatctscaagagatttgatgcttctgggatgagtagttaacmagaaaaagttcaatgtgaggtaataataaattgtccaacagat

SEQ ID NO: 10629 - DNA, 489 bp, Homo sapiens
  misc_feature 152,154: n=a, g, c or t
attgaagaaataatgatggaagattttccaaatttgaaaactgaactgacaagtttgagaagttatccataccccaagtagaagaaacaccatgctaaaatgtatagtaatcaagttgttgaaaactggtgataaaaatattaagtgcamsngnaaggaaaaaggcacattaagtacagaagaacaaagataggaataactgtcggaaacgatgcaggccagaagacaatgtagctacatctttgaagtactgcagaagaaacaaatttgtcagtagaaattctatacccagcaaatatatctttcaaaaagtaaggctgtacttttccagacaaacaaatgcatcaccaacagacctgtaccagaagaaatattacgtgttcttcaggcggaagaagaatatcaaatggaaatgtcagtctacacaaaggaatgaagagtggaattgctctcatttttttcatacctctagaagacaggtgactaagg

SEQ ID NO: 10630 - DNA, 281 bp, Homo sapiens
atttttattattagctggctatgaaggaaagaaatgcacttaattgggtaaacagtttatttcttatcttcttttaagctttctgaacgaacagaatttggctagctggttttctacccttgaaagcataaagaagcttggactgtctgaaaatactcttttctgggagtatgtwcgtagacaactgaaataaactgcaactcactggtgccaaatatatcacacatcagcccacctcctgccacggtgagcttgtagcagagaaaagaatgttctcaggt

SEQ ID NO: 10631 - DNA, 400 bp, Homo sapiens
  misc_feature 109,212,393: n=a, g, c or t
taaaggtgtatgtttttaatgtakaatctgtgtgtgcccccattaatattcttatttaaaagttaaggccggacatggtggcttacaactgtagtcccaacagtttgtnaggccgaggcgggcggatcacttgaggtcaggagtttgagaccagcctggccggcatgatgaaaccttgtctctactaaaaataccaaaaaaaatttagccangcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaangcgttav

SEQ ID NO: 10632 - DNA, 511 bp, Homo sapiens
  misc_feature 438: n=a, g, c or t
agtttgtgcttggtcgccagaggaggcggtggctgaggagagttgagtccactgctgaccctgttttacgttctgtgacccatgcccccgtagagtaatgacagaacatagcacctctgcctgcatggatgctgccatgataaccctgtctccttcttaccactggatatgaagattggcttgatgaaattgggacaaattgttctccagaataccaggtccatcttctccattctcctgctttcccaggtgcctgccacagtgcagcctggtactctctgaaagcagtaacctgaagccttactaggtctcaatcattgtttcacatcactcaggcactacaagatgatccaggcaaatttgtgtttatttcatgcccaagccaagtatccaccatttcttcaaagagtcgctacagggtcatctgttgactggggnccttgttagctgacacagcaaagaaatatacctgtgtatactaacacacacatataaatgtatctataatatt

SEQ ID NO: 10633 - DNA, 374 bp, Homo sapiens
  misc_feature 107: n=a, g, c or t
ccatttctgtaaaaagtattgttgggattttggtggggattgcattgaatatgtagtcacattgggaagtattaccatcttaatgatattaagtcttccagtccatnaacttgggatttttccatctatttagatatttccttcagcaatgttttgtgatttttagtatatacktcctgcacctctttggttaaatttatcactaagtatttgatttttttattctactataaatggaattgtttccttaatttcctttttagattgtttactgctatttatagaaatacaacagatatttgtgtattgcttttgcataartgtaacttctgctgaatttattagctcaaataatacttttgtggatcttattc

SEQ ID NO: 10634 - DNA, 487 bp, Homo sapiens
agataagactctgtctaccctgggcagctttcctgatccatggcagtctggcttacaagcaatactaggcttctattgtctctttctgtatatttataagaaacatggccaggcaagatggcttatgtctttaatctcagctgtttgggaagccaagtggaaagattgcttgaggccaggagttcaagaccaacctggataatggtttcttcccactctccagtgaataagcaacgatgagtgttaggctgtttattcagataccctcacgccactgcagaagcgagtagaggaagaatacaaggaaaaaagtgtctcccagcctgtggaaagaggatggctatttcatccactaaaggtgtacactttaagtgaattggtatgtctacatcatcccaggaggagtgaatgtctgtgtgtgtgtacctgagataagatgatgtcttgtccaatgctggtttcaccttgtgccctgagctgttgggag

SEQ ID NO: 10635 - DNA, 514 bp, Homo sapiens
agagtttgccctaagctttgggaatacttgaatgctgccagtaaagcctcatccccatgtgttaaatacttttctatctctaggaattccattagtcctatagtcctgagttcaaatcttttctggaattttcatcttacctctaacttgctgattgcataatactgatttttctgaattttatcttgctccttggtaaaattgaataacatgattcagtcttgaaagtaaggccaggcgcagtggctcacacctgtaatcccagcactttgggaggccaaggtgggcagatcacctgaggtcaggagttcaagaccagcctggccaacatggcaaaaccctgtctctacaaaaatacaaaaattagccgagtgtggtggcgcactcctgtagtcccagctactcaggacactgaggcaggagaattgcttgaacccgggaagcagaggttgcagtgagctgagattgcgccactgcactccagcctgggcatctcaaaagaaaaaaaaataga

SEQ ID NO: 10636 - DNA, 551 bp, Homo sapiens
  misc_feature 44: n=a, g, c or t
gacattgagctctctatagcaggcattgttctaagtgctttsmntagatttatttaatctyammaatagctctmtaatatgggtagtcatacccccattttgaagaaattgaagcacagaagagttaattaacttggctaatctcacacagctaatgtgtgatacaacctaggcagtcagagaatggtgggaaatgcctcatctgcaaattctgctgtcagaagaaccccatgtggggcagggactacagaaggacagagtacaaggtcttgagtacataccagcgaggacacccaaatagaagacatatttcatggtgatccagctcttccccctgtgagatgtagaagaaaatcagcagagtgtggagcggttggcttagttgtcttctcaggaacacctggtagactcagtggctatggttagatacggaggcactcyatggggattggaaagcagctctgggcataaacaggggaggagatggcttcagagagacagatgaaagccctctgttccagggaaggtgaggctgtgctctgttgggattc

SEQ ID NO: 10637 - DNA, 466 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaaattttttgtagagacagggtctcat

SEQ ID NO: 10638 - DNA, 451 bp, Homo sapiens
  misc_feature 74,205,209,287,312: n=a, g, c or t
attgttttgcaacaaacagccggcagccagggtcccaggcaggtttctsaagksckggcccccaggsttggctngggctcaatccttggccctcccaactgcctggccagscctgaacgattgagttatctccactcgcatcccctttgtttggggcggctacttgcccactcaaggtaaacaaattctgggcctgtgtgaaaanaaangaacggttatctctgatgccctcagcggcctggctggggagcaagactttcagaggcttctgtctccaaagawagganggatttcggagcatagckkccagangccagctgcctgggttcaagctccacctcggccactgactgctgatgacctttggcaagtcccttgaccttctgcttcaacttttttacctgtaaaattttggcacaataatatctatatcataaagtctcaaaaaaaa

SEQ ID NO: 10639 - DNA, 552 bp, Homo sapiens
taattcatactggaaagaaactctgcaaaccagaaagatctggcaatgcttttgacaacacctcaaacttttctaaccataaaagaaattatactggtgagaaatcttagaaatctgaagaatgagacaaagcctttaaatggttgtcacacttgattgtaggtaagataattcatactggagaaaacacctacatgtgtgaacaatgtggcaaaacttaaccagtgctcaccttattgcacaggaaagcatttgtacttgagataaattatacaaatataaagactgaaaaagccattaatatatgttcatatctcaacaccagatagttcatacttaataaaagcattataagtacaattactgtcaaaagacctttcagaaaatacaagcttttgaccaggcgtggtggctcaggcctataatcccagcactttggtaggccaaggcaggtggatcatgaggtcaggagtttgagaccagcctatccaagatggtgaacccatctctactaaaaatacaacaattagccggttgcggtggtggtgctgt

SEQ ID NO: 10640 - DNA, 456 bp, Homo sapiens
  misc_feature 393: n=a, g, c or t
cataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctccctttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtgganttgtgcaagcattttacattgccacataattgacttgccattttatggttaaaaacggcacat

SEQ ID NO: 10641 - DNA, 169 bp, Homo sapiens
attttgcatttccaccagcaatatatgatagttcgtttatttcacatctttgacagcatttagtgttgtcagggttttttttgtttgttttagacattttagtagtctggctcttgctgattgaattccttttggtgcagtttagcatgtycctcttgkgtyytgcatc

SEQ ID NO: 10642 - DNA, 155 bp, Homo sapiens
actcccactctcactgtgtgacagccctgctgccccttcaccttctgccatgattgaaaacttcctgaggccctcaccagaagcagatgcsagtgccatgcttcctgtacagccttcagaaccatgagccaaaataaacstcttststttataaa

SEQ ID NO: 10643 - DNA, 440 bp, Homo sapiens
atcgtcttcaactgacaggataatcattaagagtaatctttagttcaccatttactgctggaagtgttgagaagtaatttaatcttttttttaaatgataaaagtgacttacagaagttatgctattgaccattaagacttaagtcatttatgcaactacaagttaccagaacgagacaaaagattatgcaatctagaaaaattcagtcttaacccaggaaaacaaaaaagttattaattaagataactattggcaaacactgaaaacagctctggtaacctagtaaagtggataattattttgccagtaaactgtaacaaggaaacacactgtggtaattatgttaagtcaaagctcttaatccactatcaatgamaaaaaatctcagccatcaatcaatttaataagtttacacrttatagctttactttttcctgtt

SEQ ID NO: 10644 - DNA, 129 bp, Homo sapiens
tgttctgttctgtctssctgtagtcagtcttctcsttcattctctgstgatcactaatgttttcttgctactgtaggcttgccttttctagrtattgcatggatagaaccatacaatrcatagtctttt

SEQ ID NO: 10645 - DNA, 541 bp, Homo sapiens
tagaagcatttgttgtatgttttcaatgtaggtaatgttagattattgatagaaaagtatataaacttatctccaaactacagttcataaatcctgattgaaaatggtacctactgtcctgcaaaacctcatccctataccatcatcccaggtctcactttctctgctaactgtagtctaactgctgagcttggcaacagaacaatcccatgagtctgtggccctcaaatgagctgtgttctctggtgatttttgcacagatgattccccctattgggataacatttctttggcttgtcagcttggtgaattcctattaagtcctcctaaattctgctccaggcgtttctcctccaacaaaattccctctttgcccagtgaatcccccgcttttttggagagctgctgtgcactttatattgttttgtgatatatgtataaaaaatcagtttcttgtttgaaagacaaaaagactaatttatttttgtatcccaacaaagtggcagacagtkcatgtgaaatgtttgttgactgaacatag

SEQ ID NO: 10646 - DNA, 557 bp, Homo sapiens
  misc_feature 386,399,475,481: n=a, g, c or t
attttttctattgtaacatctaggcaaaacggccaacccttgtgtcatttcaaaaagaccaactccatcagatgttccggagactgaggaatcaaagccttagaagaccagggttaggaaattatacwkyracaggactaacaggagaacaggacactctccaaactctccctccagtctaagatgatgccagctccaggaagttggggattgtcttcctcactcctgtattcccggctcctagaacagtgactgtcacccagcagctgttgagctaatggctattgagtggacaaccactcgagcaacaatgcagtcagcttcgtggactttgttttactgaggggcatctggagagttgggaccagaggtgaattgctcaaganaagagggaagcantgaggacacagctgtcctcctccatctatccccagagcctataaggaggaggagcagaggacacaccatgtgargnmcacancaataaggcagctgtttgtaagccaggaacagagcctcacagaaactgactttctagcacgtgatcacagacttca

SEQ ID NO: 10647 - DNA, 557 bp, Homo sapiens
  misc_feature 67: n=a, g, c or t
agagatcgctttccactgaaatgtaccgaggaaaggctatgtgaggacatagcccagaagaggbscncaccagagcccagctatgckcaaccctgacctcctgctccagcctccagactgtgaggaaatacgtttccatggttgaagccacccagtctatggtattttgttgtggctgcctgagctaagacaccatcacacaatgaccagggaggctctttggccgtggtcagcagaggcagctgtkccactgcctgtgggtgccacgcctgcctcacagcagcaacttcctcataagaaagtctctgctgttatttagatgtgtgtcttgtctcccagactcagatacaagcccatcaaggcagtgaggttgacatctttttttctgacttgtctgcaaacccgtcatgaggattgttgcacagtcatgtttgggtaatgccacgtacagtctttccttcttaggcaattatattagcagttaaaggctctgagaagttttgcaatgaagatgctgtcataagtttgtctaattcagcatttgacaacagaactga

SEQ ID NO: 10648 - DNA, 484 bp, Homo sapiens
  misc_feature 117: n=a, g, c or t
tcattagggaccgttgctggtgggcrrgggatgggcgtatagtgggctcctttgaaggttatttcacagttgaggattttgggcagatccataacagctggttccaawtttgacagngaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtag

SEQ ID NO: 10649 - DNA, 553 bp, Homo sapiens
  misc_feature 524: n=a, g, c or t
gggtttcttagaacactcctgtgatactggacccaccataccggagaagccacagatttgcatcctgtgtgagagcatcctcacaccccatctttccagacatttctgccaaagtgtccaacacatgagtgaagccagcgtggagctccataccagccctccatccagcccaccgattcacctaagttgttatttggagtacgtgggctgtatgttttctctctaacctttctgttgtaaatttctccaagaaaggaaaccaaatagaatcttggagaagatgttcccagttgggatgtcttactaaaggaagttgatccaaaatgcacaggggatggactgtgctgggtgctgtgtctcaccaaccagatttttacttctcttggaaatatgagtgttgagaagtcacgtgtgagccgttttctgggaatttccctgagataaaaagtaccacctcctttcaagtttcagacgcctgctcagtggtcacatatctaatgatggtggacgcaggagttgtkaangtcagctccattttctccgtctgcctttt

SEQ ID NO: 10650 - DNA, 538 bp, Homo sapiens
agttcgcagctactggaagagagaggagcatatcaattgtttaaaacaaaaagccagcgttaacaggctcagagaaatgaagttgaaaggaatagatgtagctcctgaatagaagcaaaagtccaacgtggttccattaaaatgacttctcagccgtctctccctgcagatgacttcgatatctaccacgtcctgactgtctccaatgtttttttcaacaagacgcactgacctggaacaacgaaattcactgctccttttgtgaaaccaagcaagaaactgctgtgagggccagtatttccaaagcaccaaaaataattattttccacctaaaaaggtttgacattcagggtacaacaaaaaggaagctgagaacggatattcattacccactcactaacttggacctcactccttatatttgctcaattttccggaaatatcctaaatacaacctctgtgcagtggtgacagtttcgctcttgtctcgaactcatgacctcaggtgatccacctccctcatcctcccaaagtgctg

SEQ ID NO: 10651 - DNA, 497 bp, Homo sapiens
  misc_feature 363,482: n=a, g, c or t
agaagccaggttgtcatctcaaatgccgtccctcacattcccaccactgctcaggggagcagctctctatttttaaacatgttttagtaattatgaatatgtgttcatatgaacattttaaatattactggcatttgaaagatacatttaatttttttttttttttagaaaaagcaggatgacatttttaaaagctatgtaggagggctgtgcycattcattttcaaacagaaagcgcagttgcctgccatacagctgaaccctggccaaaggtcatgagattatcyctwdkagatcacatttctcaagagaaaggcacttggactgggycctttgtgtactgggtcatgccttgtaagcwknscataattaccaaaaaatgctgctggaggtcccttcttaattactgagcactttcgttccgaatcaagcagaaatgagtggctaagctcagggcctgaaataaactkagggaggcattnaaaaaaaaaaaaaaa

SEQ ID NO: 10652 - DNA, 445 bp, Homo sapiens
tgactaaaaaattagcaggcatggtggcttctcaggaggctgagagatgggacaattgcttgaacccgggacatccaagacagcagtgtgccatgatagtgccactgcactccagcctgggtgaaggagtgagaccctgtcgcaaaaaaaaaataaaaaaaagtgttaaatcactgaggtagaaattggctttttaataaatggtaccgatatatctgaatgtcccagataataaatgataccactgaataaatagtactgagatatttagaaagrgataaaattagatacacatcttgtaccatgkwtaagrataaatwcmacatgtacacaggttttcatagcattattcataacagccaaaaaattcaaacttatatgtccattgactgataattggataagcagagtgtggtatgtccatacaatgaaacatatttcagca

SEQ ID NO: 10653 - DNA, 309 bp, Homo sapiens
atgttctctttcctaagataccctccaaaagacaagaggaaagtttgccttttctgctcccttcttggaaagatgcaaagtgctttagtaggctcctgggccaggcgcagtggctcacgcctgtaatcccagcactttgggaggccaaggtgggcagatcacgaggtcaggagttcgagaccatcstggccaacatgcacaacaatggcttctatgggcactacagaagccaattcaagagtgaaagtgctagagaataccaccttgcagccaagccccagcstccagcagtgttcctgcagcgatgtc

SEQ ID NO: 10654 - DNA, 426 bp, Homo sapiens
gcgaagtcaaactgttgctgtttgctgatgatgtaatcatatacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccacagattcaatgcaattcccaccagracaccaccatc

SEQ ID NO: 10655 - DNA, 527 bp, Homo sapiens
attgattagatataaaattcagtttaaaaagaacatgctattttttaaatgccatcacataaacaaagtgatttcacagggagaagaaagctgtataaagctgcagctttcaacaggttttaaacctggcattaaaatgtaatgcaaaaccaatattttctatattgtgaagggcaaaggttacagaaacggtcccaagaaaatctaacacccaaattttcctttgatagatagatgcctttaaaagggctggtaatgcagttacattctaacagagaagtccaaactacaggtaaaaactacggcttgtactgtgaaaaatgtgcagcttttcagttataaaactagttgaacactggtttacaagataatccgtagaacagagagactgtagaaaaatattccagcacttgagttgtgtgtggcagcagcatttgagtccatgaatgctatggtcattaaaataattgattatactttcctaaagaaaagccattttttaatgcaaagtctactacttccaaatg

SEQ ID NO: 10656 - DNA, 149 bp, Homo sapiens
taataataaaataaaaatttagattataattggaaatgcattgtatgtttgcaatagtcaaggataggtttccaataacgtattcactgatctgtttttcttatagtctatcaagctgtattcattaacccacgggscagtgactagtc

SEQ ID NO: 10657 - DNA, 525 bp, Homo sapiens
gtcctcttgtgggatgctgcagactcacagtgactatgatactgcctcctaagcaaggacacaccccagtgatgagaaataggcaaaccatggtcttgaaatgcctaggagtataggctggggtttggagggaaatagttggatgacctcaggaaatagaaaaaaacaggcagctgctttttggagagagtggagatgagatcagtgcctacctggaacaaaaccctctggcattctagactggctgaatatgtagtgtagggactttatcatctgtcagaaaatctcctttaagaagaagcgatcaagaagtttagtcctggccaggtgtggtggctcacgcctgataatcccaacactttgggaggccaaggcaggcggattacttgaggtcagaagttcaagaccagcctggccaatgtatggtgaaacccgtctctaccaaaaatgtaaaaaattagccaggtgtgatgggcacacacctgcaatcccagctactcaggaggctgaggcagaagaatcatt

SEQ ID NO: 10658 - DNA, 470 bp, Homo sapiens
atggatgctcaagtcccttatctaaaatratgcatcatttgcatataacctgcacacatcctcccacatactttaaatcaactctagattacttataatacaaaatacaatgtaaatgctatttctggaggctgggagttgaagataaagataccagctgggtacgatccatgcccagttttccatgcagactgctgactttcttatatatcctcgcactgtgaaaagaaggttaaatacctgggagtgagattgctgtgtcatatgacgactgtagttcattcaggagacaacaacgccgcagtgatactggaggctcctggaggacctcagcgactcaaggtccagtccaaggagggccgcagatcaggctgaagaaggatggatccacatgcttagaggagatcgagaaatgcagaagagagatgcagscagagaaatgccacagaaatggggggctggagagaatc

SEQ ID NO: 10659 - DNA, 520 bp, Homo sapiens
aatgagactaaggtatgtccagatgagcctagccccttcggagggggtccctttggaggctatgcaggactgtcacttttgttgaaaacctgtttggaacctcatttgggaatggccttcagagcctgtggtgtgttcttcggttgtcctcattggtagcatgtcctcctacttcaagagcctgaaatggctaggtgtggtgacatgtgtctgtaatcccagctactcagcagtttgagatcttgaagatactcacagggaagatagtggtggggcatgccatccacaacgacttcaaagcccttcagtactttcaccccaagtccctcacccgtgacacctcccatatccsccccctcaaccggaggctgactgcccgagaatgccaccatgtctctgaagcatctcaccaagaagctgctaaaccgggatatccaggttgggaaagcggacattctctgtggaagatgcccaggccaccatggagctatataagttggttgaagtcgactgggagagc

SEQ ID NO: 10660 - DNA, 403 bp, Homo sapiens
  misc_feature 297: n=a, g, c or t
cactcctccctgaagccgccactacacacagcgctcggtcatcttttcaggaactytttgctgttctggggatgctcctctggatatacttcaaaatccaacaacaaccctcttataatgtggactcccctccacagcagaacacaacaccatcaacacagcatgtctccccaggacaaacagaaagactctgaagcagtgaggtggaacctgcccttgagggcaatcaacgtcaaatgacttgccatctcctaagagcaaaaagtggtcagtggctgtaaaaacyttccwcgtctnacacagtgggaaatggaggaagcattactactttttaaattattattrtactattaagttctggggtacatttgcagaacgtgcaggtttgttacacaggtataca

SEQ ID NO: 10661 - DNA, 428 bp, Homo sapiens
acaagtctctttcatttcggcagtttaaagacacaactgtgggctttgaggcgatgcccgttgggcaaacttaggtttatgtgtttggtttttcagctgacgtggaagccctgggtgggcgtcccctggctggcctggcttttgggttcaagtctgtatgtatggagtgggttggggccccaaagctttgctgctatttgatttgtccccgacagcaggcaaagcctcacattgccctcaattttccccctttcatttgaaggaccagtttttcatggtactttgtcttgatctttttcatagtgttcaaatctgtatttttgtatgtagagggaaataattttctcaacactaatcgttaataactattgtattaaattgtcatgaaggaacttgtttaataaatggacgtgtaaggcaaaaaaaaa

SEQ ID NO: 10662 - DNA, 503 bp, Homo sapiens
acaaaggatcctgcgggcttgaacaaggggctcgaacaaaaagcagttactccacagaagaccagaggggtcctcccagcattgtggctctatgaggaaactgagacccagagatggaactgggattcaaaacaatgtctagtgtgactccagagcctttcctaactcctacttaaagcctctgaggaatgctgaaaagagcacaggacatagaatccagattaaaatgatgaaagtcatcaaccttaaaagaagcaaaaaagaagagaattagctcctctgtgtaatttttttaaatatagcatcaaaccatcttcccgtcagcaacaggcactgcagtattgaagatcatcacatgagggcagagggcgtaaaaaaggatggtgtgttgagaccagaagcagcagcagtcctcgacatcaactacaactttccttcgcacagtgcataccctctgatatactgaacccaacgcctatcctccagcccctaagaactagaga

SEQ ID NO: 10663 - DNA, 562 bp, Homo sapiens
tttattgttttaaatcgtcatcgtcctctgggaattaccctacatgtttgtcattgcttactgttcatttttgaatgtcagctcatccttcttgaatcattcttctgaaattcatgttagaagactttttagtcttctaactgtagatgataatttatttttttaataatttctcagtttgtgtttgtctgaaaataactgtattgcttctgtttgtaagaaatataccataagtatggattttgtcagaagattggaacggcagtkggatcacaggctagtgtaaagagattaagagcccatcctgcctatcacagcttcaataagaagtggaacttgcctgtttattttcaaataagaacagaagtctgtgacaggatgagctgaggtgccaggtgagccagctgtcatcagggaaaaaagaacgcacatctaggaagcgctggtacagacagccgtagaacccgaagatttagagaaatagcgggatccttagaagcagcacttacagatgtcctggaagatgcccagctgaagtccgtattgcctttgsttctcatag

SEQ ID NO: 10664 - DNA, 583 bp, Homo sapiens
aattccatgtcagtttctttataacgtacgctcttgtctacacccacttttccgtcatggcacccatctctgtcgttttatctgtattgtgtggatgtttgactgatgctcaccatgcatgagaaatgtatacaaaatacgaaggcagagagaaagttttagaacacacctatatgacccaagtaatgagtttccatgtgtgccctggaggttggaagaggagtcaagacagatgctggaggcagatgggccttaaggcacagactgcccttggggtatcatttcacagattttggctcctataaatgatacttctgggaaattaagatatagatgatacacatcacaactccttcaaccacaagtaaatcaagcacattggtaatcctttacaaaatttaagaaaatttaattacgttatttcttcaatttgaattttcaggtgtatggcaaatatctcaccaaagaaaattattagtgaamctcaaattgagcagttattactctttcacaaaattatatcttatagaatcttgagcgcatcaagtgactgcatgtctgagtataattaaagactaaaaaa

SEQ ID NO: 10665 - DNA, 265 bp, Homo sapiens
aaaaagttgaatgcagattaaaaactgtcaggaaatgggtgatttctactaacatcattcaaatgctctaaaaattatctatttcacatgctgatagtatgttacatggatactaaatacacaaggattataagcaaaaatgcaggaggggaaatggaagaaagagactaatgacgtttatgcacctttcaagtgccaggcactggtttgtgcttcatgtgcatccatcattatccttcatctccatgacaattctactggcagg

SEQ ID NO: 10666 - DNA, 480 bp, Homo sapiens
  misc_feature 439: n=a, g, c or t
ttcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcctatctcagctcactgcaaccaccggctcctgggttgaggcgattcttgtgcctctgcctcccaagcagctagaattacaggtgcgcaccaccatgcccagcactttgggaggccgaggcgggcggatcacgaggtcaggagatcgagaccatcccggctaaaacggtgaaacccgtctctactaaaaatacaaaaaattanccgggcgtagtggcgggcgctgtagtcccagctacttggga

SEQ ID NO: 10667 - DNA, 433 bp, Homo sapiens
ctgtgagagtttagcggtaccactgctgagagattttagcagtctcaaactctgtgcacgctcatactccaaactgtttaacgtgtgaamtctcaaagcttacgttcctaattgcagtgactagagattttaacaggtaatggaatcagcgggtttgaaagttataaggcactcataaagcagatcttggcgactcttactggtttggccttttcctaagctttggtgggtggtgtgcttgccacactagactgactgccaaggctatggtgcaggtgctaagctctgcagttacatcatcattcatgggttctggaakgcacattttctcatatgtcaactctgaaatcagaatacctcatttttagttaaggtaatgaagtgacattgtcctcatctgggatacagtaggtkaagagttaaaaacatttct

SEQ ID NO: 10668 - DNA, 260 bp, Homo sapiens
attctggcggctgggcacagtggctcaagcctgtaatcccagcactttgggaggccgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccag

SEQ ID NO: 10669 - DNA, 493 bp, Homo sapiens
aagcatatatatatggcactccaggaagatgaagtgtatgcagctgtagtctgggaggtctgatgttagggaaaaagaaggaggaaagcaagattaaaaatcattcctggaaatgcaagagaaaatgtgctggagtggtgctgttagtaccagggacactggacaagaaagataagcaagccactgctgtctgattcctacatagcaggttaaagtgttggattcataattctcacttcaggaagactgaaaaccagactttattctgttagatcccaagatatcaaggaagaggaaaagggaagagccccaggcactattaaaccacagctacaatcactgccatttgaaacttcccaccaaacaactttactattctgatttaatttcaactcccagggagagttagtattaagaggaagtacctatcatccatgataatccaccagctctgggggtttagaagggaaaagatggaggtctcagtgcttga

SEQ ID NO: 10670 - DNA, 345 bp, Homo sapiens
  misc_feature 11: n=a, g, c or t
gcccactgganbtctggagggtgggacatccccaaacctaaactgttaactgagacctggaactgtagctgagtcatatattcttcttctttttttgagacggatttggdtcttgttacccaggctggagtgcagtggcgcgatctcggctcactgcaacctccgcctccccggttcaagtgattctcttgcctcagcctaccgagtagctggggttacagacatgcgccaccacacctggctaatttttttgtatttttattagagacagggtttcaccatgtctactaraaaatacaaaaattagccaggcgagtttggtgtgcacctgtaatcccagctact

SEQ ID NO: 10671 - DNA, 196 bp, Homo sapiens
  misc_feature 110: n=a, g, c or t
acgacgcccagctaattttttgtgtttttagtagagacgggggtttcaccgtgttagccaggatggtctggatctcctgabbtcgtgatccgcccgcctcggcctcccanagtgctgggattacaggcgtgasaccgcgcscggcccctcataaggtatgttcttttacttcaaaatagaaaatagtattaaatga

SEQ ID NO: 10672 - DNA, 447 bp, Homo sapiens
aggtcgttggaagccccagtatgggagatgctcctcagggaggaagccatgtgagggggccggctctgtggcaggattgttgctgaggaattgttgcaacctatggactatttgttggaatcctgaccaaactggaaaagtggcagtaaccatggaaaagtcaaagacaaaatgacagccaaatcacaccagtaaataagtggagtgaagacacgtctgttttcacagctgaacactggaaattgcaaatttgattgccactggcattggatgctggaactgcttctgtttttactgacactagcataccgggatacttcgaagttgctgtagtctctgcaatattgagtgttggaaggtgctagaaaatgagtgtctgtcttttttgtcttttatactggaaggcaatcacctagacctatgctggagagtcatcctacaaggtca

SEQ ID NO: 10673 - DNA, 429 bp, Homo sapiens
  misc_feature 341: n=a, g, c or t
atttttatacaggaaggagagaaatattgttcatgtaatgtgttacctttttttgtctgtgtgatctacaagagcatggctgaaatgttaccatttttaactagtgttttgactgaagattattatgaaaagttttacttttgttagattcctaattaaaaatgcctatactcttttataggagtttcaacttttgcaatttggtaataacagatttaggtaagtaaaaaatgagaatctcatacagttctgaagatctaagtttggttgagaatttaatgtttcatcaccagtaaattcaattaaagacttttgattcaattaaagactcagttctgccnacacctgcaagaactgagttgatctgtacatcaacatttctgatgtttctttggtagttgctgctggagtcagaagttaggaacaaat

SEQ ID NO: 10674 - DNA, 531 bp, Homo sapiens
atgtaaaaaagatgaacaaacaaaaagaaaagataatattgcaaaacaccgtattgtgcttatacccaaagaagttaaaattaaatttataatcaattattttattgcataaagttaatcacaatttggaaggccattgtttctaagttttctgtaaattttactttactcacaatatgtagggtcctggtttaggcctggtagaagagctaaatgacattatgcatttcttctaaaagctcatgaacctagacatgtcctaaaattatagggcaatatatgattgatgctaaatgtgagttaacagtcaataagtagtatatggatgagtagttcagaatgaggaaaaatcttaagggctaaagtgatgagaaatttttgatgaaagatgaggaatattgggagagaggtacaagattataaaakagaaaaggtgggttattatttctttaggaagaaagatgtggaaagatgcagaggcatgtgcagaagcagcaagatcagtgtgtaggtatctgtgcagaggactgg

SEQ ID NO: 10675 - DNA, 233 bp, Homo sapiens
atgttaataacatgaatattctatacaaaccctcactgtgcctgccctaagtaaggcccattctgagggaaaccagatgtccaaacttaatctgtctgtggacccatcatgatcagcattttataggagagcaaattcctgggtgccagatctgaggttgcattaaacaaattgtgatatgcaaaaaaaaaaaaaaaaaaaaaaaaaaaaaaaaaaaaaaaaaaaaaaaaaaa

SEQ ID NO: 10676 - DNA, 410 bp, Homo sapiens
  misc_feature 98,150,407: n=a, g, c or t
aaccgatatcgcgatactgcactccagcctgggcgacagagcgagactccctctcaaaaaaaaaaaaaaaaykkttagawtgcstwttagstgswtgnggggaaacagtaaccagaaagtagaggactggacaacatctggaccaagggntcaaaattaacatcaataagtcctagaatcaggcgtttctttaagaggccctacttcctctaattggataattctagaaaccggtatttgaatctgaggtttamctaaagagaataccttctactgatgtaacagcaatggtaattggtataaaggcaaaagcatgtgcaaaggagaaatcacaccaagggccactcaaagtttaaatattaaattagttgtcaaatttttgcaatattaaaagattttacctccanaga

SEQ ID NO: 10677 - DNA, 497 bp, Homo sapiens
  misc_feature 43,76,377: n=a, g, c or t
agacaaaaaaacagcagatggtttctggatggtgtttcctggnctgtcaaggggtggtggtgaggcaggagaatanggtcgggaggsgttagggctttttcatgctgacttcctagaactaaattgaaaggaaaaccctaactttccacacctaagtaacaaaggaccagaggctgctccctttgcaaacccccccttttttttgaggcagatgggaaattgaaagtacctctgattgcaagtagagtcttggtttgcaaagaaacgcaactttgtaacttcactttagcctctgattggttgcagaagtgaagttacaaaggttgctttccacaaccaatcagactgatggcaggccaccacttcatttacaccangcgagcaccaagtggccaatgggaaacctcctgggggtatctggacctgagaagattctgtcactaggccttgagactctgctcagccggctcccacactgtgagtgcactttcattttc

SEQ ID NO: 10678 - DNA, 402 bp, Homo sapiens
acttttcatttcagcagttatagtttgtttcaatagcaacagttatttccagttttagttttgacagcattcctagaactagctccttagggttttttaaagacaccaacgccaaccagcaagcgccccctactgagcggtctaggtcccagctctgagaagccactcaagtttctaactgagccccagaaaacctttcagcaaacaaacatgatggtttcatataccagttggcatgaagataaagtgttggtgctgcattttaaaggggaagtttgagaaatatgaggaacgaagtcatgagtagaagccagggaggcatgaaagaaaaagtcttgtggcacccacaccgagaagatgctaagcagagatgtgaggaaacaaagctgagaattgagggac

SEQ ID NO: 10679 - DNA, 351 bp, Homo sapiens
agtgatgccatcaggtgtggtatgtaatcacaggcaactcaggaacagctctccagccccaggacttctgctggaaccgctgggagttggaagctttcttcccactgaggggcaaaccttctaggtatctgaagatgttgaagaccatttcctggaacagcagagagagactgtggaatggactgactctccagagctgcagattgaagatctcaatggcgggaacaccttcatggcccctttatagctggtatgttttcttcttatggacaatgagaaacatgtaataaactgtgtttccttctcgctaggaaaccctgagttaaagctttaaaaaaaaaaaaaaaaaaa

SEQ ID NO: 10680 - DNA, 298 bp, Homo sapiens
  misc_feature 243,274: n=a, g, c or t
cttctctgcagacaccagcctggtgtcctccttcatcccaggctgccaggctaggcaggggacagcggctgccctggtcctcacagccctggctacggggctggtgacasagatcctcatgcttctgcgacctgagcgctgccttcagacacctctctgctggcgtgttcctgggtccatgatggaagaaggaaaagtatttttaaaagacaatctgaagctcatactgtgactgcaacatanaatgtgttcacctgaggagactgcttggganatacagtctctgcttgggcgatca

SEQ ID NO: 10681 - DNA, 413 bp, Homo sapiens
  misc_feature 359,370,404: n=a, g, c or t
aaaaacatgctgaagsataatcttactctcctgtaacttacaatctaattgtagagttgatgtaagagttgtgtttaatgccatttctacattgtgtgtgtgcttgcctgtttataattgtcatttattaaaatctgctatcgttgcaagttttagacggattctgtaaagatgggataacatgggagaatctacaaaattagaataagattgaggaacacagggttctttcttgttcctttctgatccctgtggctgctggtgcattttaagccagcaagcagactttactttcctctcttccctgaaggacattaatgaccttcccataacagcccagctaatttctgtgagtaggntattttggaantgagtattgaatgtttttatctgttagtgtgacnttttttttt

SEQ ID NO: 10682 - DNA, 410 bp, Homo sapiens
agttttctgataatcttcagtaatttaaaatcttctggaggtaattataaggaacatcatttcaaaggatacggggaaaagagatgtcacatgaacacgtcttagaatttacactgtaaatcaaacaatgttgctgcaaaggcatgtaagttaatatagaaacaatggaagaatgtaaagaaaactcagagacagggaagaaagccaggataggctccaagatcagctggatgagatcacaacatgtgaccctcacagatgatagatcaagaaaatgggaagagcttcaaagccctgaaaccatataaaggagagtcacccaacaactaaaagcacccatcctaaactattgtgtgaacagaaacaaacctctattaatatatttgaattattaaatattttgagtctaa

SEQ ID NO: 10683 - DNA, 487 bp, Homo sapiens
  misc_feature 105,337: n=a, g, c or t
aaagatgccactgtagggacagggatgacctctagcaaggtgaccctcagtgggccagagggggcttctgaagagaatttctctagcttcttggtgtttcctgcntgctactttcaaacaagggtcccatttttaatgttttcccagtaataccttatgaatgttattgcaaagcgggctaaatcaacaccacaggccccgtgatcaatatatgtgatgaggacattacatcctggtgttgttgccccaagtcttgacgtgaatctgaccacaaggacaattcggacaacctgaaatggtgacgcattctacaaaataaacatcaatgtcatgaaanacaaagactcaagattttctgcttaatggagactaaagagatgcgacaacagaatgccaggcatgatcttggatattcttttggctcaaacagtcttaggacaattgaawaaacgtgaatgaggtctgtagctaatagaattgtgtcaat

SEQ ID NO: 10684 - DNA, 546 bp, Homo sapiens
  misc_feature 42..43,536: n=a, g, c or t
agattaaagggattcatgctggggtcaggcttttggagctanntcacaataacatttgggtttggatgactgcatttcaaagggtttcaagttagaatcttgatttcatacagagtaacagagaataaagagtatgtaatgcttattttttgtaaaaaaaaaaagagagagaagaaaaagaaaaaggcaaatatggccaaatgttaacatctgttaaatctggatgggccctggagccagactgtctggggtttgaaatcagctcctccacctaccagctattgacctcagcctaaagagacccttggagccagaaaaaaagagcaaagttatctgatgacagagggagcatacaagcagaagctcaggctatcactcaagagtttgagtgtactttgggcaacagctgggtgtattttaatatttatcaatttttattaaggatacagcttgggctttataaagacatggccatgttttaagttractcatctaagtttcctattctcagtgttttagaaatgtcagttgttcanataatactac

SEQ ID NO: 10685 - DNA, 501 bp, Homo sapiens
ataacatcccaaagtgtatctgctggtgccccagctaaagccacttctgctgttttctgabctctaaatgcaattttagagggtctttttataataatttattgtgcctccctttctagaaagtgaaagtgtggccctttaaatatatcttttattttaaaaatgtttttaaggaatcagaaaagtaaacataggttgacacctccctgtcttacaagggttgtcatgtcagggaaacatggaaaggaagggaggtgaaaagagacaataggaaaaccgtagctgtgacggaaaaaaatgaaacagatgagtgagaagaaaagtccaagagccaggatgacggcgcagtgatggctcactttgcgttgctgttccgtccactgttccactgactgtgaactctgtcagagtagggagatttttttgaaactcataaactttcaagaacatgagaggagaacagcagcacagtctgggagtctgagcaacagatggacgagt

SEQ ID NO: 10686 - DNA, 293 bp, Homo sapiens
atattgagtagatgtcttggactcacccagtaactcagggctgtggaatgaaggtaaatgtaaaaaacaagcgggagtcacagatacattgtctgggaaagtcaaacttagtagctttgtgagtcctgttgtaatgctttcagacacatttatagatcaaggggccaaagttacattttttaccgattagattcctgatcatttaggggttgccaagattctgctacccactgtagttaataaagagaaaacttgtctctaaaaaaaaaaaaaaaaaaaaaaaaaaaaaaaar

SEQ ID NO: 10687 - DNA, 477 bp, Homo sapiens
  misc_feature 315: n=a, g, c or t
agaccaaaaggaaaaaatgacagtcacctgacagtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctanaaaaaactcagaggttacttgaaaaattagatattcggtgcagttatattcatgtgaamagatttttaagttaggaaagcacaccaaatgtcattagaaggttttacaagatacatggattcacgtgaatgtctactgtttaaaaatgaatgtagaaagttt

SEQ ID NO: 10688 - DNA, 447 bp, Homo sapiens
  misc_feature 303: n=a, g, c or t
caccacaacaatttaattagttacagtttgttttcttttctgtactgtttgtttttcttttcctttctaatttaaaagagtgtgtttaaccctccatcttagacaatgtgatagtcatgaagtctttgtgtaagaaaagaagaagaaaagataatctgtaatgaagatcaataggggtcttctctggtgcccttcagttaactactgtcttttacaaaacaacgtaggtaaggaaaaaagttaatctataacagagaaataaaaatcacattggcctaggtgacagctgcctgcttatgttgnctcaggtaccataatcacattcccttaaggctcagatattttaaagttccaacagcttagattttaagtgacctatttttacagaggaaggattctgagcatattctaaggcaatgacatttaagtggactttcagcctagttc

SEQ ID NO: 10689 - DNA, 84 bp, Homo sapiens
gactatggaacgtcaggtgctgctgagcgagcccgaggaggcggsgmctctgtatcggggccttagccgccagcccgcgctgag

SEQ ID NO: 10690 - DNA, 67 bp, Homo sapiens
gaggaaccttaccggtaccggccgcgcgctggtagtcgccggtgtggctgcacctcaccaatcccgt

SEQ ID NO: 10691 - DNA, 429 bp, Homo sapiens
aaaaagttctgagggaaggagagacagagaaggggagaaaactctcaaccaggaagtctatatccagccgacttcaaaaataaaagagaaattgagacattcctaggtaaaaacaaaatgtttgttggtagcatgcttaacctgcaagaaacactaaaagaagtccatcaggctgatgtgaaaggacactaaacagtaactcaagttcatgtgaaaaatgaagagcatcagtacagtactgaattatttggtttgtaattcttttactcctatctgatttaaaagaaaaacatataaagcaataattctgtgttgatgggcacataatgtgtgaagatacaacttgtacaataataatagcacacaggaggggagagagaatgaaagtttttgtatactacttgtgatggttaattttatgtgtcactg

SEQ ID NO: 10692 - DNA, 356 bp, Homo sapiens
  misc_feature 283,307: n=a, g, c or t
actactttgttgttcttcacaattagttggagctttctttggtcaacagcagatgtgactaagaaaatcacgctgtttcacttagagcagtggtcaccaagtgtggtccttaggccacacaggtcagcatcacctaggaactaggaaatgcaagttcttaagcaatcccacccagacctactgaattggaagtgctgaggatggggtccagcaatctgtggttgaacaagctctgcaggcatccaggagcagagctgtggggcagcagaatctgtgatgacanakaatgatgatgtatttttgccancagatgcttttgctcctgttttgataccccaatattcggattcmgaaaa

SEQ ID NO: 10693 - DNA, 361 bp, Homo sapiens
  misc_feature 346: n=a, g, c or t
attcttcggtttgcctcctcccagtggcgtggatttgctcccgacccgcttttggggcgtgcctgcttcctcctctctgttagatctcgctctgtcacccaggctggagtgaaatggcacaatcttggctcactgtaacctccgcccccaggttcgactgattctcgtgcctcagcctcctcagtagctgggattacaggatggagagtaaaggaggtaaaggaggactctgatgcctcagccatgcgcctgtgtgccgattcccattaagcctgcaccaatttgatttccaagactccagtcaatcctcagagctccaagatgggagggcagcttttcctggtanctgctgatcaccagc

SEQ ID NO: 10694 - DNA, 271 bp, Homo sapiens
atattgagtagatgtcttggactcacccrgtaactcagggctgtggaatgaaggtaaatgtaaaawacaagcgtgagtcacagwtacattgtctgggaaagtcaaacttagtagctttgtgagtcctgttggtaatgctttcaggacwcatttatagatcaaaggggccaaagttacattttttaccgattagattcctgatcatttaggggttgccaagattctgctacccactgtagttaataaagagaaaacttgtctctaaaaaaaa

SEQ ID NO: 10695 - DNA, 270 bp, Homo sapiens
  misc_feature 192: n=a, g, c or t
gagaatttacaccatggaaactggcaaacgctgcaaacactgcctcccaccatcacagacagccagttattaagcatttatcagcacattatgttgccagggactgtgctcagagttattggggggagaggcagtagcagtgttatgtagtcaagcttataactgataaactgtagtcatttggaaaaacanaagcaacgcagaggagatgggagtgaaccaagaacatagtaaccaccctgaacctcctcaacaaaccccakaggacat

SEQ ID NO: 10696 - DNA, 521 bp, Homo sapiens
aaagagcagggaaataaaggagaagagaacagaattattaccatgaatttttggaagacagacagaaggtgagaaaaagtatatgagggccttgtaattgcatgtcctcaactttttatctcagttcatcagggactgatggcactccatttggaactaagggaaaataacacgttgaaataggcagaaagaaatacttgttcaggttggttaacgaaagtgagccacaaacagcttatttgttcagttttctttgactctgagaccatagtgggaatcagataatggaagtcaacaactctgtgtcatagaatttcctggaggactgacaattacattcaggaaaaaagcaaaaacctttagtataagcaccctcagcaacaaggcaacctgaacttctaagcatagagtggaaatcaaggaagatggagatcctgaaagtttacagtgaaaaaatagtaaatgtatattaatggttcagaatctcattgtaactatttttactatgtgtatttagggtg

SEQ ID NO: 10697 - DNA, 344 bp, Homo sapiens
tatatttgagtccctgcttttaatttttctgggtatatacctaaagttggaattgttggatcctatggtaattctatgtttaactttttgaggaactgccaaactgttttctgttgtagccacaccattttatattcctaccagcaatgtaccagggttccaatttctccacatcctagccagcatttgctgttttccatttttggtaatggccattctaatgggtgtgaagtggtatctcattgacttgcatttctcttaatggctagtgatattgagcatctgttcgtgtgtttgttggctatttgtacatcttcttcaaagaaatgtttactcaggtaaaa

SEQ ID NO: 10698 - DNA, 379 bp, Homo sapiens
  misc_feature 319: n=a, g, c or t
atcatacacctgggagggcacagcatggggactcagggatgcaagccaggtgccaggtgctgcagcctcagagcaacaatgtttgataaataggagcttaacagccatcttggagctcaaacataagaaggaaagaggcagagtcagcgtcctcatcccccgctactttgtgggagtggtttattatagagagagtgggagaaggaaaaccaggcacggcaactgcaaacatgctaaatgatttccaagtccaaatagagaagaaaacagatagggagctgatgcatttataccgactgacatgtaaaccacaggacanggaccactgttcctaaaacctggctgtctagagcctcrttttgctcattctsarataagg

SEQ ID NO: 10699 - DNA, 419 bp, Homo sapiens
  misc_feature 411: n=a, g, c or t
aatcatcacaggcaggctctcagggagagctctgtatcccagggcactgcactctgagcccactcaatgacttgtatgggcacattatgcccaaaggtgtctctaaaccctcaaaacctcatgcagaacaagctagggtaatacagatctcaactgcagtccattcagagggagaaaatatgaaaatggaaaactgggtctgtcctgagaatgtttactatgcaaaagaaagtgcaagccaggaagagacaggtggtgaagaataaagagcgctatggtggaaaatgagcttgagaatgtaaaacccgccattagaggaatgaaaatgagtggggcttctctggaacggcagtaagcatttggatgacagtaatgatggatctgtttcagttgagttcctacatggtcatntcaatgac

SEQ ID NO: 10700 - DNA, 470 bp, Homo sapiens
atatgcagtagagactaaataaatatttaattgaacttattaaaaataattcagtcattatgttttaaggagaaagtggacaagtatggaggctttgaagcataaattgtgatttttaaatttttatttatttttctaacgtttgaagtcttctatgtgacagtttgattctttggtttttttattatttccatttttcccccatccaggaaaatgcttgtgcacgatgtgtgctgaaatcttgcatttgttgcctttggtgtcttgaaaagtgcctaaattatttaaatcaggtaaaatattttaaaaataaatctaatatttactttcaaagataggttcattgtttcttctcccaagataaacttaattgaaagatgttatgtttttcttgtggtattgtacattgtgccttgataaagtatgtctatttcaatcatattcttattttttaaattaatgtatatgct

SEQ ID NO: 10701 - DNA, 288 bp, Homo sapiens
tttctaggccgacaagtccagtcaacagcagtctgccatwkgctggggaagaaaatggagaaatgttggtcaaaggttaaaaaccwwkttgtaaggtgaacacgttctggagatttaatgtacagcatgggtggtcatcaatgtgttaattttkactgtkgtaaccattacagaatgtatatatatacatcaaaacataactgtacatcatgaacatatacaatctttgtgaagtattttaaaataaaaaaggaatgtttaccaaaaaaaaaaaaaawtgcgaaaasc

SEQ ID NO: 10702 - DNA, 299 bp, Homo sapiens
aaattaagccaaaaggtcttaagtgagtrtttctcagcrrcatcgagccatagcaccttacgccagakgggcagcccggttctccaaacccattgcaaagttccctaccacacaggcaagctatgcggggtcctaaagagacagaaaccgcacaggaatagatgctgcccaggaggctgagggctgggccaggttcaaggggtggagcctgtggcagtggttggtggaagaaccagccgctctttgaccatgtcaaagtcttcatcacaaattaaattaatctgatcccttaaaaaaaa

SEQ ID NO: 10703 - DNA, 470 bp, Homo sapiens
accaagtttgtgtaagcataaagatatcagcacataagaagaacattcatgaagagaccttaaaagcagatgcttggtgtaaaaktactcatgccaagakattctctaataatgagcaatgcatcacctatctcaaaagaggctccccaaaccctcggatttattaggactaactggccggtctcttactctccagacaaagtacttacactttcttcgctgacagcattctctcttattaatttatacccatatggaccgaaaaagctttcacttatgacataatatagaatttgcatctatctctacagtaacatgacccattttccccccttcattatgccatagatttctactttttctctctcaagtagcaaaacaactatttctaatgatggattaaaaacctgaagctgctattccattatgaacctctatctagtagctactgcaaactgctcagctccttt

SEQ ID NO: 10704 - DNA, 85 bp, Homo sapiens
cagaaagggctgtgtatagtagggccctgttctccttaggatgttgcttcttgattttttttttttttaggggtgggtsagggtt

SEQ ID NO: 10705 - DNA, 540 bp, Homo sapiens
  misc_feature 517: n=a, g, c or t
agcccgccagcctggaattgctcttaggccagggcagattagccacctccacaccctttccaaaccaagtggcagcctgagccccagttctccttcaattacctgatcaaggaatctcaactcccagtgtgagtttttcccaccacagcgtgaatccaggttgttcctgcaatgttatgcaatgtgagtggagctttctaacaataagagcaccatctatggtctggctgtctgctgagcagcctcatctgtcaaaggagcagaaaattccaaagcatgatcctatgaatcaaacctgacacccacagacacaggagctccctcctccccaaccgccaaaccctcaagcttccacagagatctgagcctctctgggttgaggaagagagggactgttctcccgtattaatcagatcccattaatttttcaaagtagacaacagcccacttactcatctgctgtggagcctcatccataattgatcctgaactgcacttaccctaacagaccgcgcanatgccggctgcacatagagctct

SEQ ID NO: 10706 - DNA, 420 bp, Homo sapiens
  misc_feature 132,322: n=a, g, c or t
ataacaaattgctactgtttaaatgcagccctgccaagagtgctccagagtcttctgcaagccacagccagagtgattgccagagaatcagagagcatcctaggtggatttagacacataggctggccacancaagcctgccagcttgactccccagccccactctattgatcagcatggggagacttgatttttataggcttttatttgaccttgaaaagttaagttacagaaagactagcaggctcatgccaaccctgaaatgttttcctttttagtcaaaaggcaatgcccacaaaggcttttattcaggcagttgaanggcacaagtgaaggagaaaattgttkttgaaagaccgctgggactctttgaaacctagttactttggaagtattcgtggggccagtatagcattagga

SEQ ID NO: 10707 - DNA, 304 bp, Homo sapiens
gatgagatcattggagtgggccctaaagcaacaaaactggtgtccttataggaagagggaaatgccatgtggacacaaacacgaggagaagacgactatgcgtgatggaggcagagactggagtgatgcatccacagccaaagaaggccaaagactgccagcaaaacaccagaagctagaagagtaaaggaaagcttctcactacatgttttagagggagcatggcctatgacaccttgactttggacttctagcctccagaactatagacaataaactgttgttttaggccaaaaaaaaaaaa

SEQ ID NO: 10708 - DNA, 499 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagattttgtcaccacca

SEQ ID NO: 10709 - DNA, 418 bp, Homo sapiens
tggatgccccggtgtgaccgccgggggsgcccggggcckycggcgcacctccacacccgccccaacgcgttctctggagctttgggcctcagggcgcctagaaggcagggacgcagacctgaaggcggccggtgagcggggcgggttctgctgggtcgggaagaaaaataattctgcaaggtattttgttttttattaattcgcgcttggccacctcatctgtaaagagattctaaaagcaagatctggaaaagtgcttcgtagactccttgacggagtttgcctcctttgtacgctgcgtgaacatgcctcacctttaagagagtcttaaaggtaaagacacgaaaacacttcctccagggaccttcccgaaaacgttctggctctcatctggtgcggcatgtgtccactttgcctt

SEQ ID NO: 10710 - DNA, 194 bp, Homo sapiens
attatcacaggttgtctcaagcacaaccaactgaatgtctcttaactgtggggaccaaaagggagagagcctggggtctacaagaggagacacatcatcaaatgtttgaatgatcacaaattaagacattatcagcccagtaaatttcttgcttaatgtttttccaagttctggcttgaatatttcttattaaa

SEQ ID NO: 10711 - DNA, 474 bp, Homo sapiens
attgagcgcctagcatgtatgaaacacctcgctaaggactcaggataaaagagtacttctccttgaggaggacacagtctgatggggaaacaggagtgtacacagatgtttcttcatgatcttgtggaaagtcttctttgagtatggcatttcaactgaagatgatgaccttccgtgaagcaactgtacaattgcaaagaagaaaatgaaaactcctgtgatgatattagaagacatggaaagagcattttcagtgtcctataagaagatcttccagtgatattgaaaatcaaatcatgagtgatattgtggccagcatatctaaattaaaaaatattttaatgaagtccataagaggataatataagatggaaatgtggaaatacagaaagaaataaagagaaacagaaatacgaaaaacctactacttattttggagaattctgtcaaagggaaacaaactaccaggttcca

SEQ ID NO: 10712 - DNA, 486 bp, Homo sapiens
  misc_feature 95,173: n=a, g, c or t
gagaaaagaaattatgaataagcctcgttatgttcaataattagcagctacatggaaaaaaacaaaaccatgaatttaggttgatgcatttatsncagtgtttgaatacaactctgagtgtgttattgctttaaaatgagattctaacaaactgccaaaaacttcttgactancagttgttactcagtgctataatttaaaaattcatcctgtccatctcttttttctcctatttatattcttccccagcagaagattggtaactaatgggtaatacacaacattccaagatagattctggtatcttgagccaacatatcaggagaatggtacagaaaaactgaacattaccagcccctctaccttagctaactgcaaaatgaacaacttccaaggacttgctgctactctcccacaaaatgaaaagtctatgtatcaagatgtagaatagtacagctaagcacaaggctcctccccagtcaaaga

SEQ ID NO: 10713 - DNA, 58 bp, Homo sapiens
accacagcctccacctcccggcttcaagtgaatctcctgcctcagcctcccaagtagc

SEQ ID NO: 10714 - DNA, 468 bp, Homo sapiens
  misc_feature 413: n=a, g, c or t
gcgaatcaaactgttgctgtttgctgatgatgtaatcatatacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccacagattcaatgcaattcccaccanaacaccaccatcattcttcacagaactagaaaaaacaatcctaaaattcatgtgg

SEQ ID NO: 10715 - DNA, 59 bp, Homo sapiens
aaagactgcagagtctttcgttctttctggtgcagcttaactgatttgaagaagccgaa

SEQ ID NO: 10716 - DNA, 433 bp, Homo sapiens
agtactggccatgtctgtactgtgaagcactgtgctggaggatgtagaaaaatataagggagaagatgaaatttccaatcaacttcacagtactgttttaaagagacagaatgaccaggcctcttctgatacaggctcccactatatgcctctgcagatgtaggacaggctgtaccaagagttggttttctctcaggaaaaatggattgggataatccagcacagctataattttgttactatttttattgtacctcaatgtgatttgaagtatgaagggcagcgaatttgaatcgtgggattaccagcttgatccagaagtcctaaccattgtcttacaggtgcctggaaaatgctgatatatagatggggcaaatacccaacaggctgatgtcaggtgatggatgcactgtgatgtggacttaaagtgggc

SEQ ID NO: 10717 - DNA, 396 bp, Homo sapiens
gactggtcaaggcagtgcaagaagtttaacctgtctggaaatatggggacaagaactggaaagggcagtctgtgcatgaagattccaggagaagcctgatgatggaaaaccttaaaatcacatcgagtacagatggggtttcaccatgttcgccaggatggtctcgatctcctgacctcgtgatctgtccacctctgcctcccaaagtgctgggattacaggtgtgagccaccactcccagcctttgtcatcatttcagatagggtgaaggaatggtttaagtcgcctccaaggtatcttgttgggggtgaggggtacagaggggtcttactgaatggtgatgaaaaaggttacacaagcgaaaaatcaacatttgagaaaagataactaaaccct

SEQ ID NO: 10718 - DNA, 443 bp, Homo sapiens
  misc_feature 405: n=a, g, c or t
aagttctcactcttttgtaatgtgtggtcctcacttggcctctgggacacctccaagtcttagttgtcttcctaactcactagttgctccttctcactctcctttgctggttcttccttttctccttgacctcttaatgttagagtcccagagtgtagtsatagtccttctctgtgatctatttttaccctgtctttgtgatctagtataatggccaccacctataaacttatagctcacgaatttatatcactagctctgagatctctcacgaactccagatgtgcacatctgactgcttactcaacatctcgaatgcctgttcttcaagagtttgagtcatgaagtgtgaagcctagagatggtgtgatacacagagatgaaactggttttcacaggtgatanatggaaggctgttttcaaaagatcaagctttgaccaca

SEQ ID NO: 10719 - DNA, 65 bp, Homo sapiens
cttsartaattaagtctccagctactcttttggctawtacatctttggtttctgcsattttcccc

SEQ ID NO: 10720 - DNA, 421 bp, Homo sapiens
  misc_feature 402: n=a, g, c or t
attttctcgcagcttcaccatggtatctatcttgtattccagctgcagacctccacattcctcagataagtctttccttttttgtactcctttatatgtcagtgtgttcctccttttgtctgggctgtcatttcccttacccacatagagaactccttcctttcaagaatcaactcctgtgtcacctactttgccagtacgatctgttcctctctctctctcgctccaaaagactaatctgcacactctgttacagcacttgtctaattgtgctgtagcgtttatttacatgtttgtttctcctctagccagtgagcacctctcaagcagaattatcttccttgtttctctggcaccctaaatatttgttgaattaatagtccttctcttcttttgtaattntgctttctgtaatagaagc

SEQ ID NO: 10721 - DNA, 500 bp, Homo sapiens
atcagctgtgggcctagagccaggggtccctctcactcctacatatacttccgtgcctacaaaatgaagggattgaaccagatgacctgacactctttgtttcctaaaacagttttggaaacctttcctaaatgctcgtgcacttaactttcttggttccttcagaggtgaataaatacagtggatgtttccctgtttccttgtggtcctcactacctgatggtgacttatgagacaagatgggtctgtttttaactgcccctaagtggggtgtgaaattttcacccacacccacctctccacaaaaacacacctctgagttctctacgtttacccctcactcgggaaatggaaattgctttgatttatcctgagcccaccttctgaaaaggctgctttttcctgttgtctaggattggtttgcaacctttccaagtcttttcatactgtatgagtggtgaatcttcgagttagaggtggtattacatacaggatttctc

SEQ ID NO: 10722 - DNA, 149 bp, Homo sapiens
tgcagtggcctctgtgagccccagcctgagccagtcccagctgtgcttggagtctttatttattttaactatttcttcaacattccacatttgatgatgatacctctttcttccctgagtgtatatgttctaatacaaatctttttgtt

SEQ ID NO: 10723 - DNA, 109 bp, Homo sapiens
agcaggttaccaaatgtagccaaagatcagactcccgtgcagaaakgkaaaagacattcatgacagatgctgcccgccgagagcaggagtccctaaagaagaagattca

SEQ ID NO: 10724 - DNA, 383 bp, Homo sapiens
  misc_feature 71,366: n=a, g, c or t
acgcggccccgstcggggaggtttccggcccggggccgactgcgggtggcatttctggctaagccgttasngaattatatggagatatatacacacacgtatctgaaaacattctgacgttttaaaaacggagcaccagaggagggggacttcatctgacttgttcagcactgtctcccaggccctggcacagagggagcactcgatacacaccgatgggctgaagaccctgagccgttgtcaaaacacagcttaatccccattccctgggcccgagaccctgcagcccccacgctgcccggcttccgtcttacctggggcaacctgaccaacaagaacgcggaakgccatgagccaaaaacaganactcctgatgggtaaca

SEQ ID NO: 10725 - DNA, 414 bp, Homo sapiens
atactaagttggcttaaaggtttagaaaagtagggtgtcttcgttcaagaatttggaatgtgaagctcccagtatcttcatgtgtcctcatttaagtcaccattagattcagcccaacaatgtggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcac

SEQ ID NO: 10726 - DNA, 485 bp, Homo sapiens
catctgcaaatagacaatttgacttcctctcttcctatttgaatcctctttatttctttctcttgcctgattgccctggccagaacttccaatactatgttgaataggagtggagagagagggcatccttgtcttgtgccagttttcaaagggaatgcttccagcttttgcccattcagtatgatattggctgtgggtttgtcataaatagctcttattattttgagatatgttccatcaatacctagtttattgagagtttttagcatgaagggctgttgaattttgttgaaggccttttctgcatctattgatataatcatgtggtattcaaccaaaaaaagctcaggatcagacagattcacagctgaattatattaaaggtacaaagaggagctggtaccattccttctgaaactattccaatcaatagaaaaagatgaacaccacctaactcattttatgaggccagcgtcatcctgata

SEQ ID NO: 10727 - DNA, 270 bp, Homo sapiens
atcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccagctggtctggaac

SEQ ID NO: 10728 - DNA, 492 bp, Homo sapiens
tctcgcctgccgccatgtaaacgttctttgctcctgcttcgtcttctgccgtgattgtgaggcctccccagccatgtggaactgtgagtccagtaaacctctttttctttataaattacccagtttcagatacgtctttattagcggcgtgagaatggactaatacactaactttctcagtgagcatcttattccagttataaaactacctctggttctgaagatacaaagataggataatgctaactatttctttgcataaggcavgtgaaaaaatacagatgacctgatatcttctatctgcctactctctctaccttttgaaagctctctttctgttgctttaatagcattgaattgatacgccattatwgtgtctattcctttcacaatacccttaaataaagtcttacttttaactttttccagttgccgttttggtttggctgaaccttagaaaaattaatagtttacagtaaattaggtggagat

SEQ ID NO: 10729 - DNA, 496 bp, Homo sapiens
actttaggtaaacaattttgtgataacatttatcccctgcccctctcccctgttgattttttctggatgaggaawkcaaggctgtgcagccacgtaactcgtgtaaggacacacaacagtgcttatgtctccatcttcaggtcaaaccactttatgaagggcctactacatgccaggcaccaggctaggtgctagggaattgaaaggacccttttcataaaaccatcatgagggtctttgtgatttagagctcttctactaaaagaaactatgcatttactcctgtcaacttctttatgatttatgtattaagattagtcataaaagaaaatacagactacagactgttgctctggttggtcctcaaattcatttagtggtgacagagcccctagaagttttagcattcttcctgtgacacctcaaaatgttaaaaaataagcttcgaatagctaatgtataattttgtaataagtcagactccttatataataga

SEQ ID NO: 10730 - DNA, 483 bp, Homo sapiens
  misc_feature 75: n=a, g, c or t
agaattattaactagtatgtggtagataggagtcaaatgataaatatccaaccaggaaggttactgtaacacaknagtgaatcaacagactatcctctcccagaaaagctctttgtgtgtctggcttcccacacctaatctggaaktacaaacagtctgtgctacgtgtgccggatttctgtggactgaggcagaaaaaccctaagcaagaagagaaaattgttttgtattcatttcagcaacaagagactgcagtgtcacagagtggtcccartgcagggacatctcatcagacgtcaccccatcgctgtgccctgcctttctctggttctttcccactgttcaagcactttgacactttgtggattatgctttcaggttctttcatcaatttaacattaaaagtcctgtgaaatattaatgaaataatgtttttaaaaaagaaaaatgttcctacaatactgcaacattttaatgcctcat

SEQ ID NO: 10731 - DNA, 269 bp, Homo sapiens
gagattggaggggtgggcaaatgggcatgtttttaacacgtaaaaaagcttggttttatcccaagaatgatgagcagtctgtaaagggcttaattacggcaggaaacaccatattattagtgttttaagaaggtgacactggctatttggttaggtggcatttgtattgtagtaggtaacagtgaatgtggattgcttggtttacagaactgaaaggcttggccactcaaaggccatctcaaagaccctatctatgaggaagaagaaaa

SEQ ID NO: 10732 - DNA, 168 bp, Homo sapiens
agtcaacakaatggagaaaagagaaatttggtttgaaatgaaatttgagtcttgagakagggctgatatkwaggagaatcaaacaagssacatgggagcatctgaaggcctggagataagggsstgttgcatggctgtgaaaatttggcctttaaaataactaggcat

SEQ ID NO: 10733 - DNA, 266 bp, Homo sapiens
aacttgtttttgggcaatctagccaaggtgtcacataatggagaaaaatgcagatggtcctgtggctggtgtgaatgaagaatgacctgggcccaacatagaacttttccagtatggtctctgcatgtggggagccaaactctagagaagacatcagtgaactgctgatttggagtgactgacacttattcctgagagtaggtgattcttcagtatccaaagaaatgtatcaagtttgtattagatggaatatagcttacttttgt

SEQ ID NO: 10734 - DNA, 472 bp, Homo sapiens
ctatcaagcagagcagggggaaagccctcaaagcagaaagagcaaagctgcatggtgtgaagactgcatgtgattcaggaaccgtgagcaatggtagactcgtgccaaagcacagtgtgtaaggaagacawggctggaaacgtatgctgaggtctgactgtgagagtttgaagccccactgagaggtctgcacgaattaagaatttcagagaaacatgattagttctacaattggaaaaataattctggtgctaagaactagtaaggtataagataagcctaatcacggaggatttgaagttgaaaagagtttataagttattctttaagaaatctctgttattgaggtgtgaggcagagcagtacataatgtctacgttctgaaccaactgaacggggaaacaaaaggctaacattaatatcagacatttgtagagcatttaccttgtgccaggcaacattctggatgctt

SEQ ID NO: 10735 - DNA, 88 bp, Homo sapiens
  misc_feature 88: n=a, g, c or t
aggctcgtggaggcgtccgarctccagggcagctctggggcagaactgtccggatctaacaatccctggggagccggagaccggtgan

SEQ ID NO: 10736 - DNA, 264 bp, Homo sapiens
aggtcgggtggcttctggggccttctgakgaacatgcacaagctgctacagctactggagctatgggaaaagtgttttagaatggagacctttcctctgcggttcacggtagatgagtgctttccgcgggcatcagagtatggcgactgaaaggcagtgcgcatgcgcccacacttccttctccagccttctctccgaaaaacccagtacagcctgggatttgggatttaacatttctaataaaaacttgcatttgttaaaaaa

SEQ ID NO: 10737 - DNA, 206 bp, Homo sapiens
attgagggagcccggaagccacgcgctgtcagtgacatctcgtgagcagactgtggtgagggtggcggtgtcccaaaggccttgctgttcctgtggtgctctggggccatgaaggccggcctggcaccccggtcgacgaccaagcgggtggtggggactactctttctacctggctgatgagccagccaccatcatccgccgtcca

SEQ ID NO: 10738 - DNA, 454 bp, Homo sapiens
tattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtg

SEQ ID NO: 10739 - DNA, 485 bp, Homo sapiens
  misc_feature 275: n=a, g, c or t
gagctctactcgggggggaaaggaggggagagcagagatgcagggtctgcctatcctgccaggcaggattgagaacaggtggaggatgctcgggatggtgttagcagcgtctgaccagcctcttgagaccatccggcagccctgagcttggttactggttgtcagggaattcgtgcatttattcaggaaacacgattataaccagccctgtgctgggcctggcaagacacacacagttcctgctctcagggagcctactgttgaggggaagaaanagacaacaaacaaggcaatggcaaaaatataaaggcaatggtgacagccacacaggaaaataatccagtgctctgctagaacaaggtttgggggggtgccagaaagtgtattaggctgggagctggggcccaggacagcattggtccggcatcactgcccccagaacttaaaaaacctctgctgagaggaggctgtaaaaccagccctgg

SEQ ID NO: 10740 - DNA, 381 bp, Homo sapiens
atkttaatktatcagccaacacctctcctgtgcacctatkgcagacatcattaatccatcaaggcactctcctgtttagcccagtccctkcttcagagctcttctcagtattgtgacccagacagcggctacccatcaaccagactgccacacaggacagaaatctagattattacataatccatcttgagaatttagaagaataatatcgccctcgtgcctggcttatatagaamaagggacagcaagaagacagataaagtggagcacagaaagaaggatgaaatgaaaattatttgtctattttagacaagcaattttctctaatgttctgttctcttgtttggttgttctagtgagagctcaaggaccttttaaggt

SEQ ID NO: 10741 - DNA, 415 bp, Homo sapiens
acacaggtcacgcgcgggcccccacaaacaagctattccagccacacagatgcaaacctcatagcaacacgagacagaagacacacacacgctctcgtgagtaggctcggaccgcgcaccggcagacgcacgcgaatacccataagcagccccagacacagaccgtcctacagctcccggtcggcacaggctggcctctatgaagcatgcagccgccctacctggttatcccggatacaagcaccaccgcctcgcacgtgctcgttcaccctgggaacacgggggccgcagctccacggacaggcaggaccggcccgcagtggcctctgggcaatgacttgagacaggggaaaggcgggaaacgctcggcgcgaagggctctgggcctcgtagttcggagggcgaggctgtgctc

SEQ ID NO: 10742 - DNA, 514 bp, Homo sapiens
aagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagtagatgaaacattaactctaactgtgacaaagaagaccacaaatagttatcttttaattacagaagagtttcttaacttacttttgtaagtttttattgtgtaagtttataatgcaggggaagtactactcctcaaatgttgagggaagcttccataacattgatgactggcttcatggcagtaattctcggctgtagttgcataagcattgctcaagaggaaaatccaaaagtgcagcaggagaactcttttccctgaaaaaggaaaaatattgaactcaatgatagcacctaaacttacatttaaagacagacattccttctacatgtaatgacacttcttgtgttaac

SEQ ID NO: 10743 - DNA, 475 bp, Homo sapiens
gaattagtcccctaaaagaagaggccagagaaccagctcaccctactttttccacttaagtaacacagtactctgtagaccaggaagaggatgttcaccaagaactcaatcctgctggaaacctgatctcagacttccagactccaaaactgtagtgcaaaattccacatccacaaaacccacctggccagtgatggcttgggtaaggacggagaatgcagtgggatcagaaccctagagtgggcatgaagaggagaaaaaacaaattctgaaatcaccatggaaacactacagaggtatcagcccacggacactgccgtcctacaatgtgacacaaaaaggaagaaatcattaaggctatagattacacaggctttaagacaaaatgacaaaaatcttttagaatataccattttctgtacaaaacatatgaaaagtcagtcatatgtccagataattaaagagaaaaaaacac

SEQ ID NO: 10744 - DNA, 481 bp, Homo sapiens
tagttatgtttaatgtcagtattctgtaccttaaatacattatatattcatgccttattttaaacagatctttgtataatatacataataggttatatattatactaatctgaggaataaaggtaagaatatttttgttagatggtagaaatttataaagcaagtagcaatgctgatgtttctgtacgatcaatatgcagcacaatctttgaagtgtgaagagttgtctctcttcattcatccttggttttgctgcctgcagccattattgtaatcaaatggtaactttattctctgtgctttctacttgagtcagactgtattttcttatacccccccatgcattccttctattcactgttgccatggtatcatcttgaaaatgtggtaaactaattatggggtcccccccttttatggtttatctttttttatttaaatactcacaagtttatatatttagtacattaaaacctatgac

SEQ ID NO: 10745 - DNA, 468 bp, Homo sapiens
  misc_feature 429,432: n=a, g, c or t
ataagactgtgtacagagcagcatactaaggctgcttctgcccaggtacagtggcacataggtgaaagtgtgaaactgttgctgcattttgtaacttcttaacaatctctggcagctcatttgaaatttaccaagtgccctttcccagatgttggtaaaaacattcctgctgatagataacagaagctatggaaaaatcagcacccagctgataggtgcagaggtatacaaagccctggagggctgttggmataacactactcaaaaattttctgaaggaggttgaagcaggtttaagggtttgagttttttgaaacaagtgccaaggacaacattaatgtcaagcagacatttgagcgccttgtggatatcatctgcgacaaaatgtcagagagtttggagactgatcctgccatcactgctgcaaanaanaccacgagactcaaggaaactcctcctccaccgcag

SEQ ID NO: 10746 - DNA, 478 bp, Homo sapiens
  misc_feature 162,298: n=a, g, c or t
agttaggccactggaagcatggcaaaatattgaaaatgagggattaggtgacagtgtagtaactgctgaatactaaatacttgatccaggccccattccctggagattgacagggagacacattgtccaggtagtagtggagaaatgttttctgggtatctnabcagcctttgtggaargavctggcaccatcctgcagatgtaaccscctgaygggttcttcctgaccaatgtacacaaaaactcaattcatggagaccatggcactgcaggaaacggtttcattgacacakgccanccacgacatgtgggagacagagttattactcaaagcaatctcactgaaggcttggaggtaacaactaatgttggaattatgaaaagctcttctctacttttaacaaagcttagtcacaaacagttccccagttgatgagaaaaactaaaacaacagaacaattgaaagtccgaatctgca

SEQ ID NO: 10747 - DNA, 468 bp, Homo sapiens
gtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcakggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggat

SEQ ID NO: 10748 - DNA, 277 bp, Homo sapiens
tttaaatggtgaacgttgagctctacccaaagataaatactctgcttttcttttagtcatttttaaactattcttgttattatcatagactttgaagattttcctatgtatttttacccccattttttaaggatttcttgtttcagtgttctctaggtaatggtattcaccccaaattttcatcctttaaagcagttgttcttagtgggctgtcacgagaagattgagttccattatgcgaaawgggtatcgttacacctaacagacaagaaattct

SEQ ID NO: 10749 - DNA, 475 bp, Homo sapiens
aggacgattccctgagccttgacaaagcaggakccctccgtggcggtgcgtcggtgtcgaggctccagtctgactaatccagggggtcgacaaaacagattcgggacactatgctacacggagggcctaccaggatgcagaaacagcagacggagccagggaaagcagtgcgcatcccagcctcaggcctgcccgtacggtgttcggacggaatgaagttgataatagtgagaccttgttggtacaagactatgtaacataacctgcgcttctcaacaaagaattgcttttctgacttctgcactcaactactcaacatgaaggcaataagaatgaagacctctatgtataattgacttccacttaataaatagcacctcctacgaaccaggatctgtacttgctgtcccagttataaagtaaaacagcctgtccttcctgcactcaaggagacagctccataagcggggagctt

SEQ ID NO: 10750 - DNA, 150 bp, Homo sapiens
agaaagtcaaataacctaggccctgcaacattgcacccaggaatggattactgtctatcctacttccccaaaagagaattaacagcatagaaattatgcctaaaagccaggtatttatataccaggtttctcttactgataactctggat

SEQ ID NO: 10751 - DNA, 375 bp, Homo sapiens
acaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcatcatccttctaacaaacagtgtacactcccatagc

SEQ ID NO: 10752 - DNA, 305 bp, Homo sapiens
aaaatgattcctagttcagactgttcaggtttcagacacatactctactatattgagtataaagttgcttttagactggagctttagtcaactatggatttttttttccctcaatattctctcctctctagttcttcttcattcatgtgtttgaaaatatcttctgatttacttttaatgatctgtatcatttatcttcagtttttttttaaattgtctcacttaggtattaccattcacttaggtctgcgccacataaccattctgaagcttttaggcgttggagaggaagttgggggagtgtt

SEQ ID NO: 10753 - DNA, 360 bp, Homo sapiens
atcatcactaggtccttcagaatactttctttttttttcctgagatgcagtcttgctctgtcactaggctagagtgcagtggtgcaatctcggctcactgcaacctccgcctcctgggttcaagcgattctcctacctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggca

SEQ ID NO: 10754 - DNA, 455 bp, Homo sapiens
aaccaaaggtttgacctctaacagctagacatgggtgaaattggataccaagcttaatggggcatgcagcttgatgtttgcagaggagacagtctagcatttcccagtctgatatggaacatcaaagattgctaggatttctcagtactcagacattcctcattttgtctgaagtggtttacaggaaatctgtcattttttattaaaatggaaaactgtgaagaaagaaaaagatagcagttgaagtcaaaattctcggatgactattttgcttttgaggagtcagcatttaaaaacgatatgctgatttggaaggtcctgggagtaaactgcaaactttattttttccattcaatcaatggattttttaatcattccttggagtcgatgaagttcggaaacggtgtgtgatggggaacgtggcgggccaaatgtgttcctagaaattgcatctt

SEQ ID NO: 10755 - DNA, 318 bp, Homo sapiens
  misc_feature 193,253: n=a, g, c or t
aggattgtgaggccgcattctgtccccggtgagacctggctctgtccagttcctcccgggcctcccaacgcccccgatggctccttcctcctggccatctgtccggtccctccttcatgtcggtcgctggcccaccggtgactgcttggcttctgctggagtttaagggggctttccgctgccccgtactgangcatccccgcatcattcctgggcgtgtccccaagaacagccatggcctccacagtgcaanctgaagggatacccacccaccatcccagggtctacaacatccacagccggaccgtcacccgctat

SEQ ID NO: 10756 - DNA, 376 bp, Homo sapiens
  misc_feature 326,363: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccangctgttctcgaactcctgagctcgggtgatccaactntctcggcctccca

SEQ ID NO: 10757 - DNA, 271 bp, Homo sapiens
gtttctggttgatgaacctaggtagtaaggacactgaaaagcatgtgcaagacccagaggtttatttcaagaatttcctggctctgaaaatccctccgtgagtttcccctatggctgcttcattacgtcctaactcaagggaaggtctcgggcctttctttggcatgagccctgagctgaatttctgaagcaaaggccctgcgccttcaatcctaataaacgactagtccgcagaatcggacttggggatcctggaaaaaaaaaaaaaaaa

SEQ ID NO: 10758 - DNA, 449 bp, Homo sapiens
cccaccgcctccgtgctcctactgcggccgccagcgccgggcccgcagtgaggaggagaacctcattttcctcaacacagatctaaggggacaccgcctcactttgagacaacttgaggctgcgtcagtgaccttgtactgttgttatacaattcaatattgaagcgagagattctccagaacttgcccagaagccaagacgtctggaaaggatctcagcctctgtcagcctgcagcttgggaagagtgattcacagagcctgactgtccactgctgctaaaccatacactggccttggctcacacatctgactgaactgtctcctatgactaactgcctctctttcttcagccttgcaagtttcctgggagtcctgggagtggacttcacatataaaaggggactctgggagacctagttcctggcttctcttctggaagtcagggaa

SEQ ID NO: 10759 - DNA, 455 bp, Homo sapiens
taaaatcgatgctagtaataaaatgtgcccagtccaataagagtttggtatatgaatcaagagataatttgtattaagcaacaacacctatgattgagagactttcttatgcttgagagattgtagatgatttttatacacatttataacctgcattacatccctgtgaggtagctattactgtcctgattttagggataatggacctagatcttacagaaggtaagtaacttgcccagtaattaacagagcagattcaagcctagatctctctaatgaccccaaagatttccactgttcctaataccatttaaaactatatagtactgtgtgaatattagcaccataagactttttggagagaaatttggcaatgtgtgttaaatttaaatgtatatgtactttgtctcagaaattcaaattctgggaacttatcctaaggaaataatcaggca

SEQ ID NO: 10760 - DNA, 432 bp, Homo sapiens
aagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaa

SEQ ID NO: 10761 - DNA, 364 bp, Homo sapiens
catttagaattatattgctatcaggaatggtttcttgagaactggagcggaagaaaggctgtgtcccacgatatgtgatcctgctaataaagtggatgatcagacacaaagccaagttcatcttcccaccttggggccaccacagagccacgtggtaaccccctttttctgaaggaacggcattgaggcccaggccatgtgcatttccccctgggctgcctcctctgaccccaggattccagctcttcctcagaagttgtctccatctctgcgatgaaagaggagagcagggacctttctccctcccctcctctatgtctttctgaccaggtgcccccaggacgcctattgctgatgggcatag

SEQ ID NO: 10762 - DNA, 476 bp, Homo sapiens
  misc_feature 77..78: n=a, g, c or t
atactgcgcctgcsccgcggcagaggctcgtctctaccgggtccgctctcctccgacaccccagcaacgccgactcnncacccctttgagccgcttgaccagggcactcttctgcccgctcttggctaggcctcgctgctccagtgcggccttcaggtcggtcacccgcagcgcctgaagaggcttcccgtccagagtcacctcctccagctccgccatcttgcgtgaggtactcgggtccgtcccgacggcttcgggcatcttcggtaatttccgccaacgcccttcgaacgtaccgagatgaccccgcccactgccatactctacccctcgattaccactcagaactccccgggttcctccggatgtcctcggatgtttccgtctccacatcgttaccaatcaattctttccatccgccctgcagcgccccttttctcgccctgctttcaggctcggttttcttcgtcttgccg

SEQ ID NO: 10763 - DNA, 440 bp, Homo sapiens
  misc_feature 287: n=a, g, c or t
ataattgagaagatggcggaccagcaaggacctcatcagaataggtttccatcgtgtgggaagaacggataacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgassagcagcynaaatctcacaagcgaggaatgaaaggggacactgtgaatgtgcggcggagtgtccgggtgaaaaaccaagaatccacctcattgcctggagatcacgccaccatcttcagaaaagctggtctcagtgatacggttaagtgacctctctacaga

SEQ ID NO: 10764 - DNA, 71 bp, Homo sapiens
aaccgatatcgcgatactgcactccagcctgggcgacagagcgagactccctctcaaaaaaaaaaaaaaaa

SEQ ID NO: 10765 - DNA, 481 bp, Homo sapiens
acacagtccctggcttagctgacttccacctattaaatgaccccagatacttctaaactgggggaccaaaacaggatgttcagaaatattaaaagaaaaccaaaaagagcaaggctagcccgtcacaggtattgattgttccattgtggccagcctggaaacaggagcaaacctatttgcaagcatgaaatacctggagattttccactgcgcagttcacgtctatgtaaattttcttgaagaaaatttcttaaagatttggttcattaaggttaattgttccacatttagaacactcatgaacctaccaccaaattcatgaacttaagaacctcacaaaggaaaacggggcacagagaactacgcaatttatccgaggtcacacagctgtgtaaggagcagagctgggatttgatcaggttaaaagagactctgtggaccctctgctacatgctgtgagtgttattataaatgtcttctg

SEQ ID NO: 10766 - DNA, 162 bp, Homo sapiens
aacaatgttaaagtatcagactgaggccctgaatccggagacttccaagcggtatctctctgcataattgagtgatctaggaagagatttcaactgtttaaaagctattcactcattaaaaaaaaaaaaaaaaaaaaaaaaaaaaaaaaaaaaaaaaaaaaa

SEQ ID NO: 10767 - DNA, 506 bp, Homo sapiens
aattgtgacaaagagcatggcttttggagtgattctgagctatgtttgaatcctgactccagcatttactggctgtgtgactttgaaacctctggagtgttctaactggcaaaaacaatggtactttgcggttttgagcctgggaaacctaaaaaaaagtaagctgcatgcctggttgtgctgtgacatctcgtaacagacaggcagttgacactggctccatgaacaacagccaacctcctcctttgcacacagactgaaaatgggaaacatgaggtttgggaagagtcttagacccattttattaccaaatagttgaagcttttacttggacaaatatatttgcaatttcaaaatccacaaggatttggtttagaaattactgatgaaaaagaacatcaatcagccatcccacaccctgttgaactccttggagaactgaatgagaggcttaaaagaggtagttttaggccaaacagtacaagaatatattatattatgtcata

SEQ ID NO: 10768 - DNA, 421 bp, Homo sapiens
ggcaaatcatttgggtcccgtcagtattgtggaagctttgttcttttgctttttgcagtaaatgttggtgctggtcactctttgggtctgtgctgcctttatgagctgtaacactcaccacaaaggtctgcagcttcactcctgaagtcagcgagasatgaagccaccgggaggaaagaacaactctggacgcgccaactttatgaactgtaacactcaacgcaaaggtctgcagcttcactcctgacgtctgtaagaccatgaacccaccagaaggaagcaagtctggagatgtccgaacatcagaaggaacaaactccagataaaccgtctctaagaactgtaacactcactgccagggtccgcggcttcattcttgaagtgagcaagaccaggagctcaccaattctggacacagcac

SEQ ID NO: 10769 - DNA, 329 bp, Homo sapiens
atcagcctaagattgagctaggatccaaacccactctcactcctcaggagcgagggtagagagaaagatgtgattgcttccccttctgccatgatcggaagtctcctgagacatccccagccatgtggaactaatcttatcatatctggatacttgaaacatcccacagaacatcaagtggtctgctatattaaagacataatgcagagcaaaaaagactagcacactagaagtcttsgaagagaagcactctggaatcctagaagaactactttaaacttctgcagaaggaagtggatcttagcaacataagatcaactatggtagta

SEQ ID NO: 10770 - DNA, 354 bp, Homo sapiens
  misc_feature 305: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggangcccatcagactaacagcagatctctcggcagaaaccctacaagctmga

SEQ ID NO: 10771 - DNA, 127 bp, Homo sapiens
attttggaagattccagaaaaacatgaacaagtgtttgagtgctcttaaggggattgtctaatatcttggctcctgactcatccttagaagtcttccagccaccttgtacccatttcaagcccaagg

SEQ ID NO: 10772 - DNA, 263 bp, Homo sapiens
aaatcagatgttcaagaggaacagcagcagaaatggtagcagtgaamtagasaagaaacttsgagaaaatctaagagatgcaagaaacagtctttttacaggtgatacacttggagctggccaattcagcttccagaggsssttattagtssttgttgacagaaacatagatttggcaactsstttasatcatacttggasatatcaagcattggtgcacgatgtastggatttccatttaaacagggttaatttggaagaat

SEQ ID NO: 10773 - DNA, 320 bp, Homo sapiens
agttgtctctgaaagcgctcaccaagctcctgtttgaggtgatctgagggtggtgagccctgcccagtgctggagaatgaaagaggcctgcaaataaagcttctgctcttcggtaggaagtgctccttcatcatccaaagtggtccccaccacaagctgcagggaaaccctsaragctggagccaaatgttctacagaagtaccagatttgtggcacccactctggtccaacctccacttcccaatgttagattattgcatatattgtatatattccatatacatgtgtatatataataaagtgtgtatattctaaaaaa

SEQ ID NO: 10774 - DNA, 203 bp, Homo sapiens
acgacgcccagctaattttttgtgtttttagtagagacgggggtttcaccgtgttagccaggatggtctggatctcctgacctcgtgatccgcccgcctcggcctcccaaagtgctgggattacaggcgtgasaccgcgcccggcccctsataaggtatgttcttttacttcaaaataaaaaatagtattaaatgaaaaaaaa

SEQ ID NO: 10775 - DNA, 347 bp, Homo sapiens
  misc_feature 88,180,296: n=a, g, c or t
ttttcctcgtcttccaccgctaatgaatacacatccctctgctgaccagcggctgcatatcccagttgccagacgaaggcccaggtwnctcttctctactggataatccgttatctgtgtgaagagccagttscctcctctgggtggatttttgtgaagctaaactgatctttggggganaaatgcattctacagaaatcaatgcctttctccctctagtcatcttttttttctcttattcctttgctctcaaatatatcctgcataccgttatttaaaaacatattatctaagangactccaaatgtaaacggttgaaatttttcctttccaccatactttctgag

SEQ ID NO: 10776 - DNA, 375 bp, Homo sapiens
awcccgctggggkccccttcaacactgtggaagctttgctctttcactctttgcaataaatcttgctactgctcactctttgggtccacgctgcttttctgagctgtaacactcaccgtgaagatatgcagcttcactcctgagcccagcaagaccacgagcctagcgggaggaacgaacaactccagacgcgctaccttgagagctgtaacactcaccgcgaaactctgcagcttcactcctgagccagcgagaccacgaacccaccagaaggaagaaactccgaacacatctgaaaatcagaagggacagactccagacatgccaccttaatagctgtaacactcaccgccagagttcacggcttcattcttg

SEQ ID NO: 10777 - DNA, 372 bp, Homo sapiens
aaaaaaactaggagctcaatcatttgtttgacagaggatttgttcataagctttgtatgactttatcatttatgtgacctctcactttttatgtcattttgtctctctagccaacttctaaagatcaggtattggccatgctagagaaagccaaagttaacatgccagccaagcctgctccacccactaaagcaacttctaaaccaatgggagggtccgctccagccaaattccagcctgcatcagagatggcatcttgctctgtcacccaggagggagtgtagtggcgtgatcatagctcactgcaacctcgaactcctgggctcaagtgttccttctgcctcatcctcccaagttgctgggactacaggc

SEQ ID NO: 10778 - DNA, 379 bp, Homo sapiens
aaagtctagtgggtaggcctggaagcttattgagcaaatatgattttagtcacaagtagacaggatagtctggactaataatgaaaaatgttaacactaccttggatttagagtactcttcctttgaaggtgtaattaattaatacttcctttgcagatgtaattcattaatgcttcactttggttttgttttagtacttcacttatccaaggtaggttaagcaaagaagtattattcattacactgaagtattattcattacactgaagtgaacagttcaggcctcttctgtcacatcagtttaaataagtacaacaaagatttatgacttcagctgggcgaagtggctcatgcccgtaatcccagcactttgaggct

SEQ ID NO: 10779 - DNA, 268 bp, Homo sapiens
  misc_feature 259: n=a, g, c or t
ttcctttgtccacaaggcagtgaagtcaactctgaccagccttgcactattttcttgtctgttctggcaaaacaaggactatacatccacatttcaatgtgaaggtcctataaagaaggaaattgtcagaagagttctgcagggtttccagctccaggagccgatgtaagtagggagaagaacagtgccaaggaaaactgctgttgccaaagaggagggaggaagaagaggaaggaggaaagaggcaaacatacaaaanctcagacaa

SEQ ID NO: 10780 - DNA, 479 bp, Homo sapiens
agtggttaggagtggtgtttcatcagactgcactgttgcaaacaatagacctagaataggaaatttaagccaattgttaatcactgtgttaattgtcttgaggtatctatgaccaggaatctaactaggaaagaagataaaaccaaaatcttcatcacctctctactatatttaaaacacatcatcttgtaatcagctaatcactaacttaactcttaaatgtaaagcctgttttagcctttattggttcaaagttgctctaaacccagtaaaaaagtgtgtttttaaaatttaactgaatcattaaggagttaaacataaacattgttttctaaaaacatttccattcagtgtttctacctttctttatatatgccaattaagccatctacaatacagcaaaggtacaaaaacagaacctacaaggatagaacttactcctaaaaggacagaattgacagtgggagaaagcattgtcc

SEQ ID NO: 10781 - DNA, 462 bp, Homo sapiens
  misc_feature 278,345,354,412: n=a, g, c or t
aacatgattggttcagattaatggttgggcgtggactggaaactgagcgtcaagctccgtgtcctctgccctaaaagaccaggattctatgggccttgctgggctcttgccttcaaaaacccaggcctcctaattctccccagaaacagctgcattggagaccccaagtctcgggagcacacccctgcttcctgccctgtgactggtccctgaagctttcctctcaacctcagcgggtccccacctctccgtcaagttcagtcttgggaaaatgccangcatgatggctcgcacctgtggtttcagctattccggagccaaggcaggatgataacttgagcccangaggtcaangggtcaaggctgtagtgagccatgatcctgccactgcactccaacctgggggatagantgaaaccctgtctctgaaaaaataaataaataaatacataaaaaacaaaa

SEQ ID NO: 10782 - DNA, 431 bp, Homo sapiens
atctcaaaaaaaaacccaaaaaacctgtggcttctgscttgtcgtctgtssctgggattactccctctgggaaaagcaggtgtsatgtcaaggggacacccaaacagctctgtggagagttcagtgccatgagggactaagatctcctcccacagccgtgcagccgtgtcgggaacttgagggtgaatccccaagcacagtgaaatcttcggatgacagcagccccagcagcatcttgattgssgsctcgtgagtgatcctaaaacagaaactttcagctaatttgsstcctcatttctgacccacacaaactgagattcaaaaacgtgttgsttgtgttaagccctcaagttctggggtaatttgttacacaacaatagcaggaagaaaaggagaagtatcactctttttgctgcacaaatgtgaaaact

SEQ ID NO: 10783 - DNA, 232 bp, Homo sapiens
attagcttgtttctcagctagcttatgtagaaatttgccacagttgttactgctgggcacctgccctggatctgatcatcaattatatcatctcttccatctgatggactgcacctcaccccttgctttttcagagctggcgamstgggccaaggaaagcgatagtgccagctgagtggaatgtgcaggaagggaccgaggaggggcactatgtactggagaaaagagatgg

SEQ ID NO: 10784 - DNA, 63 bp, Homo sapiens
ctctttcttttcgccatcttttgtctttccgtggagctgtcgccatgaaggtcgagctgtgca

SEQ ID NO: 10785 - DNA, 154 bp, Homo sapiens
attttctgtatgcctattgcctggcactaagctggcagcacagcagtacgagtaactgttggatgaaatggtggcctttgcctgataccaggatgcctgggtgacttaaacacgaggatacaatttggagtgatttcccctgccccgaagaaag

SEQ ID NO: 10786 - DNA, 434 bp, Homo sapiens
aaaaaaacagattggttgttttagagcagttttaggtttataaaaataccgggcagatagtgcagagagttcccatgtacccctcccacgcccaggttctcasatwatttatattttgcattcgtgtggtgtgttggttgcacctgactcaactctacgttggtactgttactaacagccatagtttccattagggttcttggtgttgcacattctttgagtttggacaaaagtataatgaatgtgtctgccgttggagtgtcacagagtggtgtcactgccctaaaattcctccatgctccccctgttcatccctccatgacctttggcagccasagctcttctcactgcctccacagttctgtcttttccaggctgtctgtagttggagtcccagtgttgcaggcttttcagactggcttcttccacttcac

SEQ ID NO: 10787 - DNA, 152 bp, Homo sapiens
acttagccttgtccctacctctttactcctctgtaggcagtaattcttttttcttttctttctttttttttcttttggtgtamagtatcgcatgagccaagactgtcatgaaactatttggatactgtactctggttccttcatctcctcca

SEQ ID NO: 10788 - DNA, 343 bp, Homo sapiens
atttcttttcttctgctaactttgagtttagttattttttttcttgttatagttttcgttatatttttcaatgccttgaggtatggcattaggttgttaatttgtgatcttcctacttttttatgtagacatgtaatgctgtaaacattagtaatgccctcttagcactgcttttgctgcatcccacaggctttggcctgaagaagtcagtgatttatagttcactaaaactgcacaaaatgtggaaagggtggctgaggaaaacatcctgattttgcttgcttttatatatgttatgtgtagatgaataaagtgtttgatcctttttgacagaaaaaaaaaa

SEQ ID NO: 10789 - DNA, 247 bp, Homo sapiens
abatgataaatctcttcacgaatgtagggtcccactcgaacctcagacactgctcagggagactgcagggtgacacagaccacatgcgtcatggcagagcctcatcttgaattgtgactgggttcaagtgctcactattcacttgtcaaccaatgcttgttgaactcttggccggcgtggggtagggcacacccctgccttctgcctctcggsaagccattcattcattttcaagtacttgtggasa

SEQ ID NO: 10790 - DNA, 441 bp, Homo sapiens
ttcgcattttactttaagatatatgattattgtcattgtgctatctttatcatactatataaatatgcacacacatatatatgcttacatatgtatactttttatgtattatgttattttatatataatacatttgttttgtatatataagtacatatacatatgtagatatatgtatatgcataatttgtgtacctataaaaacatacaataaggaactctttaaccttgccttaaatctcatctctatgtcttattaatttttctcaaattgctttcacgtatctgtaggtaccaagataaaaacattcaattccaaatatggtttcsccggttatgtattaccaacaacatcctgactatctattacaagaccttatatgtgcaatttaaaattcacttttctagaagtaagtgtccatttatttcactttgacttat

SEQ ID NO: 10791 - DNA, 223 bp, Homo sapiens
agacaacatctctatggcaacacctccacggaaaaatgatggcggccacagcaagacgagcgatgactattttttttaaatatacacaaatacagcactactaacccctgcaacaagccagatgaggaacataaggaagaattataattgtcattatttgtagacaataaaactgcctacctgtaaaaaaaaaaaaaaaaaaaaaaaaaaaaaaaaaaaaaaa

SEQ ID NO: 10792 - DNA, 441 bp, Homo sapiens
taatgaatacaaatgtgattttgaacatagccagtgtcaatgtgagaatccacttctcccaggacaatccacaaagccattcagtggtgacaaaattgaattgcttatcttgaaggccaagagaaatctagagcagtgtactgaagaattaccaaagtccatgaaaaaggatgacagtccttgctcattagataaacttgaagcagacagatcatgggaaaatattcctgttactttcaaatctcctgttcccgttaactctgatgatagtcctcaacaaacttcaagggcaaagagtgctaaaggggttcttgaagactttctaaataatgataatcagagctgtactctctctggaggcaaacatcatggtcctgttgaagccctgaaacaaatgttatttaaccttcaagcagtacaagaacgttttaatcaaaataa

SEQ ID NO: 10793 - DNA, 304 bp, Homo sapiens
aagttaatggctcactcaagactctcaacaagttggtgctaacaaagttgattttaaatttaggttcggctaaaccctgagtcccagacttcaaatacaagaatacagcaccagctgaaaaatatcttaactattcttctttaaaactaaaagcagatttcctctasstccccttgcactctcacaccagctcccatgaagacgatcctcatcaccatcttgmttgctaaacttcaatytgaaaaatagttactaattgaccaaaatactatgttgagtactgagaacacagagayaaaagggc

SEQ ID NO: 10794 - DNA, 172 bp, Homo sapiens
  misc_feature 57: n=a, g, c or t
agagcccgcgtgtcctgggccttccaagccttctgtccaccaggctgtgcatcccanttccttgaactgtgtctgagagcctcctctcgccaccctgaacgggatcccattggttaacatctyhwwtadgtcagaggggtgagcccagaaggccccatttcgggagcagcct

SEQ ID NO: 10795 - DNA, 254 bp, Homo sapiens
aaaatgcagttaggaacagcatccttaacaacaactttctttacaacgatattaacacaagagtcttgcaatacccttaacaacaagtttcctttgcaacagggccataacatcaacactcttggtaattgcattggtaccaaaacttatctgtgacaatatcttgaacattaatgcctttaagagaaatgcccttaaaaatatctttagcaagcatttccttagcaaacacgctcctagcaacagagagtaag

SEQ ID NO: 10796 - DNA, 374 bp, Homo sapiens
aaagatttaatacaagakgcaagaccaggtcagggatgctttggaattcattcattcattttcaagcattttacatgtgtatgaaaatgcgaattttaaagaattatctacacatgaagttgaaaagagacacctattgaaagaacccaaagaggaaaatcatgttagagggacagtttatgagaattttttagtagtagaatgattttggtgattagaatcggagtacacttgggaaactgttacagtgtttccaattcagtactcagcaccttatgtttcatatcgaaaagtcccatttcagtgttttctcaaacaaaagagacacatgtcttggataggattcatcacagattaaaagaaacctacgcaga

SEQ ID NO: 10797 - DNA, 80 bp, Homo sapiens
tgcaacgagaagatggccatctgtaaaccataaagtgagccctcaccagacaccggatctgtcagcaccttgatcttgga

SEQ ID NO: 10798 - DNA, 417 bp, Homo sapiens
aaacacttcccctcctgcaggtagcagggcgccaagcagtgacttctgaccaacagagtgtggggagaagggatgtgtattagccccggagacgtgatgtgagacccgcttgtgagtcctccacactcgttccccattggcaagatacatggagagcaccctgaggacctttaaaaggcaaagccgcaagsagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaaaaaaaaaaaaaaaaaggg

SEQ ID NO: 10799 - DNA, 268 bp, Homo sapiens
  misc_feature 248,253: n=a, g, c or t
gcgartcaaactgttgctgtttgctgatgatgtaatcatatacctagaaaaccctaaagactcctccaaarvgctgctagaactgataaatgaatttagcaaagtttcaggatacaaaattcatgtaaacaaatcagtagctctgctataaaccaacagcaaccaagctgagaatcaaatcaataactcaaccccttttataatagctgcagaaaatatatatactcagaaatatacctaatcaaggnggtgnaagccctctgcaagg

SEQ ID NO: 10800 - DNA, 447 bp, Homo sapiens
  misc_feature 280: n=a, g, c or t
atatcctttggcaccgggtggcattggccatagsagggtgaggatcaggagggagctcaggagggggaattgcactgaagatttgtcccatcgtgaagcaagagcactggaacttacactccaccatcaggccctgtcacaggagaacaaagaaggaaggcagaggagatcatgctccggccagcagggaatctccatttttttcagcctcataccttggaaagtacaaaggagtgagagctgggactaccagccagagggttcatggaggtagtgggangggaagatgggttctgcatggagccactccagggacttttcttctgtctcacagcctgacaatcacctctagctgttctcagtcccattctcatcgatgacctcgtctcctgattttgtacaatatctaggtgaccttctcttctttccatcttcaaacgcttgatc

SEQ ID NO: 10801 - DNA, 142 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaaaaaaaaaaaaaaaaaaaaaaaaaa

SEQ ID NO: 10802 - DNA, 245 bp, Homo sapiens
  misc_feature 29: n=a, g, c or t
catttcgaaagcacccagtgggatcttknggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattc

SEQ ID NO: 10803 - DNA, 168 bp, Homo sapiens
  misc_feature 36,38: n=a, g, c or t
gtaggaaggcaacattgacaaggccaaacaacgaangnttgactcacttgattccttgcactctcgaaggaaacaaccaccttagaaaaaaccatgcactttcggcgggggcttaatcacattagcagcccaatggactaagatacttggattcagagttctctccca

SEQ ID NO: 10804 - DNA, 361 bp, Homo sapiens
  misc_feature 255: n=a, g, c or t
aatttgttaacgaccatccgcctgattcggtccgcggtgttagctcctcctagggggcgggacctcacttgtctactcaatgccgttaattaagtaactgcttggaaaactgatttcattactggagacctggtcttgtaggaggagtaaatatggtcggagggtcacaggaggaaggagtggaggtactgaagagcaaacaaggaaataattttttaaaatactgtgtgaaagaggtactctggaaggcagcanggatattgcaacctaattttactcatctctagaatgaatgagtatgaagaataatggggggaarttctcgtgcaagttggaaatttttaaagggtttccccaatta

SEQ ID NO: 10805 - DNA, 170 bp, Homo sapiens
acagtggcttctcagcctcccctggcccaactgaggctgttgctagatatgtttttcctgtatcaggtggttcatttctttttttctttttttttttgcctcttgatcttttttttcttttgtccctaaagaaaaaaaattaaaataaataaataaaagttttaaaaaaa

SEQ ID NO: 10806 - DNA, 376 bp, Homo sapiens
ataaccatttagagtttctgttttgggatttcaatttgagaagaatgtggagaatgctgaatcaagaaaagagcagtaaaaatgacaagaaaacaagctcaaattagatatttggtcaaaagaagcaatttctaattgcctagggtcattacagcttcagcctcatctctcatatcttctacttcactctcaagactatagagcagtcattggtgttcagtgtcctgaggtacttcaagatcatcaaagaatttttggaaattcctcctttcaacaagcagtatacagaatcccagcttcgagcaggagctggctatatccttgaagatttcaatgaagcccagtgtaacacagcttaccagtgtcttctaattgc

SEQ ID NO: 10807 - DNA, 343 bp, Homo sapiens
cactttgggaaggaatgttgaacaatcaatcgatttacagtctcttgcctccggcagacgacagggtggctcattaactcaagataaccagagtaactaagtatgccgccctgcacgccctaccccgacgtcagttcccgcgctttgcctcttaagaaagctttgcctcttaagaaagactcgggctctggagctccagcagagccggggcctcggctccaacccgtcgggccccgacttgaagcagcggggaactctcctcacacctcggtgaccgggtggccgccgggacacagaggctttgggtggcggcgtgtttgcgggtcgggaagaaccgcgcaga

SEQ ID NO: 10808 - DNA, 357 bp, Homo sapiens
acgaataatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgactt

SEQ ID NO: 10809 - DNA, 264 bp, Homo sapiens
ttagaaatgataacaggcagcagttcaattcaggtagagaccaagaaaggtttggaagaagatcttttggaaatagggtggaaaatcgaccgggaacggtcatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtag

SEQ ID NO: 10810 - DNA, 58 bp, Homo sapiens
cttcaaatgactacataaagcagaggtttccctgctgccccccacagctccctgctgc

SEQ ID NO: 10811 - DNA, 188 bp, Homo sapiens
aaaaaagaaaaggagctcttaaagggaaacgactttggactcacgtaggcataggagaacgaaacttctktacattttaatctgaataattcttcaggatttaaaattaattggctctggcttggttggaccgtactcggatctcgccacctctgcgtttcccgagtcactggcgaagaggtgatttt

SEQ ID NO: 10812 - DNA, 447 bp, Homo sapiens
actgttctcccattgtgtcttgctaatagattctgatttttaaatgttgttttacaagakccagtgcccccatttatgtacttttcttccttgttaaaaaacaaaaccccaaagatttgaaggttcttagttttgctgctaatataattctaaactttgttttctcctctcagagaatttctctgctcctcctgatgtcactacaactacctcttcctcctcatcatcttcctcaattcgcccagcaaacattgacctgcccccctcgggaatagttaaaggcatgcacaaaggatccaacaggtccagccttatggatacagctgatggtgttcctgtcagtagcagagtatctacaaaaatccagcagcttctgaacactctgaaacgacccaaaaggcctcccttaaaggaatttttttgtggatgactctgaagaaattgtgg

SEQ ID NO: 10813 - DNA, 52 bp, Homo sapiens
atatacattcctcagcatctggccctggactgcctgcsacctccacacatgc

SEQ ID NO: 10814 - DNA, 237 bp, Homo sapiens
atgatgcaatatgtgcaaagtgcttaacgtaktcctggcacaatattaagtacttcataaatgtttgctgttatgattatcaatcaaaacacagcagtaataaattaaggcatgttattagaccttagctttcctaccagtaaagaactagacaatctcaagtgttccttccagctctgctgtttatctgaaaattcacgacagacactcagtgatacagaaatgtgtgctccagac

SEQ ID NO: 10815 - DNA, 232 bp, Homo sapiens
gagaatgttatgacttccctattatcagtttgctaatatttttatttgatggcattttgtactgcagtcttaattgggtacaaatgtattttagtaaaaaggatgaggcatcgtttttattagtggaatcagcttactttgagaaatttgtatccagacatcatttttagatatctttcacaaaggactgtagaatattgtttctgaagacaaagctttttttttttttttg

SEQ ID NO: 10816 - DNA, 263 bp, Homo sapiens
attgaaaggatctagatggtttggtgatgtaggccattgatggaataatgtagttgctgcaaatgccattatttcattcctttttatggctgagtagtattccatgagggaaggaattaggagcgggaaggagattgactgttagtttcttaggattggactaacaaaagtggaggttgttacttacactgcaaaagaaacaaccagagctgtgtcactcagaaggctgaaaagaatcaggctgacaggatttttaaactcca

SEQ ID NO: 10817 - DNA, 401 bp, Homo sapiens
aaacacttcccctcctgcaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaagsaggaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaa

SEQ ID NO: 10818 - DNA, 463 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagatttcatatccagccaaactaagcttcataagcgaaggagaaataaaagcctctac

SEQ ID NO: 10819 - DNA, 436 bp, Homo sapiens
aacggtttgataagaggaaacccgtttcacttggttctcattctctctcttgcctactgtgttgtaagatgtgcctttcgccttctgccgtgattgtgaggcctctccagccacgtggaagtgtaagtccaattaaaatctttcctgtataatttatccagtcttgggtatgtctttatcagcagcgtaagaatggactaatacaccgagggacatacaaatgagaaaaaaagtcactggggactcctagagtggggaggaagagaggggttcttggactgaaaagctatctattgggtagtatgctcactacctgggtgatgggatcatttgtactccaaacgtcagcagtataatatgcccatgtaacaaacttgcacatatactctctgaatccaaaataagtgttgaaaaatataatgataaaaataaaaat

SEQ ID NO: 10820 - DNA, 222 bp, Homo sapiens
ccctccctccctccgacgctatcaaatgatgccgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatgg

SEQ ID NO: 10821 - DNA, 355 bp, Homo sapiens
  misc_feature 70,180,188,211,290,314,323: n=a, g, c or t
aaagagactctagaatcctgaagcactaagggatcctgaagcatctgtgtcctcccaccccaagagcatnaactcccagaggcagggatcccggccctgtgcaggactctgtkgctcctggtagaagasaaccacccttacagatggaagakgctggaatacgggttctygctgcaagtntgtttgancttggmgccaggcagtgtttgcntgtccccctgggacctggaccaccatgaggagagcttgcagtcctcacaagtgcagcctctaaggtcaagggtcagganggtcatgggacaccgcctgcaagnacacacatngctcctgtagccaagtdgccctgtgtggccta

SEQ ID NO: 10822 - DNA, 88 bp, Homo sapiens
agtctatgtgtgtgcctgtgtggtgtgggtatgcctatgccctttgtgtraacctgtgtgatgtagatgtgcctgtaccccagctgtt

SEQ ID NO: 10823 - DNA, 398 bp, Homo sapiens
tagcccaagattgcgatgccagcaaggttttggcagaaatgtgaatataagcaagcatactatgagatacatgatccagtcactgtaaccttctttggaactagtattgatccagcagcagctttcagtactgatcctaaaaacaaataatatgatcggatcagatcatcacaaagggagcaggaatttgaaggatgtatctgggttattcaaaccgaaaacacctaactccagttcatkaaaaatcatttcatatttgtataaaaataatttttaaaagagtctagatgtagttataattttaaaagtagtcatatttctagaaccttctttaaattcttgttatttgaatatgaaattattgtaaatccattgaataaataactatattcataaaa

SEQ ID NO: 10824 - DNA, 504 bp, Homo sapiens
aattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaagggtctttatcattttaaagaaacattcctcagtgta

SEQ ID NO: 10825 - DNA, 364 bp, Homo sapiens
caagagggaggtgttataagagcaatgcagaggttggagtkggcagcagttggggcaggaggaagccgactgctgcctggtctgcaaagaagtcctttcaagtctctaggactggactcttcctaagcaagtccggcgtgagattcaacattttggggtgaaaatcagcatagttgaacctggctacttcagaacgggaatgacaaacatgacacagtccttagagcgaatgaagcaaagttggaaagaagcccccaagcatattaagggagacctatggacagcagtattttgatgcccgtgataggagctttgtgggagtgggatttgtcaatttcctataagaatattattytgaagacct

SEQ ID NO: 10826 - DNA, 58 bp, Homo sapiens; identical to SEQ ID NO: 10713

SEQ ID NO: 10827 - DNA, 440 bp, Homo sapiens
gattgaggctcatttggtaacttcctttactgagccagtcttgatcagaagtccacattagtatgtgacagctagaggtactgttattaatgtatcagcaacagttacattaactatttcaaaggactactgcccttaaaatgaaaaracctttcagctatgtttgtacccgtgactgacatctggactggatttatgcttgatgcattgttgggaaaatatgcaatacaaactggtatcagaattccttatactgatgaggcactttatattttttattagaaagtagaactaattttagatttttcaaattggtgaattttatatttccctgaagaggtttcttcactattaatcttaaaattggataccattgtgcagcggtgtactgtacttcagagaaakcataaaagtacatctagctcagtccctatgaggta

SEQ ID NO: 10828 - DNA, 331 bp, Homo sapiens
atcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtga

SEQ ID NO: 10829 - DNA, 80 bp, Homo sapiens
gtcgttccagggtgatcatctgctcggaggccgctctcatcctaagctcccacgtctggtgtggctgggggggcgtcaca

SEQ ID NO: 10830 - DNA, 267 bp, Homo sapiens
aaaatggtgcctctaggaaaggaggcttgtattttgcacattttataaaaacttgagagaatgagattagtgcttgtatatttctaaaaagaggaaggagcccaaaccatcctctccttaccactcccattcctgtgagccctaccttacccctctgcccctagcctaggagtgtgaatttatagatctaactttcagaggcaaaacaaaagcttcgagctgttgcatgtgcgagtctgttgtgtggatgtgtgtgtgtggtcccca

SEQ ID NO: 10831 - DNA, 429 bp, Homo sapiens
  misc_feature 224: n=a, g, c or t
agaatgagaaaaccgtggggtgtgtgtgtgtgtgtgtgtgtgtatgcatctgtgtgtgtatgtgaatgtgtatttgggcttcatctgcaatagcaacttaagctcagaataagtgaatgggttgtcaaggtggacattagcagtgagagaccaagagtctggacaacagggattcagtgattggkctagaagacccagtcatgaaggtcatagtgtgwwwwcynytcatttggaaatctgggagcagttcttaagtcaaaaaacagacctggaatcacagtatccatacataccagttggaggacaaaagacattgccccagagaccagaggcaccaaaatacactacacctagctacctgagaatgcctctagctggcaactccagcaaaggcccttttccccatccttgaacatcttgagtgaaagc

SEQ ID NO: 10832 - DNA, 69 bp, Homo sapiens
aattagagcaatttttctcagctgctccactacagaaaacgaaagtaattatacaaaaatagtgtaaaa

SEQ ID NO: 10833 - DNA, 189 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaa

SEQ ID NO: 10834 - DNA, 440 bp, Homo sapiens
  misc_feature 340..341: n=a, g, c or t
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtagacggattacaccttcccacttgctgaaaaggtcaaggccttcttggctgatccatctgcctttgtggctgctgcccctgtggctgctgccaccacagctgctcctgctgctgctgcasccccagctaaggttgaagccaaggatagtcggaggagtcggacgaggatatgggnnttggtctctttgactaatcaccaaaaagcaaccaacttagccagttttatttgcaaaacaaggaaataaaggcttacttctttaaaaaaaaaaaaaaaa

SEQ ID NO: 10835 - DNA, 418 bp, Homo sapiens
agtattcctgcttcatttcttaccatacacaaagtggctggaataatgcatgacaagggaacaagatgcagtggaagaacaccagcgatcccaggagacgctcaacagaataaacacacttgagacatcaaagaaatatcatattaagagaactgttcagaaaatggtgaagactggcagtccaaaatcaaggttggtgtatggtgaagcctcttctcctggctttcagatctccagcttctgtgcccttgcatggctttctttggtgtgaatgccacgaaaagagcaagtctggtatctctttctcttcttataaaaacaccagtcttatcagatttgggctccctaattactggaacttataaatgttaccttctaaggaaaaagagtctttgcagatataattaaattaaagatc

SEQ ID NO: 10836 - DNA, 348 bp, Homo sapiens
atggataaaagtggatcaaacagcattgcatgctacagagaaatctttttgaaagagtcaatcgaggtggcaaacttcactgttttcttttaaagaaattgccaggcctggcgcggtggctcgcgctgtgatcctagcactttggggggccgaggtgggcagatcacctgaggtcaggagttgaagaccagcctggccaacatggtgaagcctgtctctgctagtaatgcaaaaaagttggctgggcgtggtggtgcacacctgtggtcccagctactcgggagcctgaggcggagaattgcttgagcctgggaggcggaggttgcagtkagccaggattgtgccatt

SEQ ID NO: 10837 - DNA, 51 bp, Homo sapiens
actgtatctagctaatctggtggggacgttggagaacctttgtgtctagct

SEQ ID NO: 10838 - DNA, 130 bp, Homo sapiens
  misc_feature 54,93: n=a, g, c or t
assagaccgcggacgtctgtaatctcagaggcttgtttgctgagggtgcstgcncmkgcgacggctgctggttttgaaacatgaatctttcgntcgtcctggctgccttttgcttgggaatagcctccgc

SEQ ID NO: 10839 - DNA, 348 bp, Homo sapiens
ctcttcatagttcattctagatattttcttccgatttttcttccagttttctcttcagctatgtccattctgtccatctcatatacactgagtttttgagttatttcatttttaaatcccattactttggcttttgataccacagttatctcgatattgatatattgcatgaagctttgttaaagtgagttctgcctgtaactggatcctgtggcatgaaccttaagggcagtattaaaacaagtgccagcaacttgagaccaagacctggatttgtggctaactttgtaaccttggaagaatacctctggtgctgtaasctcggtatcctcatctgtgacattaaag

SEQ ID NO: 10840 - DNA, 233 bp, Homo sapiens
gtagatgtctattatgtccaattggtcaaatgtcgaatttaactccaggatttctttgttagttttctgccttgatgatctaactctgtcaatgggatgttgaagtcacccactcccatggtgtggctaagtatttttatctttctcctaccctttaccttgagtctatcagtgtcatcacgtgtaagatggggtctcttgaagacagcagatggcttctcatctgtctcacc

SEQ ID NO: 10841 - DNA, 446 bp, Homo sapiens
gtagatgtctattatgtccaattggtcaaatgtcgaatttaactccaggatttctttgttagttttctgccttgatgatctaactctgtcaatgggatgttgaagtcacccactcccatggtgtggctaagtatttttatctttctcctaccctttaccttgagtctatcagtgtcatcacgtgtaagatgggtctcttgaagacagcagatggcttctcatctgtctcaccaccgggagccacagaaagtggacatgctcacagtacaggaaatagagctttgcactgttcttttaatgatgtggattttttggtgaactcactctattttgtcttggtttcttcagctcataggtttgtgaggcagtttatagcaaaaggctataaaagtcttttttttctaaataaagataatagatcaaccaaaaaaaaaaaaaaatgcgaa

SEQ ID NO: 10842 - DNA, 101 bp, Homo sapiens
actgaacttgggagctgaagaatactggacggggcttcggagaggaaggatggtccaggcgcaccccaggggttgcgatgggctcttcttggtgtctgtat

SEQ ID NO: 10843 - DNA, 282 bp, Homo sapiens
  misc_feature 83: n=a, g, c or t
aatatttttgttgaatttcacattttctaccaagtaacgaattaacctttttgaaatcgcagaggagatcacagcakgwaatnaagccatatcctgtacacgctggctaccacatatgaaccatcagagagatggagggcaatgtctggaagaaggacgggaagagggaatataagaacattcagtattaatggattccaaactccgtgtgataaccagccggtcctggaccagtttatcatcgcagtgtggactgattctcttttgcaggaasttagtttt

SEQ ID NO: 10844 - DNA, 199 bp, Homo sapiens
aatagctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtgtaggagcaagtacagcgagcaaagggcgctata

SEQ ID NO: 10845 - DNA, 471 bp, Homo sapiens
agtcgggagggtaaaacacaatcatggtgccataaaagagtgaaggagccggcattacacacagacagcccgcagaagggcagcaacgttttggagctccttttagttctctttattgatatattttaattgaaaccagattttttttttcctgtctagcccttggagacaagctctgccagagctcgtatagcagagagaaggtcttgagattagtgatactcagcgtttctgacactggagacctgcataagaatttaacaaactgggaagcagttttcatgacaacccttttcattgcatagatgttaccaagagtttgggggtgtttttaagaaaagccattaggctggaagtcagacacacctggatttgagatccgctctgctacttcgtacttgcgtggttttgaggatcatttggcctcttttcaggttttagatccttcacctgtaaaatgaggatggttgt

SEQ ID NO: 10846 - DNA, 134 bp, Homo sapiens
  misc_feature 77,81: n=a, g, c or t
atttttttccaaagccatggtgaamatctctgtgctaatttcttttgttttgtttcctaatttttttttttttkggnaggnggtaggaaataatctttgtcttctttggagtaaacyttsaacacsggattttt

SEQ ID NO: 10847 - DNA, 166 bp, Homo sapiens
  misc_feature 15,41,154: n=a, g, c or t
attctcctgcytcancstcccgagtggctgggactacaggnkcccgssactacgcccggctagttttttgtgtttttggtagagacggggtttcaccgttttggccgggatggtctcgatctcctgacctcgtgatccgcccgcctcgggtcangagttcaagacc

SEQ ID NO: 10848 - DNA, 326 bp, Homo sapiens
aaaaatatcactggattggccattggaagacctgcatgataagttcagtacaaattttcccttatctattctcttaagcaaaaaggatgtaaaataaacaggcaaatgcttctgtttattagccttctgcagtaaatccatctattgctgtcaagtcttcagcaaaacctacgtaggtagtaaaagtttgtattagtagtaccaccttcgtggcaaatgattatagaaagacctcagcaacatggagaaaccatgggtcagtatgacaaactcagtttagcctagagcagctgtgcagtaatcccaggagcatgtaacatcgcaga

SEQ ID NO: 10849 - DNA, 246 bp, Homo sapiens
gagaaataccaaggtgtacctagatgtagttacagccatcaaggagcttaaaattcagtggaaargtggtgtcgccaaagttagttacctatgaacttatgagaaagggtaatcgtgagctggccgcggcaccggctgcctatcctggccgtgaatgtttgctttctctgccctggtctcaggacgtccgtttcgaatagatcaagcacttctctgtcggcagctttcacaagagatctcgtttta

SEQ ID NO: 10850 - DNA, 390 bp, Homo sapiens
ttttatgggatagattcccaagggagggatttctcagctgaagtgtatatgaactttttaaaaaaaattkatggccataaaaaatctttgaatagcaaaatgtactgtgaacagataaagacaatgacaggcaagggaaaatatttgcaactcatatcatagctacagggatatttctatactacttgtgtttctaaaaatcagtaagaatataaaagcttaatagaaaatggggaaaggacatatcaggtaagtcaacaaaaacataaatttaaacatcttttgaatatatggaaagattcttggcctttctattacctatgatatggaaamtatcaagaagtttcatagcagtcttttggctwggggagtgggaacactcattcttat

SEQ ID NO: 10851 - DNA, 243 bp, Homo sapiens
gggtttctacatgagaatgtctgctggagttgtaggaagaggtcctgggtaaaggagcaggtgtgttcttagaaggccctcctgtctgctgctggaacacatcacctgtttattcgtcctccatttcccgstttgcagagcactgaaagtctcttaagttacagcttcacaacagaagtcyaaagtctgcgcagaactagcacatctgcagscgtagagcagcagaatgaccaggcagcagag

SEQ ID NO: 10852 - DNA, 483 bp, Homo sapiens
  misc_feature 83,273,308,341,412,455,468,476: n=a, g, c or t
agtcgggagggtaaaacacaatcatggtgccataaaagagtgaaggagccggcattacacacagacagcccgcagaagggywncaacgttttggagctccttttagttctctttattgatatrttttrrttgaaaccagattttttttttcctgtctagcccttggagacaagctctgccagagctcgtatagcagagagaaggtcttgagattagtgatactcagcgtttctgacactggagacctgcataagaatttaacaaactgggaancagttttcrtgacaacccttttcrttgcatagatnttaccaagagtttgggggtgtttttaagaaaanccattaggctggtaattcatacacacctggatttgagatccgctctgctacttcgtacttgcgtggttttnaggaatcatttggcctcttttcaggttttagatccttcacctntaaaatgaggatngttctganaaaggga

SEQ ID NO: 10853 - DNA, 435 bp, Homo sapiens
accagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatc

SEQ ID NO: 10854 - DNA, 93 bp, Homo sapiens
  misc_feature 83: n=a, g, c or t
rrgtaggaatttgggtgagatttatgtgagaggttgtgaaggtgtgaaggggataaatttgatttttgtgtgaaagcaggaanctgaaccttc

SEQ ID NO: 10855 - DNA, 217 bp, Homo sapiens
  misc_feature 149,200,211: n=a, g, c or t
acctgcgtcctagagaagcctccctaccatttctctgtaagataccaatctgtttggttggctgagagagaatgactgaccggatcctctatattgtctctaacatgtcctctgtcccctgggagggcagcgcasagctgcagtgcctnccacttctcctcccacacctgggcactaccatgttctctaccgagggtgtngagaaactcangtaggc

SEQ ID NO: 10856 - DNA, 487 bp, Homo sapiens
  misc_feature 68: n=a, g, c or t
araaatgttctaaagataaaatctaatgatttcttataggaaggctaggcttggtgggcacaagtaanaaagccaagcagagagaagtctggactttgccttctccacctccttggaagacaggctgctcatcccattgtggtgtctcggctggtgtatgttttctgcctaggcttaatggacagcacgaggaggtagggactgacgttacccatgttttacagtggaagaacctgaggsttaaagaggcacttgccatctcgaacctgctggaggccaagactgttttaagtttcccagtgtcctagttcctttcttattgattctatacctatcatcattaatattaatttttataaaacattgctttcatcagcaaatataattcatgtgtttttgagatagtaaatagcatagtttgttaacttctatataatctgcatcttgttctgaatcctccaactatagagactaaacggaattaatg

SEQ ID NO: 10857 - DNA, 349 bp, Homo sapiens
  misc_feature 175,266: n=a, g, c or t
aattgtcactggtagctgacttaccttgttagtgtgaggcagtagacaggccaactgttactgaggtttcaaccagattcttttttagttactttgatttttgtcacaagtgccatttaccattcggatgaaggactccagcatttcctgcaggataaccaaatcattccagttngaggcttggacatattgaaagatcaatctctaaaagatttggaggatcactttgggatacagatgtaataattgaatgctgctgtgctcanggaaaggcttcagattctccatgggtgagttkggccatcagctcgctgctacagtcagcagtaaacatggtggcatatttgaa

SEQ ID NO: 10858 - DNA, 470 bp, Homo sapiens
  misc_feature 253,256: n=a, g, c or t
acactttagcatgaacacaaccttgcctcggaaagcatacgtgggaaaatatgccaggsgggtagctccccaattctsctgcccaaagatgtttgcsatagactacgctgactggsccattcaggagcccctcgggtttscgctggacctacccttctgatttgagatcatccacgtgttttcccacctccggagcttttattttataamttcctcccttcttagtacagtvccaatcactgctctcccccgnmrnscccctccccaaaggctctctgaggctgctccctttgtgattggcatctcattaatgaagaagggctggtgtctctcattacagttagagtgagtgagaggacctcagaactaatttacttgstctcactagggaagasacttgcctccatcaagaacttcactttcctgctgcctgtgsaataaaagaacccgttttgttttaacattaataa

SEQ ID NO: 10859 - DNA, 433 bp, Homo sapiens
  misc_feature 2: n=a, g, c or t
anaatttgatgttctatctcaatcttgccagctgtctttttaatcaaagagatgccattacaatgattattcttgaacatttgtgcccagccctcaagagaaagcaagagacctgctaactaactcaaaatgtttgcaaaatacaaaatattaaaggtgtgaaagggagcctgcggacacagaattgcttctgatcttctttgctaggctgaatcagaggatggccaggcacagtggctcacacccgtaatcccagcacttttggaggccaaggaagatggattgcttgagcccaggagttcaagaccagcttggacaacatggcaaaaccctatctacaaaaaattacctgggcgtggtggtgtgcacctatagtcccagctactggggaggctgaggtgggaggatcacctgagcctgggcagaggaggct

SEQ ID NO: 10860 - DNA, 450 bp, Homo sapiens
aagttctaagcactatgacctcctagcatagtgactttaataataactagagaaattatataaaaagtaatagaaaaactatttaatgttataaaattacctttaatatgacgagagacatatctcctttatgtcattagagggaaagaagtacaaccatacagtaaaaacagaagtgaaagcaaatcagaaaattttatgttcacaaaccaatctatgccagttataataaataaaaaataaataactcttgatagaaggaggttgaaaaaccagctccccggcttagatgagaaggcattacagcagagtagaagcttatgtcaagaatttgaaccagcatccccgcattcacatcctgactctgcactgtgtatcctgatacagtttactgaatgtcactgagtctcagtttttcatctgttaataggggcaatgatactgtttagg

SEQ ID NO: 10861 - DNA, 333 bp, Homo sapiens
aatttactattcaaaaccagcttattgcatgctacaggaccctggtagaaacagaacacctaaccaagggacatcaggggaccagagccgcccatcatgagctgagtcctgacagatcctacatcatcccatgaatatcctccagactgagctgtccaggtttctgctcattacatgtcctgggtctctcttgatgccccttatgtgtctatcaaggtccctcccacttaacatgtcactcagccaaggatgcactcttccagctctaggtggccagagaccagggtaacaggacaattccccccacccaactacatttcatggttcagacga

SEQ ID NO: 10862 - DNA, 350 bp, Homo sapiens
atttttttgttctgaagtctattttatgagatagccattctgctttctttcaaatttaatttttgcagagtgtattttttccatccttttacttttaacctgcctatgtttattttgaagtgagtttcttataaatttctcgttgtgttatttttttttcagttgattctgccaacatctaacttttgttatattttaaccatttacatttaagatggaaccccactgagctggtgggttggaagaaccaatgaaacacacacttactggggaggttctctgcctgatgctcaaaagtgtacttgtggattagaggggaactgcattgattctcagtattactgcaactg

SEQ ID NO: 10863 - DNA, 184 bp, Homo sapiens
  misc_feature 19: n=a, g, c or t
atcccgagcccgcgasrgnaaccgccagagstttcctccgagcggaagaagcgcsttcacctttcagtgcccggcgctgggcccacgcaggaagccgacccgccttggcctctggagttgtstcttgggatgtctttcagtctggaaatgaacctgtgtgctgggaaagggctcgggstccgst

SEQ ID NO: 10864 - DNA, 450 bp, Homo sapiens
aaaactatgctgcacaagaggatgtgaacagaaacatctggacggagaagatcttttttatattcagccatgccaattkacctactaccctctccatagccaaaggaatgcccaaatttccacagaaaggcatttttatatgaagaagctcatccctgttggacctttctcttgaatgcctactatgagtcactcagcaagagaggcacccagctccctcaaggtctgcagtgcctcggaggcccacttccctccatgaaacagtctctgaacatattattcctcacggatgatcaccttcttaactccatccagatgtgtgcctctgtctcactatttagcgtcgtcctagaaaatacagtaattgttttcatgcgtatacatcatgtttcctcaagtagaatctacctttatacaatcaaaagtgtcagattgatggatgagtagcag

SEQ ID NO: 10865 - DNA, 438 bp, Homo sapiens
attgcaaaagttctagtccaaagtaaggacaatttttcccaagtgattgagtggagcagcaaatgcctgtgaaaatagtagatataaaaatatcagcaagagccaaaattacaagactgtttctgaaaatattccgaaagaatgtttagaaaacatctttttccaggtagacagagagtttgtgaggctgcatcattggcatcattttatcatcaccatcccgctcaggagctcaagaagaggggaactgagtcagttagaattacagagggtgataataatttcagttggagcctcactggtaaccttgctcagccacacgactggaatgtaagaggctggggcattttggacagcacagatgttaaacgtgaacactaccttctcagtagcacaaatctgactacatctttaagtctccaagaggaacatgaggac

SEQ ID NO: 10866 - DNA, 256 bp, Homo sapiens
  misc_feature 49: n=a, g, c or t
ctggttgacagactgagatcctgtctcaaaaaaacaaaaaacaaaagangccctcatacagctagtaagtagtggatccagattcaaagcagacagtctactttcaaagtctgtgctcatcatcactacgttatgctgcctctcatagtatatacatctgatcacactttaagaacatcacaataggtagaagttcttaaatccatcagtatggttaaatagtctactgcttggtcaacattttccttccatggca

SEQ ID NO: 10867 - DNA, 336 bp, Homo sapiens
tatagatgaactgagcgccaatggacaatatcaatgtcttgctgaactgtccaccagccccatcacagtctgtcatggctccggtatctcctgtggaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaat

SEQ ID NO: 10868 - DNA, 372 bp, Homo sapiens
  misc_feature 152: n=a, g, c or t
atagtgacgattaggaccgtgcttctcaacacttgatgtgcataggaagcacctagkgaccttgtcagaatgcaaattgtgattgggtaggtctgggatgaagcctgggcactgcatttttaacagtgatgtcttgctgtgaacagaatagnttctaatctccccaaatttggcaccatcctggagagaggctctgcagaaatgaaagttacatgtaacatcatagtaaagcttaatccctgttattttagataaagcttaatctccattattcttcaatgatgaacagaatttcatttcattggataactcaggacattgtggacagtgatatccatggaaagcaagatactcaacaatgcctcaaatgcc

SEQ ID NO: 10869 - DNA, 358 bp, Homo sapiens
actaaggacagcataaaatggaagtcactttggtttctatgctatttttsattgcacattaatattttgaagcaatttatgaagatcttaaaggaaaaaaatgaatcctgaagaaatactttccttttgtgcaagtagtggcaaaatagtgactttaaggaccacgagttttcccccaaagtgaaattatctggtaaaagtgcagctggagaatttacgtgtacatatcattcatttaattccagaagcctttttttccccagtgaagatgatctctaattccctcacgtgtctacatctcagaggaggcagtgtgagcccaacggtttgatgctgcaaaggctgactgacaatgaag

SEQ ID NO: 10870 - DNA, 389 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaaga

SEQ ID NO: 10871 - DNA, 53 bp, Homo sapiens
cacctgcccacggacctgcctcgccctcaagcgcctcaaagcttcctaagcgc

SEQ ID NO: 10872 - DNA, 296 bp, Homo sapiens
gtttacatcgtacaacaactggtagtgatctaagcgatgacggctgcagagtgacagtgtgaggtrttgagaggaaaggscctctgaagaggtggccattttgagcagaagttaatgacgtgaagatccgggagaggaacagatgaggtgaagggtggcatgcasaaaggtactgagtcaggaacaagcttggggtattcacagagatgcgagaagacccgtgtggctggagaaacaaatacaaggagaagcaactctccacattgtgagcctctccatgaagaggcccgtgtgct

SEQ ID NO: 10873 - DNA, 378 bp, Homo sapiens
agtagttcagttctgtggggctccagggggcaaaaggcatgataaatgagtagaagtcatggagaggtggagcttgcctccagacagaatgctaagaaggatgctgctgcacagtggggactgagccaactcactgttcaacaaataagcattggagggtctctagttccatagaaagaaggcaaatgaagaggacagaagaaggagagagaccttcccaccccatcagccctatgctgcagagagatttaatcactcgaaagcccaaggtgtgaagagggaattgtgtgtgaacgctctaggcaagctttggtcagacacccgagcttgccctgcagttaagtgaagacatatgatgtgctctggccaatgaaataa

SEQ ID NO: 10874 - DNA, 294 bp, Homo sapiens
  misc_feature 140: n=a, g, c or t
cttctactgaaccactttcttccatgtgcacacgctgatttctcaacctggaatcatttccctacacctttcctcaaaggactgttaatgagttttcagaggtacttcactgaaatgtaactaccacaatgcatcctttncatgtgactaacttcgctcatggaccagaatcactgtggctctgcctggagtggtgcaaagagctcgcattctgtttggaaagcaaattatttaaatccagtagaggactctcaaatgtggttggaaaatctaagaagacttcccagaggcagc

SEQ ID NO: 10875 - DNA, 333 bp, Homo sapiens
aatattgtccttccatactccagaagtaaccattaccttgcacttaagtttgtcatttcctttctttttgaaaaacagttccaccatgttatatgtgcatttctaagtaatacattttttacttgtttttgaattttatgaaaaggatgtcactgaagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaac

SEQ ID NO: 10876 - DNA, 484 bp, Homo sapiens
aacatgtactttccgttggtgctgagactaaggcagtgaagggctgcttctcgagcaagtgatttctggagttagttttacaaagagtattctcatcgatagttgacatgcttaagagggtgacctcctggccatgttttccctatcagtaaggatcagataccccgttcagatgacagagccaaaaaccaaatgtcataacttgaaatgttttaacctggtgactgttcccaccatccacctataatgattcctttcaccagtcaagtcattttccaagataagtgttgttgaacatgaaattcaaggacataaagactcttcgcgggatggctactttctatagtcattttctttctatcgtttgaacctcttcagaaatacaatctctctaatagctgcctcttcagtttttccccttagccacaactaaatcaatcttgagggggaaaaaaaactgttcaaaataaaaacataccaaaca

SEQ ID NO: 10877 - DNA, 475 bp, Homo sapiens
tgaaacaggaagtaggtcctcaccagacacagaatctgccagtaccctgaccttggattttcgagcctccagaactgtcaatgtcactgttccgaagctagacttgcagttcactgggaagcatgacaccacagcacctccagctgtggacgcatcatggacaagccaggctgagaggagaacttctcattacttgcagcacagcaacattgggttcaatgtatgcccatgaaaaacctcatttaagagaatgccttggaaaggtgccaaggtccccaaactaattaactttcatctctcctggscctctgcaccctctctccatgaggaacattaaacatagaacatcagcttgagaacactctatttaaagcaaaagtccttctaaagatagccttgaacgtccatctaaatcatcctagtccattttctggcccagaatccacaaggccagcgcccccgatggccctactat

SEQ ID NO: 10878 - DNA, 438 bp, Homo sapiens
  misc_feature 414: n=a, g, c or t
gcgaagtcaaactgttgctgtttgctgatgatgtaatcatatacctagaaaaccctaaagactcctccaaaargctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccacagattcaatgcaattcccaccanrrcaccaccatcattcttcacaga

SEQ ID NO: 10879 - DNA, 288 bp, Homo sapiens
  misc_feature 54: n=a, g, c or t
attctggcggctgggcacagtggctcaagcctgtaatcccagcactttgggagnybgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctc

SEQ ID NO: 10880 - DNA, 58 bp, Homo sapiens; identical to SEQ ID NO: 10713

SEQ ID NO: 10881 - DNA, 300 bp, Homo sapiens
tatcaagtcaagaccattctatcattggtatttacttttgcatctattctcactgctgtgattcagggtcccttgctgtttccttcvtcattttcccaccttctaggatcctgtttcttaaaaccataatttctagcactaccagaattatttttctaaaatataagttcaatcatatcactcttggagcaaaagcctttagtggttcacccgtagaggtagtcattcattgcatcctgaaaagtatcatctcaaataaagcactaaagtacagcgtcagtgtcctggttggagacatca

SEQ ID NO: 10882 - DNA, 238 bp, Homo sapiens
aagatgaaaaakttctggagatggatggtggtgatggatgtacaacaatktgaatktctttaatgctgctgaactctacacctaaaaattgcccacattacttcactggtgaattatatcaaatattaaaagaagaaataacatcactcccatacaaacttttacagaagatagaggaggaagttaccacttcccaacttatcctatgagagtcaccacagccaccctccattgcaga

SEQ ID NO: 10883 - DNA, 340 bp, Homo sapiens
agtggtcattaccatgggctatraaggcctgggctctccccagctctgccatttattggctggtcaacattgaaaaakaaacatctgtgcttccatctcaccatctgcgaaatggggtaataacccccacccctaccacaccaggaaattctcattccagtcaatatctcaccttctccgcctgtgacaaccactgatcgccttgctgtcacagtcaatccgtgaaaggacctgctcctgaacatgcaatcgagccgtgcaggaggtcatcttctgtgcctggtttggagatttctkcaacatggttgcatscctccatgaggctttcttgctgctgagt

SEQ ID NO: 10884 - DNA, 358 bp, Homo sapiens
  misc_feature 264,295,306: n=a, g, c or t
atttattctaggttttctaatttattggtgcatagttgttcatagtagcctgggcaacaacgtgagactccgtcacaaaacaaacaaacaaacaaaaactcacagagaactaagagcatttaaaaaggtttatgtccaaagataagcattagaacaaaaaggcaaaacttctgaaatacccaccccccaaattatttataaatttaaagtacgggccatgcacagtggctcatgcctgtaattccagcactttgggaggccaangtggacagatcactttgagctcaggagtttnagaccatcctnggcaacatggtgaaacctgtctctacaaaaaatacaaaaattagctgggtgt

SEQ ID NO: 10885 - DNA, 171 bp, Homo sapiens
  misc_feature 88: n=a, g, c or t
catgtttcatttattagatgtttattttttcaacttcgstttttagtagtcatttagttaggttcattctaaartgtgaagtaatganatttaatacagagaagtctctgaaaatgtttggtccattgtatattagtcttgaataaatggaattctttttcacamttacst

SEQ ID NO: 10886 - DNA, 429 bp, Homo sapiens
agttagggtcgcactcatcacggggcccccattgcctctgggcaccccacgactgacatctgcggggccttcgcgctaggcttcgagtttcagcttccgcaccaggcctgcctttctgcaggggccagggtgggggtcgtgtgctgattgggccctctgaaccgccaccgctgcagaggggctgttccttccgtcacatcccttgtgcccgaatccaccctgtgtcttctcttttctcagcaggacattttaaaagcccagaccccctccttacagagcaaatgtccaggcttcggaggtcactgtcacatcccaagaacccccttcaccaggtgccactcttgagactggactgaagccccctggagaggacccctcycstcscatggstttgagccatgagatggacttggacaaagcggcaatggg

SEQ ID NO: 10887 - DNA, 476 bp, Homo sapiens
  misc_feature 430: n=a, g, c or t
aaacagggctctgttttgtattggacagccaggctaccaagaaactgggcaaaagttacaaatctgtcttcgcttcacctttcccatctgcgaaatagggctggtgctgttcacgtctgaacaggtgcctttgtcactgtcactttccctggggctcttccatctttctaggcaccacagcatctactcacacttagctcctgctctgaagttccttgtccccagtttgggggactctgtctcttctggggcaaagggcagtgcgtgacctcctgtgggttttgcctgccctgaatccagaggttttcgatacctttgaagcccttcctctgcttcttgcaaaatatccctttcctgaggcaatgacagcgacastctaaatgctggaatggaggaaaggagtgtgtgtttggggagggggcacggatantgcattacagtagttcataccttccacctctggaaactgggaggtg

SEQ ID NO: 10888 - DNA, 301 bp, Homo sapiens
agagaagcatgaaggcccacagacgctcgggggcagaccaagacgccctggggtccccgaaacagagatgtacagagtcggacacggaaagggagagaccaactcacggttaagaaaggagggagaccagcccaggatcaagaaagggaaagaccagcatggtctcaagaaaagaaagagaccagctcaggctcaggaaaagagagagacccagagaaaaggagcactcgaggctgagacagatctggacagagatacagagacagggaccagcagacccagtactggggagacaagaggt

SEQ ID NO: 10889 - DNA, 407 bp, Homo sapiens
ttaaaatctctgtctattaatgctgctaggaatatctcttgaagtttgtcatctgccttttttcagatgtttctcaacctaaaagaatgtcctgtaatctcttagatgttttcatctgattatgtgttccaggacttttagcgccaccatttttccttagttaactgtattgaatttttaaaatattcttgtgctagttataacttgatttacattaagagaaaccactaacaactttatgaaatatgtaatcctttgatttaaaaaaaaagttcatgttaatatttacgatttgattttattggtgggaaagatgcagttttcaattacaacatcattaaagcatggctttttagtcataaactaatgtgaaatgttcacttttcctgtttcttaccctccatact

SEQ ID NO: 10890 - DNA, 497 bp, Homo sapiens
cagtgtaatctctatcaaaataacaatggcattcttcacagaaataggaaaaacaatcctaaaatttttatgaaacaacaaaatatactgagtagtcataacaatactgagcaaaaagaacaattctggaagcatcacactgcctgagtttaaaatgtgctacagacatatactacaaagttatagtaaccaaaacaacatagaactagtataaaaacaaacacagacacaaagaccagtggaacagaatagagaacccagaaataattccacagccaactgaattttgagaaaggcaccaagattatacgtcatggaatagaaactttctttaataaatagtgctgggaaaactgtacatcagtatgaaaaagaatgaaattagtccccccaccatgatatacaaaaaattaactcaaaatgaaagacccaaaactataaaattactagaagaaaacataagggaaacacttcaggatattggtctaggcaatgat

SEQ ID NO: 10891 - DNA, 53 bp, Homo sapiens
aggtgaccccagcccctgaaaatcctcacccagggccccaaatctcccagccc

SEQ ID NO: 10892 - DNA, 360 bp, Homo sapiens
  misc_feature 73,75: n=a, g, c or t
aagatggcgtctcctcaggggggccagattgcgatcgcgatgaggcttcggaaccagctcsagtcagtgtasnanatggacccgctacggaacgaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtkcaaattaagatccacgagacacagccactgctcaagctyaaacttgamcsggktmatgcagtacatcgtgtataagctggtgcctggcttgcaagacattctg

SEQ ID NO: 10893 - DNA, 436 bp, Homo sapiens
  misc_feature 414: n=a, g, c or t
aatgcctgggattaggcagatgattttstttttcccccatacccctctattatttaggtgattgagtttaaacccgtttcttttactgtcttcctttgtttagtgttttgggcctcagtatacttaaagagtaatactatttttcttgggttgcaggtttttttgtattttttcgagacggagttttgctcttgtcgcccaggctggagtgcgatggcgcgatcttggctcactgcaacctccgcctcccgggttcaagcgattctcctgcctcagactcccgagtagctgggattacaggcgcccaccaccacacccggctaattbttttatatttttggtagagacggggtttcaccacgtcggccaggctggtctcgaactcctgacctcagatgatccacccgcctcggnctcccaaagtgctgggattaca

SEQ ID NO: 10894 - DNA, 371 bp, Homo sapiens
taagctgagtgtgtttgaaacacaaatgtacctatatttgggagaaaggtaatgcctattaagagtgtggcctctctttgctgtttatcctttgtatgtcccatatataaatttaaatacattatatatataggttcaaacttaaggagatataaaactgtggagtccatttgcattttctcttccctgaccttattttgaaggccagtttgtgtgtctctgtgtgggggggaacacttgggtggggagaaggtggaggggtatattgtgaacacagagaaaagtaatgtggcatacacaagatgaagttttcacaagccatgaatctagacctagagaagcttcagatttctggtggagtttcatgcaag

SEQ ID NO: 10895 - DNA, 358 bp, Homo sapiens
atcactctttccacatgacaaaaaccagtatcaaaggcaacagcattgtctgtgaaagctttaataaaaccacgtttgtttttctggcgaaagaggcgcaagatgaatgcttcttgacaagactcgattattctgtgggctctatacaccaagatgcctgagggggagaaacataatttaaactacagaacaggaacatcgtaacaccaacaggcagagatcasagagatcatagaatgctgactatgtgccatgctaccaagtattttacatataagcatttcatttcaccctgacaatcctaggaggaaggtactatctttatcaccaatgtamgggtcacagatatttactgagc

SEQ ID NO: 10896 - DNA, 67 bp, Homo sapiens
ttcttagtcascaatrtattaatatatacatttgttatatatatgttttatatgtatttaatatata

SEQ ID NO: 10897 - DNA, 278 bp, Homo sapiens
  misc_feature 252: n=a, g, c or t
atataggaagtccagaaggacagtcatctgccacctccagttaaaaaagaacaaaaccctcacactccaggaatgagtcaagaacccagtgaaggccacaggtctagcccacaaccacctaggtatgtggggtcctccaaggctcacgcttgtgtcctgcaggctggagccatgcgagggtctgcagtctttgttccggatggggaactactgcttcactggttacccaggtgccccgatggggaaaggaangaaatggtgagaatcttcagcacagc

SEQ ID NO: 10898 - DNA, 156 bp, Homo sapiens
akcccactggaaagcttcaatacagctgtggaaatctgcaccctagaagatcctagtacagaaattctacaaccaaccataatcatggaagagccaacttccagcaccaacgagaataaaatgaagagcccctgtgaatctaacaaaagaaaagtt

SEQ ID NO: 10899 - DNA, 215 bp, Homo sapiens
aagctttactctgtgccctggcctcccctctcttcacctttagatttccattcaccgaagtggctttggacccctgggtactcttgggacctgtttcctggaggccctggcttgggacactcacctgtgaamtatgcagctgggagctctctgcctaagagtttgcactatttaaacctgcctgggagttaggacggatggttttaggaatgacc

SEQ ID NO: 10900 - DNA, 159 bp, Homo sapiens
  misc_feature 44: n=a, g, c or t
aagtctttagtagaattkcaaaakacagaatattagaaccaatnatagaaataattaagactcatcaatatagttattctgacaagtgaaagaaagaaagagaagaatagtcaaagtcatgatgtgctggaaaacagcctggaatcattaggtataatt

SEQ ID NO: 10901 - DNA, 375 bp, Homo sapiens
tttcctttggaactttatctttaagataatagtttacatgtagtagtacttgaaatctaggattattaactaatatgggcattgtagttaattggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagattcattatttctccactttgttctttaggagattttaggtgttgattttctgttgtattttaactcatacctttaaatgaattccccaaagaatgt

SEQ ID NO: 10902 - DNA, 479 bp, Homo sapiens
  misc_feature 386: n=a, g, c or t
atcctttagttgtttttcctgatcctctccctcctcccaccttccaccctctgataggccccagtgtatgttttcttcttcatgtgtccatgtgattctcatcatttagctccaaattcatctccggtgcctgaaaccttcacagtcatcatgctatttcgtgtttatcattaatcttcctgttgaaagcatccccttttctcccctcttgttcctgccctggcccatttgcagttcaggtgatcgaccctctcagaaaatgctccctgtgaagccaaaatatctgtggaaagctgaataaatgaacatggccatttgacagagtgtacccacaccagacctgttgtgcaatgccttgaacgtaagtccttttcaactaaacggangtatattttcttttrtattgttgactttgaccctkaagcttagcaaagaacacttgtgcaacattttctggatcaatttatcatctgctcaga

SEQ ID NO: 10903 - DNA, 476 bp, Homo sapiens
actttttaacttgcagtattgtagataagaagtctggctttgtctcactatttttttttaattttaataacctagtctttccatttggaagcttacaacataatttctatttttgaaagccagaatttttttgttttttcaccgtactcccatctctaattaatcctgcatctatwwtaagtgttttttcactctattcctatctctaattcatcctgcttgagacttcatgagccctttcagtctaaaatcaagtcttatttagcctagggattactttcttctagtatttctttgattgttttttgtttgttccttttatacttcctgtgacttctgtaattttaatattagagtttttagatttgtcttcttacagttttattaatgatttttggtttctttggagttacttacatgatatatattctagactactaatttgttattttcagtgactttttcactgcctctga

SEQ ID NO: 10904 - DNA, 373 bp, Homo sapiens
atccttccataaccgtgccacttgataatacatttttttctcatgccatccaataactttttttctctaaaaataggactaggatagtaactgcagaataactaaagacttcasttttttactgctcagatgaacattcaaaataagtattatatggaattttgctgtagttttatgcttacttggcaacacaagcctggcctagtttctgtaactcaaggtttttgacsatgaatggaagttaaattttataatcagagcattttctaagtcttgtcccacaaaaaaataaaatataataaaatggaaactgttcakgccctagagataatttgstggtcaagcacatatttacacaagtagagtgcatggc

SEQ ID NO: 10905 - DNA, 369 bp, Homo sapiens
tgggagtttatgctgttatttaacatattttgcttccaaaggggttaagatgttttacctaaatggaggtttctaggtcagtgctatacaatatttctaatctgtgttttatagtgtgagctacatatgtaattttaaaattttcaagtagccacataataaaggaaacaggtgaaatttaatgacatatttcctttaatacggtatatccaaaatattattatgtcaacctataatcagtataaaaacctgttactgaaatattttatagggcccatctcagttcagactagccacatttaagtgcttcatagccacatgtggctcatggccatccatatttggacaatgtactttagactattgcat

SEQ ID NO: 10906 - DNA, 103 bp, Homo sapiens
aaagcaaccgcgtggtacgagtaacaactccaccggctggcgtccgckgcgcttggcsacaagtcacttttccagatctaggagcaccatggacacctcgtca

SEQ ID NO: 10907 - DNA, 68 bp, Homo sapiens
ctcttcctttctccgcmwtcgtggtgtrttctttactccgctgctsgccatstcttctcacaagactt

SEQ ID NO: 10908 - DNA, 349 bp, Homo sapiens
cacatgaacaagaagttctagaaacagttcgttttatctgaagtgctttctcttcctgsccactccgtccagcctcaggcccgctttctctgcatctccgcagagctgtctctaatccttcaggagctccctctgaatactgggagtctggstctwcwctcactccacaacttgaaactaataaggagctgtcttacgtgacctgagatgtgtactctatttcctggctatttcctcaaatcctttcctgcagagacssctctctgcsataagtaagagcccasctcgtgtttatgcccattggagcccacagttggtattgygtaatcacytttcggagttttattga

SEQ ID NO: 10909 - DNA, 138 bp, Homo sapiens
acatttgtgcaatatttaggaagcaaaattgtagagcaggaatggatctgaagtcaatgaaaaactcttcatagctctagttgttgggcttcccagaagatgacattgaaaggaaggtttggatgcaagttgttcatt

SEQ ID NO: 10910 - DNA, 203 bp, Homo sapiens; identical to SEQ ID NO: 10104

SEQ ID NO: 10911 - DNA, 184 bp, Homo sapiens
acttctctcttcccacctctatctgccttattgaacttcatctttccttcattctcttcaacttccacttcttcttgtatggtcctgttgatgccatcttgtttccgtccccagactcatcatctttaccctctgtcaactgagttcccaccctggttctctctcaagatcttcctctcatagc

SEQ ID NO: 10912 - DNA, 197 bp, Homo sapiens
actcaagactgctctgcctacagagaagccattcttttagtttcttctttttaaaaaaattagagacagggtctctctatgttggccagtgtagtcttgaactcctggcctcaaccaatcctcccgccttggcctcccaaagtgctgggaggtatgagccaccatacctgacattctttggaatccttttttttttt

SEQ ID NO: 10913 - DNA, 227 bp, Homo sapiens
  misc_feature 127: n=a, g, c or t
ataaaaagacataagtgatactgtactatgcatacattgtatcttaatgctgtttcagatcagcattttaaattttggtttgcatttttaatattggcaaaacgtaaccactgttaattaaaataanaccttgttgtatatgtaacaacataattttccctctatcccttcccaccctttgttctctatttctccctatcagtgccaacttcatacattttgtagca

SEQ ID NO: 10914 - DNA, 229 bp, Homo sapiens
aacttattttcccaggaggccatttacaaggggatctggatgacctgctgatggagatccagcttgccagggacttaggtttatcctgttttgtttgctactggttacaaattctattttctgtacaattagtcagactaaagttttcactgtatttgtttggcaaaacaaattaaacaaaaagtaaggtttttaaaaaaaaaaaaaaaaaaaaaaaaaaaaaaaaaaa

SEQ ID NO: 10915 - DNA, 251 bp, Homo sapiens
  misc_feature 63: n=a, g, c or t
ttgactgtaggttttatagatcttacatacaaaacaccagattctcttcttcctttaggttanatgagtaattataagtatggattattatagtaacaagaaacaagctgggttgttttgaaaaagcagtaagatttttttcttaaagcaaaaragcctcactctatgacttaattcaagttctatattagattaagtactacttactgatggatacagtgaaattataccttaacttagacaaagtaaag

SEQ ID NO: 10916 - DNA, 59 bp, Homo sapiens
aagtgggsgggtcgcgaggagcctgaggaagagggcggcgacggtggtggtgactgagc

SEQ ID NO: 10917 - DNA, 477 bp, Homo sapiens
  misc_feature 309: n=a, g, c or t
aggtttctggagggtgtggcccccagaggcatggaagctctgcacccctgctcccatacctcaccctacgcatctcctcatctgtatcctttgcaatatcctttgtaataaaccgacaaggtcttgatctgtcaccaggctgaagtgcagtggtacaatcaaagctcactgcagtctcaacctcctaggctcaaacaatcctcccacttcagcctcccaaccagctgggaccacaggttgacatcaccacacccaggtgaaaactccaaagcttaacattctaaccactctagggatggaggatgggangaagagagctgagtgtgcaccaaggagcggtaagatgccagacctgtgagtgaagaagcatcttggaagtggaccctatagctccaggcacctgctgacacatagtcggaggcaaaccacccagtcaagttcaacccaaattcctgacccaaaaaatcataagcaaaa

SEQ ID NO: 10918 - DNA, 469 bp, Homo sapiens
tgattgtktttttaactagcattcaacctttaggttttacaatagaattatttccccaaatctgccatgtgctgttttctagagtggattgacaattattctctggactttttggtaaccaagaacttctagcaactaaccctggcatgaccaccagaatctgcagggctgagagaagaaagaaaggcaaaagtggatgaatgcagctgaagatgctgtggaactcctatcacattccaagtgctgtgttgatatctggagatatagacaagatcgaagcagatgcagtctttcacatgaatatttgaatcaggcagtatgttccccaaattagcaaagtatctcccagattttttctttgatgatatatttgaaatcctaatgctgaaagttaaattatcagggttttaaaactagaagcagtcattatcagaattttatatactattttatttttaagaacgtaatt

SEQ ID NO: 10919 - DNA, 353 bp, Homo sapiens
ctatatccaaaggaatgaagttaataggacaacctgaaaagtattgttaagatgagaactaaaaagaaatcagccaggcatggtgactcaccctgtaatcccaacactttgggaggccaaggtggaaggatgttttgaagccaagagttcgagaccactctggccaatatattgagacccccatctctacacaagctttttaaaaaagttagctgggcatggtggtgtgcacctgtggtggaggctgagatgggaggatcgtttgatcgtaggagttcgaggctgcagtgagctatgatcagaccactgcactccagcctgggtgatagcctgtttaaaaawaaaaaaaaagg

SEQ ID NO: 10920 - DNA, 112 bp, Homo sapiens
agttctgtgtcgctaggcttcggcccggccgccgccacacataagctgcgatgaggagctttacgacttcccggtcttcggggccgggcgcaaagggccagactctgcgcta

SEQ ID NO: 10921 - DNA, 247 bp, Homo sapiens
  misc_feature 8,147: n=a, g, c or t
agcatgtnggctccccaggttggagccctttccctctcccctgcatgtccatcgcaggcttcaatgtgtctggcaggcagatgagaaagctgaaatactgcaarttgaaatgactcgtcctagatcccaggtctagtgaagagtgangaccagaaatcacatgtactagactaccagcagtcagatataatcagcccccaaatctcctgtggttcactatwtttwaaaggaaaaaaaaaaacmaggg

SEQ ID NO: 10922 - DNA, 80 bp, Homo sapiens; identical to SEQ ID NO: 10797

SEQ ID NO: 10923 - DNA, 218 bp, Homo sapiens
attagagcccggaacagctaaccactggattagcggatgtccgctgtgtgagtctgatgtgcttttggcaggatctgaaacctttaacatgtctggaaatcccagaatcttcccaacagtctgctcctgaaagcatgtgatataaacagttaccaatctgctgctctgtacccagcaccttcctgggctctggcctggtcacagctcccgttcctcaa

SEQ ID NO: 10924 - DNA, 226 bp, Homo sapiens
  misc_feature 152: n=a, g, c or t
ttaggcagttctctgcatgaaaggaggtgactaggttctcttttcttccaaagtcaaaaccagataggaaacctttgaagatgcataggaacatgtcatggtagggtggtgggctcctcttcagatcccacatagcagctggggccagccanggcgagatcaagggtgaatgtaggtagatgccagcaagggaagagcatgatcagagactatgagtgggctggga

SEQ ID NO: 10925 - DNA, 243 bp, Homo sapiens
actctaatactggctctagaaattatctttcttagaaaaaaggtgacactcttacagaagttctctaagaatagatgtaacagtttaatattgagataattatacatgtctctaatctgtaaatttctcatgagaataagaagagaaatagttttctttactactactactactactactactatagtagtattagtaacagcaggtaataattacttagcacccaggacctcctgacacacc

SEQ ID NO: 10926 - DNA, 463 bp, Homo sapiens
gtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcarctataaacccaagaaactgtattactattactgttggtcatactaaacctgtctatttcctgaagtatatgacccacaagg

SEQ ID NO: 10927 - DNA, 512 bp, Homo sapiens
gataagagaataaaagcaggctgtgcagccagcagtggcaaccagctccagtccccttccacactgtggaaactttgttctttcactctttgatataaatcttgctgctgctcactctttgggtccacactgcctttatgagctgtaacactcactgcgaaggtctgcagcttcactcctgaagccattgagactacgaacccaccgggaggaaaaaacaactccagacgcgccgccttaagagctgtaacactcaccacaaaggcctgcagcttcactcctgagccagcgagaacacgaacccaccagaaggaagaaactccaaacacatccacacatcaaaaggaacaaactctggacacgccgcctttaagaactgtaacactcaccgcgagtgtccacggcttcattcttgaagtcagtgagaccaagaacccaccaattctggacacactgggaggtgattggatcatgggggcagatttcccccttactgttctcatgatagtgag

SEQ ID NO: 10928 - DNA, 463 bp, Homo sapiens
cagatgtcctaatgaacatgcacctacatttaataagagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcamcattgcttcatttctttgcaaaatgtagttaagatatactttattctaatgaaggccttttaaatttgtccactgcattcttggtatttcactacttcaagtcagtcagaacttcgtagaccgacctgaagtttctttttgaatactt

SEQ ID NO: 10929 - DNA, 131 bp, Homo sapiens
  misc_feature 15,41: n=a, g, c or t
attctcctgcctcancctcccgagtggctgggactacaggngcccgccactacgcccggctagttttttgtgtttttggtagagacggggtttcaccgttttggccgggatggtctcgatctcctgacctc

SEQ ID NO: 10930 - DNA, 312 bp, Homo sapiens
tgctttcaccattaaggttgcattttaatgcagttattgttttaaattagagaataaaatgtaaaaccaagggaggctttagaaccctttattgaatggcatggcaaacttttaaaactgcttttgctatttcactagaactatctttgataaaggatatagctaaaaaatgtcagcccaaactgtgtgtaattagggttgtttattaaaattttctctaaatgtcatacagaggcttaagatctgtgtatgctgttgggtcggagtgccagtcactgctttggaagtctgttctgggggctgcagaatgac

SEQ ID NO: 10931 - DNA, 242 bp, Homo sapiens
atatatccttggttcagtactcaggtgatgtgactctcctgcctgcttctgcctacaggcacagtatccgacatgttgtttcatgccttattattttacacatgctattgcacctagagtctttgtatcctgactctgcactttgtctgtccttcccaatatggccccattatggcagcattttctatgcttttcagataaaactgattgttctcttaaaaaaaaaaaaaawtkcgaaaagc

SEQ ID NO: 10932 - DNA, 79 bp, Homo sapiens
  misc_feature 7: n=a, g, c or t
agagctntaaccaatctcactgtttccgtacctcacttctgattcctgtacgtcactttaccttttttttttttttttt

SEQ ID NO: 10933 - DNA, 386 bp, Homo sapiens
agaaaacttgtacagaatgaaaaaacctgatcaaatagacactgcatacaacatctgcacaatatatatgccttttagcagcaaaatggaatatatattttttttagttgaccaagttctggagcaaaaagcaaaactcaacacagtttagcggttttaaaatacacagcttgttgcctgccaaatcgatctatcatcttcggacctcatgctgagatccagacctgtgtatccaaccaacaatgtgctggaatggtcttgtaagagcagacagtgcccattttctttatcgtgcctaccattgatgggcatctaggttgattccatatctttgctattatgaatagtgctgtgatgaacatatgcatgcgtctgttttttttttt

SEQ ID NO: 10934 - DNA, 464 bp, Homo sapiens
  misc_feature 397: n=a, g, c or t
agcggagtcctggttgagtgaccatccaaggaatatgtcctcgcgcgcggccgccgttttccttttcggaatgtgggtaaagaatttaccgctaacagacgacctccaggttcgctcttggacagcaagattgagagacaaaacttaacaaagcgctgtgcaaactgaaatcccaggcttagctcgcttgtgtcttgaacacggaagtcacctagtcacccacaagatgtatgagtacagctaacccccagatgcatttgacagacggcgtgggacgcgccacttgctgattggctctactttcccagttgaccgcgacakcccccagccccaactcccttttgatggggctgtgaccacctgccggtcccctcacccacccctcacgcccggagantccgagttgattcgagtactcactatgtgcttatgtaacacatgttttcattattaaaatataacta

SEQ ID NO: 10935 - DNA, 412 bp, Homo sapiens
aatcacagcactttgggaggccgaagtgggcggatcccctgaggtcggagttcgagaccagcctgaccaacatgtagaaacccccgtctctactaaaaataaaaaaattagccgtgggctgggcgcggtggctcacgcctgtaatcctagcactttgggaggccgaggcgggtggatcataaggtcaggagttcaagaccagcctggccaagatgatgaaacctcgtctctactaaaaatacaaaaaaattagccgggcttggtggttggcacctgtatgtaatcccagccactcgggaggctgaggcagagaattggttgaacccgggaggcggagattgcagtgagccgagatcgcgcccctgcactccagcctgggcgacagagcgagactcgtctcaaaaaaaaaaaa

SEQ ID NO: 10936 - DNA, 531 bp, Homo sapiens
agcagaatgtaaggctggctttggctaaaggcctggatattagtcatgctggcagatacagtgaaatcactttgaaaacatgtgctcatgttgccttgtgccagtcgttcagtaggatttccaaaaatcttcatcatgacaatttgggattggacacagccttctcttcagagtgacttcagtgatctaaagaatgttggtcctgccctctggcattagaatgccataaagatctctaagtttgcctgtgcgtggaagcactgtctccataaagtttgagcatgtccattctctaaacacctcttatcctgatccaaaatcttgagccacaggactctaactgaagagaaagaaaatgaatctactgcctcctccgaagctagtccttcagatactagaagacaattatgccctctttatcaaaggccctacttaaaccagttcagtgataatctattttctatacccgtttttcataaatagaccccaaatgtgttgtttcttacataattatagaagtgttcaagagaa

SEQ ID NO: 10937 - DNA, 304 bp, Homo sapiens
aacgtgatgattgcgcaascagaaaatgggccctcttggccgtcgggacttgtactgttggtgactccgtctccttagacggtggagcctgcgtgacccagaaaggccaaagggcacactagccagctgttttgccacgagagtacaccgaacaaaggagacagggttatttataacctgacacgtctaccctactgctgtgtgtggtttccattgcctggaataggacctgaaattctgtatttgtcccaactggctagcaacttagaactttctaaaagagacaaaagcagaggagaacaaa

SEQ ID NO: 10938 - DNA, 372 bp, Homo sapiens
aaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaaa

SEQ ID NO: 10939 - DNA, 458 bp, Homo sapiens
gcgaaagtactgaccctggacccccagttgcctgggtccacctgtcgaaccaaacacaagcctcttttaggtctctttcactcatctgagcaggacttggctacccagaaacgccacctaacacccgcagcttcgccccatcatctgtgactacctactgtgcccgtgagactgtccagtctatagactgccgctcagagaagagcttcactccaaactccaggagaaacatcagtcaaagataccggtatacccgacctttttaagggggggaagacagtgcgaatgtgagaggtgtttcttcctcagagaagggacgtgtctcctgatggtcccacttcaggagccagcatcccagcgaactgataccagctgatagaggaggaaaaagcccgagaagccagttcagaaaggcctgasatcttctccctcccgsagagccacagacactcaccact

SEQ ID NO: 10940 - DNA, 203 bp, Homo sapiens
aggggactagttgatacttaaatattcccagccatagaattagtggtgcttagactgaagacctttcattttgcctcttcttgtcttgaacccgtttgatgactgtgtagagatattgcttgtagcactgccaaagaatggacttcgatgatgaagatggtgaaggccccagtaaattttcaagagagaatcatagtgaaatc

SEQ ID NO: 10941 - DNA, 185 bp, Homo sapiens
atatggtgaaacgtgtctgtactaaaaatacaaaaattagctgggtgtagtggcatacacctgaaatcccagctactcaagaggcttgaggcacgagaatctcatgaacctgggaggcagaggttacagttgagccaagatcacgcactgctctccggcctgagtgagactccatctcacaaaaa

SEQ ID NO: 10942 - DNA, 220 bp, Homo sapiens
ataaaataataaaacttttaagtttactaagcaaaagacaaaccccaaaagaaaaaaagggggggcattttataggaaaggaaacataattgtctaagaataatatgaaaagatgttcaagctaattagcaattatgaagatatgcaaatctaaatataccacaaagatatgatttcatattcattaaaatgacaaaaagtaaaatggcatgacaaaatt

SEQ ID NO: 10943 - DNA, 366 bp, Homo sapiens
  misc_feature 11,356: n=a, g, c or t
tcctgtcaggngcacttcgacaggcccgttcctacggcctccgaggttggtcacgaactcctgacctcaaatgatctgcctgccttggcctcccgaagtgctgggattacagacctgagccaccgcactcagccctattgtgtccagaattggtgggctcttggtctcactgacttcaagaatgaagccacagaccctggtggtttatttaacaatgtgaagtagtcccgggaagttgtactttgagcaaggtccgcaagcagtattcctgcacttctccagtcatgccccagcgccaggtcggaagctgtccacatgcggggatggagcctggcgtcctgggcccacaaggacanggccctgaat

SEQ ID NO: 10944 - DNA, 359 bp, Homo sapiens
aaaaaaacgtttcttcacaggtcagattgtaacaaacactcgttcctaatttatgaactcgccgttttgattttattatttaagcatgcgccasrattcgtgtttccttaagaaagaactgacctatttttggctggagataaacgatcatgttaacagatgttaatcttgtaatctgtttttcctgtaagcactttacctagccgggtttcagaccttaaaaataacatcttttccaaaaagacctgacgtcacaattcactccctgaaaaatcacactccccctccagtttcttcccctgcaatgatttcaaagacattaaatcttttccactttataaatgctgatctgttctgcc

SEQ ID NO: 10945 - DNA, 260 bp, Homo sapiens
ctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccagctcaggca

SEQ ID NO: 10946 - DNA, 331 bp, Homo sapiens
atcatactcaccatggctcacaaactgcctgtttgaaactcccttcagttctgagaggatgggaacattctttaagcggttcgtcttggcacgagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggca

SEQ ID NO: 10947 - DNA, 344 bp, Homo sapiens
tataacatacagatttgaactataattcttcctaattaagacttccaatttggctaagtgcagtggttcatgcctgtaatctcagcactttaggaggctgagcttgagcccaggagtttgagacaagcctaggcaacttagtgagacctcatctctgccaaaaaaagaaagaacgaaaaagaaaattaggcacgtctgtagtcccagctacctgggaggctaagttcacgggaggatcacgtgagcccaggaggctgatgttgcagtgagctgtgtttgtgccactgcactccagcctgggtgacagaacaagaccttgtctcgaaaaaaaaaaaaaaaaaaag

SEQ ID NO: 10948 - DNA, 391 bp, Homo sapiens
  misc_feature 64: n=a, g, c or t
ctcgacrcgsaactggctsaaagacaatgttattttccttccctttcttgaagaacaaaaaganagccgggcatgacggctcatgctgtaatcccagcactttgggaggctgaggcaggtggatcactggaggtcaggagtttgagaccagcctggccaacatggtgaaacctgtctctactaaaaatacaattagccaggtgtggcgcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaatawatatgagataatgcagtc

SEQ ID NO: 10949 - DNA, 87 bp, Homo sapiens
caaattgccttaaaagaaatcagacaaatgccctgagtggtaacttctgtrttattttactcttaaaaccaaactctaccttttctt

SEQ ID NO: 10950 - DNA, 369 bp, Homo sapiens
gcactggatgcacgcagccacatcagaaaggcggttaagaggggcgggggaagcgctctgatccacgatgtcctgcgagctgatcaatcagcttcacgctggaaataaccatataaaaacctgaactcaaagaagagaactggaataatcctccctaatcccacttcccatggtgagccccagctgggacgctgacacatggccccaactttttctcctgcctgatgtctggacccacaggggacagatggtggtccctggtcactgaagtacccacagaacccatgcaagaggcacaaaaccatctgcttagtggtcatgtggcagcagacagtatctcagaagtcctcgcagcatatgacttcactg

SEQ ID NO: 10951 - DNA, 364 bp, Homo sapiens
  misc_feature 197,300..301: n=a, g, c or t
gacacactgtccagttcagaggtaagaaaactggagcccagagatgtttggtcataagatttcaagatsgctmattggggttatgaatgaggccgggtgtggtgggtcacactgtaatcccacactttgggaggccgaggcgagcggatcacctgaggtcaggagttcaagaacagcctggccaacatggtaaaacncagtctctactaaaaatacaaaaattagctgggtgtggtggcaggcatctgtaatcccagctactcaggttcccaagtagctgggactataagcacacgccannacgcccagcgaattttgtatttttagtagagatgggtttcaccatgttggctgggctcttctc

SEQ ID NO: 10952 - DNA, 426 bp, Homo sapiens
attcagaaccttttctgtaatagctataaactgaaagcagcacatgtccaacaggaaaatgaataaacaaatacagcatattcatacaatagaatcctatacagagcaactaaaataacagctagaggcaacaacacggatggatcttacaagcctgatgtggaacaagagaagcctgtccagagactaagtgaatggatttatgtggtatgcaaaaacaggcaaaaccaaatcatagtgttttgggaggtatgcttacatagtaaagctctgaaggaaaacaaagaaaaggcgactaaagagaatgacaacttacacaatgcagaatcctggattggatcctagatccaatcaacgtgtagggatgctgatcccactccaagtctagaacatcattcacatcttggacagcaaatttcacatact

SEQ ID NO: 10953 - DNA, 239 bp, Homo sapiens
ctccatyyyyytgatggthaaatggcagtgggtgcccagaactgtcccaggtctctggctcactccaggaatcctcctcctagaagatggaagcttctttgacccggccaagcccagggtctcattctgttgcccaggctggagtgcagtggtgtgaccasagcttactgcagccttgacctcctgggctcgagtgagctcccasctccacctcccaagtagctgggaccacagatccg

SEQ ID NO: 10954 - DNA, 481 bp, Homo sapiens
cattaattttgatttcaaatggaagataaataatatcccaaatgaattatctgtaacagaaaagccaagactttaactttcattacatatctaatagttgatatcaccagttaccattttgaattttgtatagtactaggttagaacattgcttaatccttttaaaaaaaatgcatttacgtaaacacgaatactgaaattgttggattttttaactatatctgacataattttattcatcaattacattacacattcatttagcccagatttcaaatagtgggggaagaaagaaactgtatttcagagtaaaatctcctaaaggaaataaaaacacagagttgtaaatacacatgcttgcaaaaacattagtcgtgaaatccctagcaacaagtcactggatttttctctgtcagcacgcgtgtcagctgccaaagaatagacttaatgaagaagtgcccacatgctggcaggggccggc

SEQ ID NO: 10955 - DNA, 209 bp, Homo sapiens
gttctcgccggtctccgtgcggcggcatctccgtgtccctgtgactcgagaccgcggctgtcgggtctccccctctctgaccctgcgtctctgtccccgctgtgtccgccctctctccgtgactctgtgtgtctctcgctgtcttgctgtggctgtcactcccaggctgtctcccagtacttcctggactctacctcggaaacttcatt

SEQ ID NO: 10956 - DNA, 67 bp, Homo sapiens
gactaaatcaagggaaggttttcatggaaaagtcaaaaaaaaaaaaaaaaaaaaaaaaaaaaaaaaa

SEQ ID NO: 10957 - DNA, 428 bp, Homo sapiens
attgtgggagggaaacatacaaggtgatgaataccaagaggcaaggatcactggagccatcttaggaggctggtgaccacacatgggacatggattgaatatggaaaagttcatgggaaatggtcttctgtctggttcaaatgctgatttggccacttaacaaattttcccaagattaagagccgttaagtttgtaaaatgaggatagccattctttattctcaggatatttcataagatggaagtttactgttctgattttcatgctgaaagagcagcgagagagaaaattcatgaggaaaaggagcaactggcattgcagctggcagttctgctgaaagagaatgatgctttcgaagacggaggcaggtaaggaaaagagagaggaggacccagwgctcacatcagcatggccgtagaagaggtgc

SEQ ID NO: 10958 - DNA, 453 bp, Homo sapiens
gattctacgtgttgagaaaaaaaaaactcctctcttcctaaggcctccatattgcatattgaaagaatgcaagttggctgacctttaaatcatattgtattcatgattgtgaggatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtragaaaaccaagccctcatcacattttgtaccgaaacctattgaaggccttgcatctttaggacactgaacatccttgaaatttgggtactgaaactgtgttggaaaaatagtatcaagtgcaatcagagagaaacaaagtttaaatcagttttatactaagtactatctataacatcatacctgctg

SEQ ID NO: 10959 - DNA, 346 bp, Homo sapiens
acacccttcaagattgctcgaggscagcctccctggagcccgggtcccagccatgtgtctaaggccaacataatggtaatagttaaaggacttcatgtagcaagccagaactgaactaaatacatggasatctcaaacatgagtgtcatttaggactgaaggsaaattaatgtcataggggtggagatcaataagaaggtaaggagccactggcagtatgagtccaaacagggtataccatggaaatcacctgtggaagaggaaggtggattccagaagaaagakaacttgtgggagtgagcatttcaaggatggagagatcttgaagatactcacagggaagata

SEQ ID NO: 10960 - DNA, 506 bp, Homo sapiens
agattttcatttatttgccttagsaaaactgaatttttttgttcttgtttaaaattttcacatttcacagggaaagaaaaaatcctggatagctagaacatgacagtttccccatctgtgagaaattgctccaaaaacagtgattgactccctctgtctctgaagcagcttcctttggaagaaagcacttcctcgatatatatatgaacctacctttgaggatgaactactactgaagctcagcctaatgaattgtcagaactgtcagacagctctaaggaatgacaaatgtctatgatttgctgctgctgctgctattttgctggaaacacctgatctttcctggctatgtgacctgaggcctcagtttctccatcgacaagatgaaaataatgacatcacctatctgagagaactcatgagctgacactattttaacaaactcccctttcatgactgaagatgtcacctacctcagtgactgggggctcagcacagttgcttcc

SEQ ID NO: 10961 - DNA, 146 bp, Homo sapiens
aatactgggctaaaatcaacgtgtcaggaaggctgtgttccttcttgaggctccaggagaagtcgtttctttgccctttctgggttctagagactgccacattcggatggaatctcactctgtcacccaggctggagtgcagtggc

SEQ ID NO: 10962 - DNA, 493 bp, Homo sapiens
aaggacccaggttgacagaggctccaccatcttgtaatgtaccatctggaatgcattgcctccccgcctccccagcccatgatggggaagacaacaatgaagggcaactcatctgcaataaaatgttttggcctggtagaccattaactgtagggatattttttagtttgtgattttacatttatctgtacatactttttcaagattgatcatttttataaccatggttttcctgaaatcctcaattcatcaatatgaaggaaatgaaccacatagactttatgcaataaataacagtgcaagtgagtataactctaactgatgttccacaaaacatttttgatttcaggtttgtatgatgtagtttttaatcgtacattttcatatgcaaaactaacacatttttaaagctttcccccacttttctctctatttgtattgttagccatcttgaagtgatgttgtttaacataaattgtactgttgaatttgg

SEQ ID NO: 10963 - DNA, 597 bp, Homo sapiens
  misc_feature 490: n=a, g, c or t
taataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtgnaatttactactgttgtcagtatcggtgttttgaattggtgcctgcctatagagatatattcacagttcaaaagtcaggtgctgagagatggtttaaagacaaattcc

SEQ ID NO: 10964 - DNA, 507 bp, Homo sapiens
aattcccagagtgagtaaaaccccccttctaaagaaagcctccatcctgcttcacattcaaggggcttctaggccatttgcacttcgtttacacctcattaaactgcccacattatatgcctgggtcccaggtgactgtgggaaaagatcaaggtttcctgcaacctcactgggcattttcagaatgatctgtacaagcgttgactgaatgattgattccaagttcccccttcctaggatttcagacctcctcttgacaagtgatgaatgggccatcttaatcttgtttggatcagaaaggaccatacaactgagctttagacaagactaaaaataccaaaagtagcagtctgcaattttatgtgcatgtggcttgaagctctgacaacaacacaaaagaacctcctttagacgtccttcacttccaggatccagtccaaactcctgggcttggcacatgaaccctccatcatctggcacctggcagcccacatgctggagcctcac

SEQ ID NO: 10965 - DNA, 438 bp, Homo sapiens
taaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaat

SEQ ID NO: 10966 - DNA, 356 bp, Homo sapiens
tgaatttgatttccatgttcttggccaagatcttagagtactataggcattaagtttaattacttcttattcaaaattttcaacactccccagttaactggtacttctctgcattttccaaatatatgggaagtgagatctcaaaccctccaccctgtgaccctggcctacctctggagagcttgcagtacaatactaaaatttcagttcctttctaaaatttgcagacaccaactctccttcttcaatttgtagtatcaactatttgtttttgtttttgtttttttttggagacagagtcttgttctgcactccagcctgggcaagtgagtgagactctgtctcaagagagggga

SEQ ID NO: 10967 - DNA, 591 bp, Homo sapiens
  misc_feature 430: n=a, g, c or t
aggattcaaacactagactgcaatcagactgtggctattttaacaccagtgacgtcatatcccattgatgccttaaggacacgatgagagaagtttcttctttgaacatcacacaaagccaaatacatcagcagctgagcatacagagggcatgaggtctactcactctttggtcagaagaggacaggacttgagcagaaagcgtgagagccccgagtcctggaagtagaggtcaggtggggctgtggggctcttcaggttcaaacaccggacgatcacgtacagcacagcagccactgcagccagcttcactccatcaaacacggctgggagttcgggagtctccagcatggcattcatcttgatctggggagcagaggcacaggtctaagtttacaagcacagtgaggacgggtggtgcccaccaccntacagacgcatggtgggctaagagatactgccagtgacggtgtgtcacaattcagatgtttccgcagctcctgacaggcagacaccaccagcatcttacagctactaatcaactggccataatcaaatcacaaacagtctgagcatggataactggagatg

SEQ ID NO: 10968 - DNA, 485 bp, Homo sapiens
acacagagcttctaacattcttctcatttcctgagtgatagcggtgctaggagcattttttttgttctaatattttgtctttgaccccagttcctgacacagagttcctaagtcccttggaatttcctaggtgataagaacgtcttttgtcctaatctgaggtggctctctgtaagcccctgaacaatgtcagggtgggggctgattgccaggaagaccaaaccatgattagaagcttaggtctttcagccccactccccatgctccagagagacgagaggagctggagactgagttagtaatccgtcaagcccacgtgatgaagcagccataaaaatccctaaaagacaaaatgggagaacttctgggtcagtgaacgtgtcatgtgctggaaaggtggcacgaccgaagtccatggggacagaagctcccgtgctcamgccctctggagcttgccctacatgcaagatcttcatctggctgtt

SEQ ID NO: 10969 - DNA, 418 bp, Homo sapiens
attctgctctgtagagacaaaggaaacacagagacatagacatggatctgggaaatacaccttttgctactcgttcagttttagcaaggaggtttcttgcatggctaagcaaaacttaaacttcctctgagaattacaggaattacaggacctgacaaagctatgaagattaaaacctataggaagaaaatctgaaccagaaacagtatggcagaattgggatctgactcacagagggaagaacttataattcttcacaggtcacatagaagcatgagaatttgggttcaagcaagtaaattctaaatcagaatccatacataaagtgtttgcaatgtccagttatatctccatgatattttctttgtggaagttgattgttcttccttacaataaattgcttgaattgtctgtctaa

SEQ ID NO: 10970 - DNA, 397 bp, Homo sapiens
atcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgacamccgcgcccggcctgagtgagtcttaatccgtggccatctgcgttcctgcaggcttcatctggc

SEQ ID NO: 10971 - DNA, 72 bp, Homo sapiens; identical to SEQ ID NO: 10311

SEQ ID NO: 10972 - DNA, 477 bp, Homo sapiens
agaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggaggctagagctaatggtctgcagtcctgtgtgattatcatacgcattcttcgagacctctgtcagcgagtt

SEQ ID NO: 10973 - DNA, 366 bp, Homo sapiens
atttcgtcaacggttaagttccggggcggggtaggctttccgcaagcgcaatggaaagcccagctaggtagacggaggagcgagtggcagatgaagccggaagtgctctataagatgatcattggtcggcgactggaagcggacacccgaagaacagtttccaaactctttacctgaaagcacaaaagacaagaaagtggaatctcactccgtcgcccaagctggagtgcgatgacgcgatatcggctcaccgcaacctcgcctcccgagttcaagcgattctcctgtctcagcttcccaattagctggtattacaggcgtccaccacccaccaccacgcccggctaattttttttttttttgaav

SEQ ID NO: 10974 - DNA, 497 bp, Homo sapiens
aagagttccttaatgaggagttgggagaggaaggatcctcattattccctcttcgctacctcctctctacaaccccattccaaagcgactgaccttcaacagaatgtatttctataaagataaaaacaacgaaactcccaagacgtctatatttggaatatacagggaaaactaggaatttaatagctgagttcacgtcctgccaacaaaacttagaaggaatcaacaaacttcaagttcaggcgcatatgtggtaccctgtggcctagcgagaagatcgcagatgacatgggaggccttcatcttctgcatctgtccgaccttttcagctcctcttctggtcactctgtcaagggggcctggaactcctgagaagtgaaaggaccagccctatctcagatggtgcgggtttcttcgccctgacctctgccatgtttgcttggagccccagagctcatccttcaaggcctttttaaaaatagcacagcctctgtcaa

SEQ ID NO: 10975 - DNA, 430 bp, Homo sapiens
atcatttttgacaatgctgtacaactgtggcccttcccatctgtctgctcaccaaagacatggagatctgggcttcccttagcacagagcaaatcagccaaagagcctgaggcctgggtagcctggggaagagaagcggtcttaaggggaagaatttcgatcaagtaatcctggagtattgagcctgggaaaattatttatacagactttctggcccatggacctcagtaaggcccagcagtgctgatgaaacatctactaggtacaagaccatacttttggctaccttctcctgccacagatactctatcccatttgctgtcatccaacgactaacaccgttttcacttcagaacgtcaagccttttctgttctcttcatggcctcctcccattaaagctgaaagtatctgctaaaaaaaaaaaaaatt

SEQ ID NO: 10976 - DNA, 520 bp, Homo sapiens
agaaatagcataaccttcccagcacgggtgccccagcctccagccagaccacaggccagctcctttctgagaccagaggccagcactgttctcaaaagagggaaggttttcagctggcagcgagctgagctgaggctggcacgcctctcctgggtcctgtcacgtgaagagggggaagtcctccaaggctcctgtggacagacagcaggggcactttcccagctaaagcacgagctctggcataggtctctgcatccaacttgaatagaccacatcagcttctccccaggtgatagttcccccaagcagaatgcacattgccagagtccctccgctaatttgtactcctctgttgtgataggaaatgcgagttccttggctggcattcctatttcccaccttttccctgatttcgtttgaagtggcgatatgcccagctatcacctttatttccagcctgtctcgcacctaggaattttccaaaaaatgtaatttacagtgatagagtgaaggtttcaat

SEQ ID NO: 10977 - DNA, 374 bp, Homo sapiens
tcaaacttttagattgaggcttttcttgaagcattgcttttgtccacataaagttgaagggaaaaaggaaggagagattatctaaatacacaaaattgaaagtgagagtgggggataagaaacttaaagaaacttaaaatattttgcttaactctgcaattacagatgctcctcaacttaggtctatgtctgggtaaccccatcttaagttgagttcagttgaagggtgtactgaatgtgtatggcttttgcaccgtaatcagagtgaacacattattcctggaaacctagttagagtttggcaaacacccggaaattcacctgtgaatttttgcttccacataggactcaaacaaacctttaaraaaaaaaaa

SEQ ID NO: 10978 - DNA, 478 bp, Homo sapiens
  misc_feature 448: n=a, g, c or t
ataactbcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgngtgttatattccaaggaaaattaaaagtat

SEQ ID NO: 10979 - DNA, 461 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasacmtgtgcctagcctgagccaccacgccggcctaatttttaattttttgtagagacagggt

SEQ ID NO: 10980 - DNA, 55 bp, Homo sapiens
  misc_feature 32,34: n=a, g, c or t
gtttctctcgcgccaccactggccgccggctnkntccaggtgtcgtaaccaccac

SEQ ID NO: 10981 - DNA, 456 bp, Homo sapiens
  misc_feature 189..190: n=a, g, c or t
gataatggatgggataatgtagctaaaactttgtttagttttatgagttgagaagggctgtcgccatcttatggcaataacggataggctaatgtagccaaaactttgtttcgttttatgatttcgattaggcatttcattgctacggtttaataattgaatatacaagaaatactataaaccatcacnnccccaacagcccccagccgcccagttcccccatctacttggcaaagattctctttttgaccaaactctaggcggcttcttctgagccctcttctggactaggtggccaccttggtctataaagacctgaacaaacccgaacatagttactaatagccccggtcttctcaagtgcctgcctgagaaaactcaattgatgccgccaaaggaatttactgtttgtttcagtcaacgtctgaagatagggccctcgtctcccaggctctg

SEQ ID NO: 10982 - DNA, 459 bp, Homo sapiens
aagtcagcaagaccacaaacccactgggaggaacaaacaactccagacacgccactttaagagctgtaacactcactgcgaagttctgtggcttcactcctgaagtcagcgagactacaaacccaccggaaggaacaaccagctccggatgcgcgccacctttaagagctataacactcaactgtgaaggtctgtggcttcactgttgaagtcagcaagaccacgaacccaccggaaggaagaaactctggacacatctgaacatctgaaggaacaaactctggacacaccatgtttaggaactgtaacactcactgcgagggtccatagcttcattcttaaagtcaccgagaccaagaacccaccgaaaggaaccaaattcggacccaatggtactatgttaattcttctaccagtcaacaattaagagcaactgtcttgcttgtagctcagcaacat

SEQ ID NO: 10983 - DNA, 209 bp, Homo sapiens
taaattcttcaagtgcctttatgaaggggagatcactcagatccagtcccacatcagcgacacgtccatcgtcctgtcaatggacaacaaccgggatctggacctggacagcatcattgccgaggtccgtgcccagtacgaggagattgccctaaagagcaaggccgaggctgagaccctgtaccagaccaagatccaggagctgcagg

SEQ ID NO: 10984 - DNA, 250 bp, Homo sapiens
  misc_feature 151: n=a, g, c or t
aacccactccggtccccttccacgctgtgaagctttgttctttcactcttcacagtacattttgctccctctttggatctgtactacctttatkagctgtwacactcactgtgaaggtatgcagcttcactcctgaagtcagaccacgarnccacccagggggggggacaaacaacttcagacatgccacctttaagagctgtaacactcactgtgaargtctgtgggttcattcctgaagtcagcaaga

SEQ ID NO: 10985 - DNA, 424 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagawaagagtaagggccaatactcaatgttcttaaagaaaagaattttcacctagaatttcatatccagccaa

SEQ ID NO: 10986 - DNA, 438 bp, Homo sapiens
actccttcctttatgtagggtgtaatcaaatacccagtgggaaacctctaaaggatatttaagccccagaaaattctgtaactagctctcttgagccacttgcacaatcccactcctagtctgtggagtgtacttttgtttcaataattctatgcttttattacttcattccttcattttttttgtgcattttgttcaattctttgttcaaaacaccaagaacctggacaactcgtagtcaagaacctccactggtaacattactatatgcttggccctgttctaaggactggagtgtgtatggttattcacagaagcagaaacaggctcagagacgtgaaaaaattttctcgcattttcagagctggaaagaagtggaacctggatttaaacacaggcaactctagagcctcaagttccactatgatccttattaga

SEQ ID NO: 10987 - DNA, 443 bp, Homo sapiens
aaaggaccctcagcccagggaggtggctttaatcttggttctccagtgtcaggaagagatccttcagtcatggggtaattaggaagtctcctaggataaggttattatattcaagtcctgccaaaaaatgtaagaaaagaagctcctatttgagtggaccaaaaagaacaattatacctcctaaaaataaaatgaacctaagctaagaaaatgaaaaggtttctaaagaaggtcagtacttcttttttggtctcctttcatcactgtgtgatttactttaatagtaccctgtcaaactagatgactcagtggcctcatcatagcttacagagcatttcatctgtggtcattcatcctgcctatgaagaaattgacatgtagtcactacagagaaacactgctcaccaatggttgttcaccaccataccctcctgatccttgcc

SEQ ID NO: 10988 - DNA, 397 bp, Homo sapiens
aaaatgaaattgactgtaattggtcagctatatttagaaatcttagttatatatcagactaagttgacgtgagaaatatttcttcaagagaagttttaggtagcagtaaaggttctaaagcatttaagaaaagtacaggagaaggagccatttacttgttcaatatgtgtctacagcagctgtttgaagtaaaagttttcaaggaaaaacaccattcttggtttataaatcaatcagttcaatcaggaggtcttctccattttgccacacctgtgatcctctatttctgcttctccactacctcataaaggctgataaggaggggaagtttcagccccttgatcaagttgtggtggataacgtgtttccaaattgcatcttgttgctgaaacttcct

SEQ ID NO: 10989 - DNA, 274 bp, Homo sapiens
  misc_feature 266: n=a, g, c or t
tgactagaccagggggtggtgcaggggagatggcttttgtgggaatttaccttggttgtttgcagttgggcctgtgttaaacgtgcagttttaccacattaaaaattttccagaaaggtagttgagagaagagcttttcaaactgttctcactccttataaacaacagaaggactcccctaccaataatctttaaaagcaaataacctctacaagctccttgttgtctttctttttatctatcaaaatgccaccattgtgcaaggnccccacag

SEQ ID NO: 10990 - DNA, 328 bp, Homo sapiens
ttccggcgggtcctggatgttgatgtcctgcatctaacgcggtgtamccccgaagccgagcgagctccggagaatttcagtatctgctacggtaacttcatcagcccgccaagatggcgatgcaagcggccaagagggcgaacggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagc

SEQ ID NO: 10991 - DNA, 442 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcg

SEQ ID NO: 10992 - DNA, 410 bp, Homo sapiens
  misc_feature 25: n=a, g, c or t
actattagctaggctgtttcgtttnaagaagaaaagatgtagatggaaagcggataattactttgaaatatggtaaaagcctgtgccttgaaaataaggttacacacaatctggctccttagaatcatggccaattccaggaggtatgacttttgaccagaactgatctcgactgataaggaaagtgttatagattcaagcagcagctggtggattctaagggctggattacagcctgtcatcagtgttgtagagaatatttgtactggagatacgattttagattagatgacctcctcattattgctgaatatgaaagcacagtgactgtgttttgaatgcttccagctgtgattatcaacctctgagccagctctccagtttyctgagtgcactgttaagaagaggtg

SEQ ID NO: 10993 - DNA, 322 bp, Homo sapiens
  misc_feature 154,164,285: n=a, g, c or t
aggtcaccaccaccaccatcaccaccaccttccacacctccctcctcctcacctgcaccaccaccaccaccctcaacaccatcttcatccggggtcggctgccgctgtacaccctgtacagcagcacacctcttcggcagctgcggcascgcancagcgstrrngtttgcmagccattgttaaaccctgggcaacaacagccatatttcccatcaccggcaccggggcaggctcctggaccagctgcagcagccccagctcaggtacaggctgccgcagctgctncagttaaggcgcaccatcatcagcactcgcatcatcc

SEQ ID NO: 10994 - DNA, 309 bp, Homo sapiens
atgggtaggagcatggtctctgagctggactaagtttcactcccagctctgtcatttcctggctgcttgacctgtaaaatggagatatacagacaacacttccttcataaggtgaagaaactaagaatcagaggagttctaactgagscatgaggactcgattcctgaaaaccttatttataaaaaacaggaatgggaactaaaacaaggcaacctgtgcaagcccttacaagtttttcatggtattacagtaaaaggtaaagcaacttaaaaaccacttgacattttttaacatttgtaaaattttgk

SEQ ID NO: 10995 - DNA, 412 bp, Homo sapiens
aagacaacattgtgagcttgacgacagcagagagcgagastttgttctggatttttcccagccctctgcagattacttagactttagaaatcgacttcaggccgaccacgtctgccttgagaactgtgtgctcaaggacaaggccattgcaggcactgtgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagcttgcccgagaagattcagtcttatgaaagaatggagtttgctgtgtactacgagtgcaatggacagacgtactgggacagcaacagaggcaagaactataggatcatc

SEQ ID NO: 10996 - DNA, 471 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgacactgtgcctagcctgagccaccacgccggcctaatttttaaattttttgtagagacagggtctcattatgt

SEQ ID NO: 10997 - DNA, 246 bp, Homo sapiens
  misc_feature 41: n=a, g, c or t
taaaggtgtatgtttttaaatgtatcatcwrtgtgtgccvnvrttaatattcttattyaaaagttaaggccggacatggtggcttacaactgtagtcccaacagtttgtgaggccgakgcgggcggatcacttgaggtcaggagtttgagaccagcctggccggcatgatgaaaccttgtctctactarraataccaaraaaaatttagccaggcatkgtggsacatgcctkgtagtcccaagtag

SEQ ID NO: 10998 - DNA, 487 bp, Homo sapiens
  misc_feature 399,426: n=a, g, c or t
agaccagctccaataatgagcaatagtggctctcttaattttctgtgagccctttcctaggcaagcttcccttcattggaattcctgtcttcttaccaagaaacagagtctaagttctttctggactggcgggggtggagtggtgagggggagctgaaattacctctttcttgcacatagacctacatgctgagattctagcactcctcccactcgggtttttggaactgggtcacaaactggcataccctggtaagctcatgaagactctttccttaagccctccccttagcagaaagagatggactcatgcctgtctaactaaataggcaggactctggagcatgcaattaggaacaatctttkgggtactttcascccctggaggactatcccttnaggtccctacagttttggggggttgantttatattcagcatttcattttcttgcataaagatgttatagraaatgaaaaatgtcatgk

SEQ ID NO: 10999 - DNA, 167 bp, Homo sapiens
aacccaggagaaacaccaracggtgttgcttcactgttacacaggagtacgcaccaagctctttaggaaacagctggtctatttttctcattccaratctaaacctcaaagctaaatgccgcaaagtggaagctgdaaggccgtactcacgtccagagactccaggg

SEQ ID NO: 11000 - DNA, 341 bp, Homo sapiens
gatgagatcattggagtgggccctaaagcaacaaaactggtgtccttataggaagagggaaatgccatgtggacacaaacacgaggagaagacgactatgcgtgatggaggcagagactggagtgatgcatccacagccaaagaaggccaaagactgccagcaaaacaccagaagctagaagagtaaaggaaagcttctcactacatgttttagagggagcatggcctatgacaccttgactttggacttctagcctccagaactatagacaataaactgttgttttaggccaaaaaaaaaaaaaaaaaaaaaaaaaaaaaaaaaaaaaaaaaaaaaaaar

SEQ ID NO: 11001 - DNA, 73 bp, Homo sapiens
  misc_feature 14,72: n=a, g, c or t
aaccgctgcgagmnggcccttccctaagttctcccagggcgctgccagagccctgccggctaagggatgggna

SEQ ID NO: 11002 - DNA, 293 bp, Homo sapiens
attctggcggctgggcacagttgctcaagcctgtaatcccagcactttgggaggccgaggcgggcggatcacgaggtcaggagatccagaccatcctggttaacacggtgaaaccctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaa

SEQ ID NO: 11003 - DNA, 395 bp, Homo sapiens
  misc_feature 299,304: n=a, g, c or t
aagaaaatgttatgacccaaaaataaattctggaaatgctctggaaattcaaggactccctgatctgtattcatctcctaaggtgactgtgagaaatcgccacacactgggtgactgaaaacacaacacaaatgtgattttcagagttctggaggccagcagtccggtagcaaggtgacagtaagatccaattccgccccccccccactcacgtcacaggaaattaaacatttaagctgaaaaaatgttcaaaccaagcagggcagtgccatgcacagaagtgaggcccaacgggaaansgganctcatccaccctcctcatgccaacagcagctcaaagcttctcaatggcaaaacttctaccaggtcctgtaagccaagattcctcctaaaac

SEQ ID NO: 11004 - DNA, 544 bp, Homo sapiens
caaaaaatgtatttgaggaaacatcggtcaaaagtgaagatgaacccccagcactgccaccacacctggccagcagtttcttaaaaagttacacttaccttaaaacccagcaatccactcctaagtatatgtctaaaagaaatgaaaacaacaggctgggtgtggtggctcacacctgtaattccggcactttggggggctaaggtggtagctctccagaccacccagggcaacgtggtggagccccgtctccactaaaaatgcaaaaaaattaaccgggtgtggtggggcacgcctctggtcccagctgcttgggaggctgaggcaggagaatcgcttgagccccagaggcaggggtttcagtaagccgagatcgtgccactgcactctagcttgggctgcagagtgagactccgtctcacacacacacacacaaaagaaatgaaaacaacaatttgtacatgagccatccccatgataaaggttccattctgttatttgagcattgcttattaaaatgatggcactacccagagatggggaa

SEQ ID NO: 11005 - DNA, 223 bp, Homo sapiens
aaaatgtccctcccctttctctgaaggctcccatctaggagctgaacttctcagtgtgaaataagctcttccccattactgcacagcagggagtgtgaactccagtgaggctctggggttctccagggcagtactgggtgtgtgcccacaattcaaagaatgtgaaattacactagaagaaaaagaatctatacacacaaaaaaaaaaaaaaaaaaaaaaaaa

SEQ ID NO: 11006 - DNA, 552 bp, Homo sapiens
aagacagttggacagcccgctggggtgggggtcaggaggaatggctccccagactcctgaacagaggatggtgacccaatcagggaacacgtctcaacccaacattgaaaggacaaagttgcttctgcaggcttcctcttaattctatggatcatgcaatagtctttcaagaaattatcttctgcttagctagtcacttcctgttgctagaaccatgaagaggcctggtgaaagatgttcagtatactacctgcatcagctgctactgctatgtgacaagcaaattttccagaaacactgacatggaaacaggatctttcttctcctactgtttgttcctcgactacagttataatcctctatttgtgacatcataattagttgccactggagaagacgatcgtgtcacaaaaggattaggacctaaggtgagatgacaggagcgacgaccactttaaagttgctgctgctgctgttgctttgcatgattgatggtattttctcatccagctgccctaaagtggcagctgcttaaagaaagatggtgataca

SEQ ID NO: 11007 - DNA, 53 bp, Homo sapiens
attcatttcatgggtagagaactgaaacccagagaaaatagaaatgccaccam

SEQ ID NO: 11008 - DNA, 491 bp, Homo sapiens
gaaaggctctacagggtgtggagaaaccctgagggagcggctgggtggggtagcctttgggtgtggaccactgccaactaggataaaaggccttgggcactggtcggagtgaaactggaagtttgcctggtgacatttttttcaaggcggacgttctctctaacgcttgtcgcggcgctgtctctcgcgggtccaccctgcactgggcgggttctgtccattcgcagctttagatctgaabctcaaataagcacctgccttgagggactcgggaggttgtctttcttccccccggacagggcttggggtattaaacaagtgagatcgacccacggatttgggggttgtctcacgggcgttggcttttgtcgcccccactgaacagttttctcagtttgactacgtacggccgttagagaaattagcgagctgaagactgaacacgcttgggaggagagggatggggatcaaatgtatcagaaaggagctaa

SEQ ID NO: 11009 - DNA, 155 bp, Homo sapiens
acctgtaatcccagcactttgggaggctgaggcaggaggatgaattgaggacagaagttctagaccagactaggcaacatagtgagaccctgtttctactaaataaataaataaataagcaaaaaaaaaaaaaaaaaaaaaaaaaaaaaaaaaaa

SEQ ID NO: 11010 - DNA, 452 bp, Homo sapiens
  misc_feature 19: n=a, g, c or t
cactcccccattggcttynacccctcccccttcttcctccgcctctcccaccattggttccctcccctactccattccttctcaccttttcccttttacccattggcgtgagtatttttcctcagcttccctctttctccgtattctgctcctcctcagtcccatcctccacgctttggaagctactgccttactgcccggagcgccgtcgtccccgaacctcccctgcttctccctttccttctgttccggtttctggtcgtaactcaagagcaaaccaccgtactgcaaaggaaccagatattgtgctcgcggttccaaaccgggcatgggcacgaatgcttctcgataaatccccttatggtctctgagcattaaagaaagcaagggaggaaaacatgcgcccaagctcgttcgcagggaacatgttcgcgtgtctgcgcctgtgtgcg

SEQ ID NO: 11011 - DNA, 469 bp, Homo sapiens
tcattgcaatgcaaaacagactaatacagtttcttttcagtaagaattacaaaatttaggccaatgaccaagctgagtataaattactaatcatacacaaaaatgtgtttcactggcttgagtcatttttctgtttaacactgaatttacacttagattcttgtactgtcactgagtccccttgtaaacagctaggtatattttgtgaatggaaactagccaaaaatacagccaaagtctcaacgccaaactggtctacatcagtatggactccagaaatgcatctttcaaccacttgattgcattaagtagtcatttgagtgcatcacctagtggcctttggtcctgaaagttagcaatcatccccaaaaaggtctgtgttaataactgatagacaatcttcattaagcaactgctgtttttttttttaatacttcaagttctgcaatacattgtgcagaacatgcag

SEQ ID NO: 11012 - DNA, 498 bp, Homo sapiens
aagacacgtctctttcctcttcgccctccgccatgattagacggggtttcaccgtgttagccaggatggtctccatctcttgacgtcgtgatccacccgcctgggcctcccaaagtgctgggattacaggcgtgasacccgcacccggccgatattacaaaatctttcctgaggctggaagtccagaagtcggggtgctggcaggacgtgctcttctgaagcctccagggcagggccagccgcatgcccgtctcctcgcttgggcacctgccagcggtccccggcggtccccggctcattgctgcatggctccaacgtccgcctctcccaccatgtgcctcctcctggtgtctctgtgtccaaatctcccgctctgtctaaggacaacagtcactggtcatgggacccatcctaatccagggtgacctcgtattaacttcatcacatctgcaaagactatttccaagtcaagcacactcccagctgctgggggcggga

SEQ ID NO: 11013 - DNA, 376 bp, Homo sapiens
aattggatcatagcgacgtccgttggmagggtaatcagaggaactacgtttaggaaaggggccgagttcctgttgaaagtgcgtggcctgtctttgcctgtccttgggctttctccttagataggtccttgatctaggtgacagccataggggcggtggttagggaagtggtagtgcggtgaagcaccactgaaggtgagcgtggcgaagtcaggagccctctttagagccaaaataaggtttttctctcgaagtagtgagattgcaagctcccaggcgattgcacagattagcaacctagacaggatctttatcatttaaacctattaaaatgaaataaactaatgtaaccagtactttaaaaaaaaaaaaaaaa

SEQ ID NO: 11014 - DNA, 460 bp, Homo sapiens
agtcttttagatggcccgaggagcatctcgagtgtccgcgatttgggaaagagcttttaactgggctgttaaagggctgccttcttttctccaaatgcgatctggattcctgcctcggggaacagttgtgctacagagagatattttaacgccctgatattatatttcagtgtcaattttacgaattaaaaagaacaatcaaaacactagggggaaaaaaccgacaagaataacctagcaattgcataacctgagaattacttcttttcttgaacatgttcctttgagcttcttgcggaagaaattctcttaggatgagtcgtccccgacagaagatacatatttggttttctgtgtgcttcactttttggtttttcatcttggactgcacactgaatttttaaaaaacgttcatccatcaaacatttgagcacctatagggtgacggctgcctctgggc

SEQ ID NO: 11015 - DNA, 468 bp, Homo sapiens
ataataggctccatcgctggtgccatcctggtagcagctattgtccttgggggcacaggctggggatttaagtaagcaacgccgcatgtctacttctcagtggctctggcatttctcttttctgcttacataaccaagttttgagttcctgctacaagagcttaggttctgtcagtcaaactgcaaaaaataagtctttttattcagaaatgggttagaaatgaagaaacacggaccctcaactgtcattttcagaaatgtcaagaagagaaggttcgatcctactcagcaaggccccatctgaatcagctgcgctgggatggacaccgccttgcactgttggattctgggtacatattctcagctcctaaggacctccttcctaaagaagaaagagttgattgaagatttgataagcatgcatgtgcgtaggagtgggtctagtgtcattggaaaagtgaacctgga

SEQ ID NO: 11016 - DNA, 419 bp, Homo sapiens
agcccgctggaggtgccggggggaaatgctggcgtctgctcctccgtctcccagaatcctgccctggaaaaaaccagcgccaaccgccggtttaactgaggacggatttaaggcattacgaaagacagctttcccctttgctcggctctccttctctctcctgctgccctgtgaagaggtgtcttctgccataattatttctcccccttggtaagagaatgtactgccaatcaacatggctgcttgtcagttctacttcttgaacaattttttaaatgttaaaagaacgaaagatttcacccattacttttggaagaatactgaagaccatttgaaaggatttaaaatgtcttttggaatcttctcgttctgagagctgctctttgctgaaaactcaaaggtaaatgagaaaaaataga

SEQ ID NO: 11017 - DNA, 403 bp, Homo sapiens
tttccaactttaataatttgtgcttatcctgtaggtaatgggactcttactgtaagtggcacgatgaaagtgttacaggaaggttactctgtggactcagatgtatgactgataggttgaggaaattattagcctgcattaggatttttttttagaaagtagctgaaaatagcaatttctagtctagacagggcagggatagagatgaagatcttggcttggaagttaagattatgggaatttttaacatccatatatagatatgtctatggactgtttgtgttacttatgacaattactggcatggcttcagatttagataatctctatttctcttttatgtaaaattgtaattcttagcccaaagtgactgaatttttgcttttgagaacaccattactat

SEQ ID NO: 11018 - DNA, 365 bp, Homo sapiens
gttgttactctgctgcaagatcctttttgcctgacaaacctcccctctggttcagatgtaggcagaattgatgggtaccatgtgggactattgagagacctaaggacaggaatcaggacttaaattctctaagtgttcagccaaccaatcttcattcattcatcattcattcagtcaacatacattttttttgagctgcctctcttatgtcaagcactttgatgccctgggcctttgaagatgaataaaaagttggcacggagtaggggcccagtgatggactgaagaaggaatgagtgggcacacctgctgcactgaggtgctttttgtccaggagattagctccgtttgacaaggcagtgaac

SEQ ID NO: 11019 - DNA, 458 bp, Homo sapiens
aaaactcaagccgcacgaggcttctcagaggttcctctcaccacaaagccccatcacagtacagaaggctttttgcaaaacagtgatttctcagcttttccgaagaggttcctaaatgtggctgtaaccctgacgtgagagtcgctcccgcccctacctacatcccacacatttcaggagtcccctacgtattctacaaaacacagaacgaccatatgagccacttcagtccttctcagcattaggtctaatttccggagagccctaactgtcctgtcctgcctacattgcctgccctctaacatcctgggaatgggaagtaacactgggatcggtggcggcagaactgcggaccctaacaacttcagattgttgaaagggggaggggagaatggaagagaggaatggaaaggcaaaagaaaaaacatttgtgttcatttacacatttcctgtgcaga

SEQ ID NO: 11020 - DNA, 96 bp, Homo sapiens
attttgtctccccatgttgggagacgatatcccagccgcggtggtgctgccgctttcgtgtgactttgggtttcccgagcgagcccgcagctgcac

SEQ ID NO: 11021 - DNA, 499 bp, Homo sapiens
aaaagctctggccaaggccttattcttgctatttgctgatttatttgttcaatgctggtctcccacactagaccatgagcaggaaggagaggcagcatgcaactgtgctcgttgtctacacagggcctagcactgggcctgggccagggcaggcacctgggaggacctgtctccaaaggcaggaggacatttaaaaatgcatgggtctctgctaggtgacacatcctgcttaggagtctgctggcctccagtctgggacaacagagcacttcaaataggcacctgtgttcatcgcggtgctttctgtccacacagggctttggtttctgaggctgagagaggataagctaagcaaggggcagaacaggacaccaaccatctccagaccccagtacaacacagatggcaggccaaagagggactgtgtcgtctgattcaagagtacagactacacagccagaataatcggggcctggcttggactctctttaaatattca

SEQ ID NO: 11022 - DNA, 80 bp, Homo sapiens; identical to SEQ ID NO: 10797

SEQ ID NO: 11023 - DNA, 452 bp, Homo sapiens
actttgtggcctggcctctctggatgggggtcaagagcccatcacatctttctccaggggtgtgtgtgtgtgtgtatgtgtgtttgggggggcgggttcatgaaatttagcattgcctcacaatgtcagctttcagctcctcaaaaaactacatgaacgagttggccatacctgcgtacttccccctggacttagcttgattcacttcaaaggacaaatccatctctgagcaattctcaaggcaaagacactcagccagacgaaaaggagggtgagccctcctacctctttcggctgacactcaggggagcttgccatcatctgactggctgccaacaggccggtggacaggggctggggttagacatgtgggaaggaaacagtcaccttgttttcctgccttggatggaattggcagaattccagttattcsctaccggggctctagctca

SEQ ID NO: 11024 - DNA, 418 bp, Homo sapiens
gaatttgcctttctgcctgaggcaggatgtcccatgaccactttagcctcttgttggaaaacaatgaagaaaatagctaccattaatggagctcctgctctgtgccagggactgtgccatgtacttcactctgagaagcaagggccctgcttatccccatttgaaatgggagaaagcctctgattaaaccgcttgcccaagtctcctggcagtaagtggtggagcaggatttcgtcccaacctcatgctgtttccacatccccacagtggccccgggctgtgctccttccctggacctgagcttcactattggaccagatgagcctctcggatccatcccagcctggcacgtctagatcctgcctcccaacgcaggctgctgagatgttcacttgaatctctcaccatggacattacc

SEQ ID NO: 11025 - DNA, 497 bp, Homo sapiens
tttattcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttctttattctatcagatattcattgtcatgcagtagtagtaaaaacatcaaagatgcagcaagcttattaagtattattttctaaaagaaataggaggcatttycayctttattattgtacttttggttatgcaaacactttgataatataaacagttatgtcccctataaatctggtcagcaacctcttttgatttt

SEQ ID NO: 11026 - DNA, 470 bp, Homo sapiens
atttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggatacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaaatgcgtttagatcttggatgcagacctttcaaagggttaaatgtaa

SEQ ID NO: 11027 - DNA, 482 bp, Homo sapiens
aaccttcagcccccagggcctctgaattggagctcagcttgtccccgcccagcttctacctaacttgatggactcagcgggtggagcttatagatacaggctcctccccaggacaaaagccccagctggtctgaaaacagtctttaactgagagccacatcccagcaaatggccttcatggatttgaaaatgggatcagagttcttgcagagtctccagtgctaccgcgagagggcagtcggatgggtctggtcccggaaaagaacacaagaggaacccaatctgaccttgcacgcttcttttaaattgaaatggtaaaatatatcttctacccctgcacctctcagtcggctaaaatgaagggaaaataacctaacttcattagtttagaagcccaagccagcaactctgaaaattgctattcccttgtaagattatcttttctggactttcataagggggtcttcacagagggtggacta

SEQ ID NO: 11028 - DNA, 498 bp, Homo sapiens
agatttctatgccaaccagaagatggatggatgtcaagacagatggtggaaaagttgtgagatgcaaagcctcatggtacagcagtcaccttgcaatcatgaagataaaagccacaaagaatggtagctcagaaggtggaaggactctgcatagttgaagacactatgattagatgtatcagccctggacttaagtacctctgcttttcttaataggagaaaaataaccctcttccttccttatgccaatcttctcgagttccttgctacttgcagctgagtccactcttgactgatatcacctaatctcagtcgctatcagattaaacaacagcattactttcagagggccaccaagaaaaaattgcctgggagaagagtaaggagcctgaagatctgactaactttctctgtagccctttaccgaatagcagattagctgagctcatatgatcgtatcaactagtcatcaccttgattagaacacagaagaagtaa

SEQ ID NO: 11029 - DNA, 479 bp, Homo sapiens
ctgtttgcctgtgaccctcacaccttgttcttcagggttttaatgattttctgttaacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagg

SEQ ID NO: 11030 - DNA, 357 bp, Homo sapiens
  misc_feature 118: n=a, g, c or t
taaaggtgtatgtttttaaatgtatcatctgtgtgtgcccccattaatattcttatttaaaagttaaggccggacatggtggcttacaactgtagtcccaacagtttgtgaggccgangcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatc

SEQ ID NO: 11031 - DNA, 470 bp, Homo sapiens
acttccctttggagtattagaagatctttatggtgacaaagaggcactctttgaccagaactttatcaggctcctccgcgtccttttagactaggtctgaccttgtgtttccctctctttccttgtggaatccagcttgagcaagaatcttgctgagtccttaatcaatagagtcccacccttgggatctgaccaccctctgtgtctcgtcaccctggcttgacctcagcacaagtctcattgagtgggtctaacaacattccccttgtccctgtgattcctcttagtaattttccatcaccgcccactgcctacttctaggctgcaaatcccctcacccatgctgtgctcagagttgagcccagcctctctccccacagcaagccctcgttgcagtggtccctacactgatcaccatgcaccccctgaataaagtctgccataccattttttaaaaaaaaaaaaaaaaa

SEQ ID NO: 11032 - DNA, 416 bp, Homo sapiens
  misc_feature 59: n=a, g, c or t
acacaatttgacccataatgaaggacaatgatgccactgggtcatagactgacttcttntgtgaagacgataaacgcacaccttccactgcagcccagaagggtcaatagaggaagcaatagcaggaactccttttcatacatcaaaactgagcttatcacctctaccctgaagtcatcctggacatcactggtcccagttaatcactcacttatctttgccatccttgacctgggaagagaacgttgccctcattggtctggaatcagcaggtacctcatggctggaggtgtattttcagatggagtctcamtctgtcactcaggctggagtgcagtggtgcgatctcagcttactgcaacctccgcctcccgggttcaagtgattctcctgcctcagcttccccagtagcaggg

SEQ ID NO: 11033 - DNA, 414 bp, Homo sapiens
  misc_feature 168: n=a, g, c or t
tactcctcaccgcgcgcgsgsggaaccagtagccgcggctgcttcggttgccgcggtccggtggtcgttatggattctccatgggacgagttggctctggccttctcccgcacgtccatgtttcccttttttgacatcgcgcactatctagtgtcagtgatggcggtnaamgtcagccgggagcagctgcattggcatggaagaatcctatttcaagctggtttactgctatgctccactgttttggtggaggaattttatcctgtctactgcttgcagagcctccattgaagttttcttgcaaaccacactaacatattactggcatcttcaatctggtatattacatttttttgcccgcatgacctagtttcccagggctattcatatctacctgtttcaactactggcttc

SEQ ID NO: 11034 - DNA, 484 bp, Homo sapiens
  misc_feature 480: n=a, g, c or t
aacagatatggtcgttctagagtggttcttcatcttgggttgctattaatgggcatctctgcaggccctctgatcaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggwtngcac

SEQ ID NO: 11035 - DNA, 489 bp, Homo sapiens
aattttgagctgaaataattcctgagtagcattaaatttcctacctccttgcagggaaaggccacaatattcttaaattttaacttgtgggcgaaaaattgcaaagctaaaatgggttttgaggaaacaaaaaatcaagaaacaatgaaacagaaaaaatattaggtggagctacagatctacaagtattgaaatcaaaggacagaagaagagtggcttatggatgatacaatagagaaaaggaaacaaaatacagaggcaacaggactatttttgctgtaacctggggatcttgcccatttcaaacgagccaaactaaagttagatgtgtttatgccctgggaaaagtgaaaggtgactcacggccaatatggaaggaggatggtggttttatgcccagtttccccatcgtctgtagagacggggtttcaccgtgttagccaggatggcctccatctcctgacctcgtgatccacccgactcggcctc

SEQ ID NO: 11036 - DNA, 501 bp, Homo sapiens
aatgcagctagtgatgctggaagtgctcccaaggagagaaatgtcacaacattacaagaaaaagttgaatggcttgatatgtaccatagattgaggtctgcagctttggttgcttgccatttcaagagaaatgaatccaggataaagaccatttttttgttttgtttttgttttgtttttaaaagaaatctgtgaagctgttgctacagctacaccagcaggtgcaaaaatcttgcactttttgtgaaatacctttttatctcacattgaaaatgcagcttttatattagtgcaggattgctattagaaaggcacacgtatagactctaatatgatttgagtaaaagcaaagtcattatatgatgacttaaagcaaaagaaaggtgaaggatctaaagctggagaatttaacccaatccaaggatggtttgatagttttagagtttggcttaaaaaatgtcaggataacagcagcttctgccaaccaagaggcaacagatg

SEQ ID NO: 11037 - DNA, 76 bp, Homo sapiens
atttttttccaaagccatggtgaamatctctgtgctaatttcttttgttttgtttcctaatttttttttttttkgg

SEQ ID NO: 11038 - DNA, 469 bp, Homo sapiens
  misc_feature 425,464: n=a, g, c or t
cagctgcagaatatgcattcttcacctcagcacgtgaamactcttcagaaaagaccatatgttaggccacaaaacaagtctcaaaaaaatttttaaatagtaattatatccagtattttctcacaccacaatggaataaaactagaaatcaataacaaggaactttggaaactgtacaaatacatggaaattaaacaacactctcctgaaagactgttgggtcaatgaagaaattaaggcagaaataaaaaaaattattgaaacaaaaacagcaacataacatactagaacctgtgagatacagcaatagcattgctaagagagctatttatagcaataaatgcttacatcagaaaagtagaaagagctcaaataaacagtttaatgatgcatctcaaggaactagaaaagccagawcaaaccangccccaaatttagtcgaagaawaagcaataaagatcagngcaga

SEQ ID NO: 11039 - DNA, 487 bp, Homo sapiens
  misc_feature 221: n=a, g, c or t
tctgtggaaaggcgaggtctggaaagcagcccctcccctgggagagagcscagggcaggcatgctgtcctgtttcccccactcsscaacagggctggcstccggctctgtcataccctatctactcctgccttcttccagctggcattccctggcagcgatggcggggaaactggcagacatgagcaggtgccatctgtatccaccacatactcctgctgntgtggtgtggcgaagacaaggctgcccagccccaacaccacgaggcaccctcgggcatgctgttgcttctgggaccagtgaccagcctgstgsscctgctggaccttaggaggccaaggcaggtgaattgcttgagtccaggagtttgagaccagcctgagcaacatggtgaaactccgtctctacaaaaaacaaaaaaaatccagcgtggaggcatgcacctgtggtttcagctactcaagaagtgaggcaggaggattgcttka

SEQ ID NO: 11040 - DNA, 475 bp, Homo sapiens
aaataactttttcttttttaaaacagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtatgtatttttattcatcatgtaaaaaagagttgtttcctttaaaattggttttggcatttcaaacttattaaccatgtaaaactattttaggtaaacttttggttcttgttagtaatttagtcattattcctatgttctggaaattttttctgcagtttgttgttcgggttaaataatattttaaatatatcawactgataacattggtaacctttggggggtcacttattggctagtggatggagtgggttccttttgattcttaaactgaatacattttataaaacattcaattgaaata

SEQ ID NO: 11041 - DNA, 482 bp, Homo sapiens
ttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccggggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcg

SEQ ID NO: 11042 - DNA, 498 bp, Homo sapiens
tatatgtgtacatttcatatatgtatgtcttaatgttttttccatgagtaaaagggagacatggaaggctgctcaccaaaccataaacagaacttaacctttttgaaagggggcctgggaatgtgaggaagatgaagagagatttcatggtttattctgaatattcatgtattctttgaatcttttatagttgagaatacgttgtattactagtgtagaaaaaaatttaaagatgtttcataataaaagagaaaaaccactgtactaaatgatctctaagctcaaaatttgaggaacactggcagttactgtgatgtagttgtctatgttaaaatatttctaattcatatactaagtgatttttatttaaattcttttgaaatattttttaggtgtggaatatcaaacaaatgattaagttgacacaggaacatatagaggccctattggacaaatttggtggggagcataatccaccatcaatatatctggaggtaa

SEQ ID NO: 11043 - DNA, 424 bp, Homo sapiens
aggattttcttcacatacatggcagcagtagtatgaagataaatctagtgtttattgctgcccctttggttaactagcagaaagctccaagttagagtctacaacagaatcacttccttcatgatgcctgtagcatactataaatgctctaaatactcaggaatgggatatcatgtaacttagtggttaaaacatgaatgttagaggcaggtggacctgacttatcagctgtacaactggcaacttatcaaacatctcttcagttttgttacctggggattatcataatttactactaagattgctttgaacattaaatgagctattcaggccatttgattaaaagggcacctggcatacagaaaagtgttcaataaaagatagtagctattaaaaaaaaaaaaaaaaaaaaaraaaaaaaaaa

SEQ ID NO: 11044 - DNA, 481 bp, Homo sapiens
aatgaccctggtatctaggtgaaatcacaaccctgtttttatatataagaagtccttgcttaaagtcaatagcatcttggaaactgcaaccttaaggaaatgatatacagcaggtcctcaagtaaaattgttttgttcaaagtccattagttatattgttgataaggaaaaacacacggtttcattataaatcatttcacttaaatcacagtttccaaaaacatattgagggtgttaattgaggacttactgtatttcaaatttaagttaattttcacagttcgtgtggaaattatttacatattacatctgtaaaatcactttaagcaggctatgtgtgacgaacttgttcacgagccctcaaccttggcttttattgacctcacctggggagcttacaaatgatgatggatgggctctcttacccagagattttgatttacttgaacctgtgtgggtctgagaggttttaaaagcacca

SEQ ID NO: 11045 - DNA, 306 bp, Homo sapiens
agttcttaagatctccacagcccctccaggasacatggttatttagtctcatgcttcactattaatggaacgctgtgctggttcctttgtgaggcatgctcttccttctgggtgttccatctgtacctccaggcttacagccacacatgagcccttggtctctgcttaacaaaccacgctctaagaaaaggtaggagacctactcacaggaagctatgacagagtaatagcggcttaaaatatgtcctctctttggagtgtgtgcctataaaacaaaatcgaaattttgaggcaaaattctaaact

SEQ ID NO: 11046 - DNA, 443 bp, Homo sapiens
atgatggccataatgcccacgctggaaggttgtgggtttaggggaaggagggcaaggaacagctggcccacccagggtggaaaaccgcttaaaggcattcttaaaccaccaacaacagcatgagcgatctgtgccttaaggacatgctcccgctgcagataactagcccaacccatccctttattttggcccatcccttcatttcccataagggatacttttagttaatctaatatctatagaaacagtgttaatgactggcttgctgttaataaatacagtgcatgcctattgggaagaggaaaagaaaaagaaaaatgaagacaatgaagaacaaaacaaatagatttaacagagatggaagacgatagtgtgtcataaactgagaaatttaactttttcctttacatctgaggttataaaagagaaagaaaatggaagag

SEQ ID NO: 11047 - DNA, 491 bp, Homo sapiens
taagaaaaatttattaaaatctacataaataataaataattttctatatgtatgttatatttcccaatgctatgaaatgaattgtgtctccccaaaatgtatgtgttgaagtcctagcccccagcacctcagaatgtgaccgcatttggagatggaaccctttttttttatttttgagacacagttgcccagactagagtgtagtggcgtgatctcggctcactgacctctgcctcctggctcaaacaattctcatgcctcagcctcctgaggagctgggattacaggtgtgtgccaccgcatatggctaatttttgtatttttagtagaaatagtagacgccatgcataaataccaattctctccaaattgatctatttctcaatctacacatattctactggtgatctcatccaaggttgtggctgcaagtacaccactacaagccaaaaaattatgtgtatatctccatctcaggcttgtcttccaaa

SEQ ID NO: 11048 - DNA, 252 bp, Homo sapiens
  misc_feature 148: n=a, g, c or t
aaactctggttgttttcttagaatggattcctgggagtcgaatcactaggtgaaagggaatgaatatttttcagctgtcaatatgggcttgcagactgccttccaggaaggttattattcacttccacttccacctgcagtgaagcgngtgcgctgcacatcagcagtgtggcttttggaatgaccccaagtttatcagaaggctcctgtggctccagggtcaactctgggcatatctgactacatcactcc

SEQ ID NO: 11049 - DNA, 414 bp, Homo sapiens
aaaatagtggagatggggtgggcagatgtggaggggtgaaagagcagttgtgaamtgagccatcaactgtgcctagagatcgctgaagtgaaggaccggagacactaaagctaagagttaacgtttattgagcatctacagtataccaagccctcttctagaaacaaatgaacacaaagttcttggcacagtgcctggcacagtcaggctccatcaagtttcatttcctttctccctgctattaaatgagaaagagggcatgaggaggtgggagtaaaggagccagaaagggaaggtaggagactggcaagaagaagctctggctgctctgggatgcaacatgcaggttcccgcaaccctcctggagtaggaggagaagctgcccctcactgaccactcaggaaggagagaagc

SEQ ID NO: 11050 - DNA, 416 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctga

SEQ ID NO: 11051 - DNA, 89 bp, Homo sapiens
aactctgttttagagaagatctcaatgttttagtaaagtacaaacaccatcaaaaaaaaaaaaaaaaaaaaaaaaaaaaaaaaaaaaaa

SEQ ID NO: 11052 - DNA, 436 bp, Homo sapiens
caaatagaattatagggagttaacagaagaaaaatacatattcattgaactctttctgtgcatggggcactgtactatgttgagtgctttaaatgtacttttttaaattctgaaagtaaccatcttactaacaataccttgtagtgaaacttaatgcattaaagaaagtgccaacttcattttcagctcctttaccagactgccatacttgggaggtagaagatggtccattcatccggaacctcttagaatgtgaggtcaactcagagttaggaggaacctttactttctggatatagagaatgaaagctattaattactctaacaatccaaggtgcctcttacttatatagagaaattttatacaaatattctgattttcaagattacctgttaaattcttgtgattatagtttttcatttgcttcatatgtca

SEQ ID NO: 11053 - DNA, 466 bp, Homo sapiens
gactcaacccctcttaatgattcctgtgtctccggcttttagaactgaagcagttataagaacatagacatattccactcagtcggagtgttcataaaggtgtttattttgtttgtttatttatgtatttatttatttatgtaatccctgcaggataattctaagttggtttactgacaactatacgcgatattaagcaccatactatatctcagcaacatgcatatgtttgaatggagttcatgaaaggcactctgtstatatgcaaatggaacatatttttctctcttaatatttgattctttctgttgtggcagacagaccctaaggttttcaatctcttggtgttaaagcctttgtgtaatccccttctttagaatgtgaactagatttgtgacttgcttctaactaacagaatatgacacacataaagcaatgtcacatctgtgattacattacactgtgt

SEQ ID NO: 11054 - DNA, 483 bp, Homo sapiens
  misc_feature 340: n=a, g, c or t
tagttttcattagttctagtcactgggcttagcgttttccatattttaccctcatagcaacctatgaaacctgtgtaggaattgacatttgatgacaaggtctgttcaaatccagcacccatgtgttacttaccactctttataattttttaaaagagatttctccttctgaataccactatttttttttgaatggcagaataagaaaaattaaaatctgaaaagctcttagaaaatactgctacaatatctggaacctagtaatgctgcttcatgtagcctctccagactcttgcctgtggsttcccaaagactggcataaacaagaggaaaagaaaantggacaaaatggggattactagtggtaatcttaactacttggtttgagcagagccctctaggatgtgtgggaggagcaggaaaggccagaggctgggaaggctgggccatgcacagttctgctagagaagaaagctgtacatt

SEQ ID NO: 11055 - DNA, 442 bp, Homo sapiens
  misc_feature 361: n=a, g, c or t
aaaaaaagatgaaaactaaaaaaataataaaacaaagccctaatggattgagataaaaaagatatctatagattggaagtcaggtgaaattgaaaaacaattatggtatgagtaatagaggaaccttaatagaccagtcttccaaaataactgaagaatgtgctggaatgcaacatcctgagatatggaggaactcactggagcagcctcattctgttcctttccttcctagaaacagaatgttcttcttcatggcctactatgccatgagatccccaagaaagaaggacctatttatttgacttgacttccaaacccttggtcccaggaaawtaaatggggccacatgatggagcaccgnttaccacgttcaagctgcagggcctaggttcattcagctaccctgatagagactcggattcctccttggtagagtggggat

SEQ ID NO: 11056 - DNA, 347 bp, Homo sapiens
acagatgtgtaagggtgggcgcggacrrgacccccgaagtccctgaggtcaggctgaggcattggaccaaatccgtacataggcatttctctgaactgcgcgccaccttttgagtgccatctgtttccgtccaggactctgatacaactatccagtccgctgcagggaccggtcactgtgtcacagtaagtggtgggatttaagaggcagttttcctcctcatgttctaccattatgaacgtctagcttgaaaaatacataccattttcataactacgtattattttgttagtgctagcatagtagatctttttcmgttattttactctgtgggggggggggggttt

SEQ ID NO: 11057 - DNA, 492 bp, Homo sapiens
tttagatgtctagggctgccataataaagtaccacaggctagatcgcttaaacaagaaacatattttctcaaaattcaggaggctagaagtgtgtaatcaagtgtaatcaaggatcaaggccatcaagctgcaaatggacttacaaatggaacctcaaatgagctcaactcacggcttctactgagaacccctggatccacctgctggtccctcactagcctaaaaagttcccctctggaggacaccacaactgcagggccccttcttcacccctaaccatcaggaagtagccagaacgactgctgccagttcccaacagcaattggtgtgtcctgtctagaggggggactgaggaggttccagctgggcttcctgggtcgagtaggggctcagaaagctgtgaamtcactcatttcctgtatcaggacttactctcatactggatgaataatattgaagatatatgcttaawatattcctaacatcagaat

SEQ ID NO: 11058 - DNA, 432 bp, Homo sapiens
cattattaccctcactatcatgaagcgccacgcagacaccacgacaaagtgagatgaactaagacctcttcttgattctaagcagggaacgcacagctcaccctgtcacatgcagcgatcataagctgagaattaccctcttccttcccacagcgtctaatctttttttatgtttttgtggcaaggtctcgcttagtcgcccaggctggagcgcagtgcgatcatggcccactgcggcctcgacctcctgggctccagcgtgcgtctaatctagaaccaaatcctccttccttagatcatcccccaaatcacccaactacaggtgaaatcctgtaatagtttcctccgaacaccctgttgctgagwsacctcaacgtctcaacctggtgtgtttgtacgtagagtaaaagacccaacttgtttaaaaaaaaa

SEQ ID NO: 11059 - DNA, 306 bp, Homo sapiens
attctggcggctgggcacagtggctcaagcctgtaatcccagcactttgggaggccgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaaaaaaaaaaaagkaa

SEQ ID NO: 11060 - DNA, 478 bp, Homo sapiens
ccaccatgctttgaccaaagtacattcacagtaactagagaaagcagatcatccatttctggataggtgaactacggcaaggtaagaacagaaaaaagtaaagtagtattgagtcatgcaggtatcagattaacagacattcattgaagataagtgaaataactttggagatagcagagaagagcaagaagatgttggacgttggcagtaagccgcagcaaggcagttaggaaagtacgtgagcctgatgacgcgaaggtgatgcctccatctgtccgcttagtggttattaaattgctgggaaagacctgcctttattttcctatcatcttttccccattactttgcattattcaggaaataattatttattcccaaatgcagttttctaagcagtgaccacaaaaatttcttattctaagggraaataattaagaaaataaccctatctgtggcattgttttaaaatgtgggatac

SEQ ID NO: 11061 - DNA, 436 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgavactgtgcctagcctgagccaccacgccggcctaatt

SEQ ID NO: 11062 - DNA, 500 bp, Homo sapiens
aaaataggtgcctgataactcagttaacttccctcttggcttttccctttgaccttaacacttttggggttatctctgaggcgaatgctaaaggagacgctccaggactcgacctctgaaggtccttggagccaattccgtaatatgatcatggaaactgatcattgcctgatccttctaccgccttggscgctttcttgaggaatgtctttggttaatggcttcacggccatggaggtgacatcatgtggacaacaggctaggatgccagagttagctgctcggtggagatcatttgagctccgactcagattttgaacggatgtttgcatgtataccacagtgctacattaaaaaccagtcatgtggatgtggagaagggtgctgatcaggactccctgtttgctaacaaattctacagcagaaacaaagtattaaggtttgcagccaggaagcaagtgcatggggaataagcctgcagcttcttccaaatgagacag

SEQ ID NO: 11063 - DNA, 85 bp, Homo sapiens
attctagagctgaacctggtacgctcgcccaccaaactgccgtgctcggggcttagtatctcacgcgcggcagttcaagaacatc

SEQ ID NO: 11064 - DNA, 337 bp, Homo sapiens
agcaacccggtgggtcctcttatgtggtgtgaaggcttagttcctttgctcttcggaataaatcttgctgttgctctgtaatctcagtactttgggaggccgagacaggcagatcatgaggtcgggagatggagaccatggtggctaacaaggtgaaactctgtctctactaaaaatacaaaaaagaattagccgggtgtggtggtgggcacctgtagtcccagctactcagaaggctgaggcaggagagtggcgtgaacccaggaggcggasttgcagtgagcccagattcctccactgcactccagcctggaccacagagcgagactccgtctca

SEQ ID NO: 11065 - DNA, 468 bp, Homo sapiens
acacagcagagaagactaataaagtgttcacatcagattcttccaacacacttcttcaggtcctctgggactcacctggctccgaatccagttatctttgaggtgaccagtcttgcttgggctccagtcaccttcatgcaggtggaatctggtccgactttgcttctgtcttatattgtacctgtctcctcccacctgccttgcacccacgcatgtctattttgcagataagttaacttgctatggtgcaaatctttgaccagagggcaatggaacaatggataatacatgatttcccctttcctttttcctggaaatggcatcctgagatacatttcttactgcttttcaggaactgttgtatggtaactgtgaaagtatgcaacaatacctacagagacagccacctgggaacacttgcatcagcaatctctccttccatgatttgcttcctgactctctctcctg

SEQ ID NO: 11066 - DNA, 484 bp, Homo sapiens
aagttcttcaggtatagtctgcccatatggggatagctcatgtggttctcttgctggtggcataaagtttctcaccttgggggtgctggtggtttgccaccaaaggcatgggggatctgtttgcctctccagacagtcctcttgtttaggatccaaggtgatctcagcctgccgtctcttctctgtggctgatatctgatctatgggaaacactcaagctttctctactctgactgcctctgggtgaactgtctgatcacagtgcagccatccctcttttattccactggagaggtagcctgctagcccttactactcaccctttacgtggtttatgcatgagacagacacccgaccactgtgaccccattttcagtccacacctattagagtggaccatttatgccagcttcccttgatttcagataaaggaaaagcacccacaacgcttaccccatggtgggagtgggactctcagcacaaa

SEQ ID NO: 11067 - DNA, 531 bp, Homo sapiens
tctttgcgtctgcgtagttcgctcacctccctttctaactccgctgccgccatggctcctgtgaaaaaagcttgtggtgaaggggggcaaaaaaaaagaagcaagttctgaagttcactcttgattggcacccaccctgtagaagatgggaatcatgggatgctgccaatttttgagcagttttttgcaaggaaaggatcaaagtgaacggaagaagctgggaaccttggtggaggggtggtgaccatycggaaagggrcargrscarggwtcaccgtgtacatccgaggttgccttttctccaaaagmgtatttgaaatatgctcaccaaaaaatatttcgaagaagaataatctacgtgactgggttgcgcgtagttgctaacagcaaagagagttacgaattacgttamcttccagattaaccaggacgaagaaagaggaggaagacgaggattaaaatttcatttatctggaaaattttgtatgagttcttgaataaaacttgggaaccaaaaaaaaaaaaaaaaaa

SEQ ID NO: 11068 - DNA, 483 bp, Homo sapiens
aatgtgaatcacttaaaagacatttgttttcctgtaataaataaaagattagtaattagttttacgtttgctttcaagggattctggttgtatttattgtcaactaaataactttgatcaaatagccaagactctaacatataggcaagagtttgtagggaatcgtgagttgcttggcttatactgtgttcttggtgttaagtattaacaggaatatggcctggtaattagaacttgtccatcagaattgccaaaagtgggattcgggggtctctgcctatggaggatgtggttcagaaataaagaatttgaataggataagctgtaggaggatcttagtatgagaatgagtatctgaagattagctgtgagagagggcagagcgatggagggaacaatgtgggacagtgtgaagcatgtgatccaggggccataactttttttgttactatttttttaaatcagaaacttagatttcagtgt

SEQ ID NO: 11069 - DNA, 312 bp, Homo sapiens
cacaacaagcttaagagggaggtgctactatctgttctcattttagagaagcggaaattgaaattcagacaagtttacacacctgcccaaggttacacaggactagtgtccttataagaagaggagaagataccaggaatgcaagtgtagagaaaacatcatgtaagcaagaaggcagtgatctgcaagcaaaggagagaggactcaccagaaatcaacttgctagcaccttgctcttggacttctagcttatagaagtgtgagaaaataaatttcttcggtttaaaaaaaaaaaaaaaaaaaaaaaaaaaa

SEQ ID NO: 11070 - DNA, 488 bp, Homo sapiens
actttgattgcttttctaacaggctgtaaaactgcggagagtctgataagaaatccaggctggaatgcaatgcggatctccgctcaccgcatcctccgcctcccgtgttcaagcgattctcctgcctcagccccccgagtagcttggattacaggcatgcgccactacccccggctaattttgtatttttagtagagatggggtttctccatgttggttaggctggtcttgaactcccgacctcaggtaatccacccgccttggcctcccaaagtgctggaattacaagtgtgagccaccgcgcccggccagcaaagctacattttataccaacccgttaatttctttctcagtacctgaggaatatagggaaagcaacagaatgggtgatttcctttaccgtactcaattgaatatagagtttatcatatgtatttttctaatacttgtattattgtcttatgacaattaaaacaactaaccatgca

SEQ ID NO: 11071 - DNA, 253 bp, Homo sapiens
aatatagagtgtacttacccaaacctaaacagcacagcctactacacacccaggctgtaggctgtgcttctagactacaaacctgtacagtgtggtactgaacactgtaggcaactgtaacacaatggtgtacctaattcctctgcctagaaagtgtgctggaattactgcctggcttctgatgaatagggcgtattgagagtgatgctttgtgagttctgaggctaggtcatagaaaggattgaacttattc

SEQ ID NO: 11072 - DNA, 398 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtga

SEQ ID NO: 11073 - DNA, 499 bp, Homo sapiens
aaggaccagcgggaaagataaaagctggggtttagtctgtgctgcgtgaaatatgtcttggcctcacttcctgtcctctgagctgcctgcaaccgggcgaggtggtgttgaactgtgttttttgtgacgaagcttacttttaagtttcatccctaaactaagttgacctgtttctttaagacggcttgcaaaatgtgttttcctcaatgtgggatatggaaagaagcagttgctcctgttattttgagctagtacctgacgctatgagaaattctaaaagagcgaatcagatcatgcaacatgaataactatggaggctgagtgatcaagaacagaagttaatattttggtgttacaaactttccacggattaggtgaataagatatttataatttggtgtgttcatctcaagttatggattacgagtgcggggcactagtgctttagattggtaaatgaatcatcaacagtcgccttgaaaatcgaatatttttgtca

SEQ ID NO: 11074 - DNA, 401 bp, Homo sapiens
ctttgcctcctgccacccacataagatgtgacttcttcctctctgccttctgccatgattgtgaggcctccccagacatgcagaactcaagaagtccctcaccagatgccaacctctcgatcttgaatttcccagcctccaaaactgtcagcttttactggatatttttgaggaaggaagagcaagcagctgtagaggaaggaaacaatgaagcacctaagtcaggatttcatggattttcagcaatgtagacagaacagatgaaagcactactggagtaatcagaatgagaacggtgattgaagagtgagatgtggcctaaaaccatatccatgtcatgattcattcacatttgcatgtaatcatatttgcattctaccatcatcaaccaaactgagggc

SEQ ID NO: 11075 - DNA, 444 bp, Homo sapiens
agtttgagctgaattttcgctttcagcagccgcatttgtagcagctcttttgtgatgacttagtctctaagcccgtgaaagaaaaagaaaactctcggtggcaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggcaggttaaccacaacaaggaaaacaccacaaggaccaccagaaatctacagtgatacac

SEQ ID NO: 11076 - DNA, 448 bp, Homo sapiens
ttcctgtggtataggggaagcgctccgggcctggaatccctacgcgtccctttggtttagcacgatgagctcaatcggcactggggtgagttcgctgtctgtcggtgtaatagtttaacctaaggattggggttgaagggaactcggacagaccacatggggttcgcggacccggggtgctctgagaccgccttcggctgggtgggccatttgcagctgtttggagaccggtcgtctttatcccctatatgctaggcctgcgtctcaggtgaccgtgactcctgaagcttttcagcgcaggtgtagccgkcttggcgtcgcgcagtgaggtttggagccgctttggattgctgagtcactttcttcagccacttagggaaaccgaaagtggaaactcgtggggcttgaaatagtgtgttctcttgagaaccaccgaggcagtgagatt

SEQ ID NO: 11077 - DNA, 482 bp, Homo sapiens
actaggaagagacttgtgccacccggggcaagaacatcagagatccagtgacagcccagcgacctccgggatcaattgcaatgggaggtgtgttttatggaccatgtgctgctatgtatgcctgaagaagtacttgaaatgcaaatttggggagactttgccatataaatgcttggctggattaagcgcttaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagggtcaaagaattgactgtagatccaactgctgctggtgatgttcgtccaataatgcaccatccaccaaaccagattgatgacttagagacacagtggggtgtggggagttccctcagagagatgatctaaaacttctttgtgaacaaaa

SEQ ID NO: 11078 - DNA, 273 bp, Homo sapiens
actttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaaaaaaaaaaaaaaaaaaaaaaaaaaaa

SEQ ID NO: 11079 - DNA, 331 bp, Homo sapiens
aatagaggcctcagctaccctggccaacagcaccccccaggcacactgcagaagctccctgtgcccatggggccatctcggcttgtccgtggccctcggcccagggcatgcgttccccctaccgcagccaggtatgggctggcccaggccccgatttcccaggatgttcaagtgtagccgcagaagatatcaacagggtctccgaggtcgaactgccagcagtgcagccatcaatcctgccaccagggccatgggtatcaacaacacccacacagacaccaccatagtgtggatcttcccacctcaagttctcagacatctcaggcaacct

SEQ ID NO: 11080 - DNA, 391 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattaca

SEQ ID NO: 11081 - DNA, 488 bp, Homo sapiens
tattctggttttacataagaagtatgggagcttgcccatttttctctgaagtaagaagatttgggcccagcagtgaggatcagacgtcaggcagtgtggaagactgaagccatccacagagaactgaaaatagactgaaagctgctcacagccaaagccagaaggaaactgcagtattgacagagagagagaaagaggagaaagaaacagactcaaatcactcggggcaagagagggtttgctggtgtggaaaccgggtggtggggaggctttcagcagaatatcaggaggggacttcagcagggacccaaggaaagacgtgaaagaacagacactatagaaaaggtgaacccttttgatccaatctcactgtaaagccaaaaggagtgagtactgtttgaagtgaccctggcctcattccatattggtgctctgcctgttgggtcagccagctcttcggctggtccctgatttggaagttacgtctt

SEQ ID NO: 11082 - DNA, 258 bp, Homo sapiens
agaatcagatgcctgtgaagtgggccctggcttggaaggggaagaggatgtgctagccccccagttgaaataacttggatcagactgctctttggaatcaggaaggactttctgtagataatgataagcagaagaagttataaaagagaactgactgggttggctaacctcatacaaataagttgttttttgcatgtaaatgaaataaatgaaaagacaacaaaaaaaaaaaaaaaaaaaaaaaaaaaaaaaaaaaaa

SEQ ID NO: 11083 - DNA, 468 bp, Homo sapiens
  misc_feature 187..188: n=a, g, c or t
atgaacagtggatgagcccttgattggcagccatctcccttgggatgtaaacgtgggtcaggacttggaatttccaacttaggtaggcagcacactagattatttctgctttacttttatttctctaaggcagtagcccttccccctcaaaaaaaaaactatctgtaaccaccacaatgaaaaaasnntattgcacagaagaattggaaagccaccattattatgtcacataatcaagacaagattctgaaactcgattgaaaaagatgaacttgtttccaaccggccttctgaaggataaaagccagtctctcttcgtggcaggcaactagctggttattcctctgattgcgtcacaaagggaaatctgtatattcaccccagatttctaaaagaagcaagaaacttcaagttcacaaatcatctctcaaggcaggtgccctgtatgacaaccaasgttatggccct

SEQ ID NO: 11084 - DNA, 339 bp, Homo sapiens
taggaacaccctggagaggctgcaggtccggccacgmgcttcagctgagccccggtctgctccttcagcctccttgctcttgttggagcacaggccccaggcttcctgccagggccccgattcttcttatgtcctccagccccgccctggcgtggacatccactcactccttccagcaataagaaccgtccttggtcgtggagagtactgtgaaacaaaccaatgcacttaccaggaggcacaagactcttgaagaagatgtaaaatgaaccttttttttttttacaaaaaacaaaaagcaaatattcataaagagaaataaaatgtaattttaaagta

SEQ ID NO: 11085 - DNA, 488 bp, Homo sapiens
aactggctctgctcgcttttcattctgtgggagctttgttcttttgctttttgcagtaaatcttgctactgcttagtttttgggttcacactgcatttgtgagctataacactcaccgtaaaggtctgcagcttctctcctgaagccagggagaccactaacccaccagcaggaaagaacaactccggacccgccgccttaagagctgttaacactcaccgcgaaggtctgcagcttcactcctgagccaacgagaccatgatcccaccagaagaaagagactctgaacacatctgaacatcagaaggaacaaactccggacacgccgcctgtaagaactcttaacactcaccgcgaggtccgcggcttcattcttgaagtcagtgagaccaagaacccaccaattccggacataccttcatagtaagtgccctatacagatgaaccattttttctcttttatactgtttttattgtacttgtcctat

SEQ ID NO: 11086 - DNA, 478 bp, Homo sapiens
aaaaatgcagggagaacccaattacagggacacgatttccaaagaagacataagaaactgatcatagctgatcatcacctcaatagaaaaattcctggaactgaacgaagaactgagattagaaatcaaaaggacaaaaccagtcttagtttatgcacagaaattaatgctaagtttcataactgaacaatgcttaaatttcaaagaaaaagagagaacctctgatgaggaaaacggagcagctgtggcctcaaaaaggtgggcgctgatggctggacacaggccaacatgtgctgcccagctgtgcccttaaagctgcaggaggagctataagaacatgaagctgtttcctttsatgacccagccccctgccctagggcaagtggcctagcctagcctctttgcaagctgtcagccctaacagtttaacccaaaaatgtaaagacaagattctgtttccagacctctgcagtcttta

SEQ ID NO: 11087 - DNA, 135 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaaaaaaaaaaaaaaaaaaa

SEQ ID NO: 11088 - DNA, 438 bp, Homo sapiens
attgtaggggaggagccggccagccagggcaggcaggggcggcctctctgacgagaaggaggccactgggctgaggccaatgaatgggaaagagccagccacgtggtgagctgggagagggcatcccaggcagtgcaaccagcgcttgcaaaggccctggggctggacagttcttggcggagtctgagcctcgggaggagccagtcctgctgacacctggatctggaacttctggcctccaggatgtgagacaatgaattcctgttgttgaacctgcccagtcggtggcactttgttaaggtagctccaggaaacaagcacaggggccctcctgggtgccctctccctcccttgcgccagttgggagcctgctcctcatggacaggcatcggcctccgttggsacctgagagtsagaagtggctggaatggtggatgg

SEQ ID NO: 11089 - DNA, 77 bp, Homo sapiens
cagaaagggctgtgtagagtagggccctgttctccttaggatgttgcttcttgattttttttttttttaggggtggg

SEQ ID NO: 11090 - DNA, 275 bp, Homo sapiens
atattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaagggacatggcttgcagtgtggcaggcataacttctgatgctaatgttctgactaatgaactaaggctcattgctcaaaggtatttattacagtatcaggagccaatacctt

SEQ ID NO: 11091 - DNA, 62 bp, Homo sapiens
aaaaaaaaaaaaaaaaaaaaaaaaaaaaaaaaaaaaaaaaaaaaaaaaaaaaaaaaaaaaaa

SEQ ID NO: 11092 - DNA, 336 bp, Homo sapiens
aagagcttcgttagacttcagtgaaggaccacttgttccctgaaggcatcttttgttgatcttgctgttcggagacaaaattatcctggaacagatttttttctatttttaggtacattgttgattgtgaamtggagtctccagtgatcttttcataaacatgccagagacggtctcaagagacaaacagactgatgttcttgccccgagcagtttaggcagtcaccctttgtgggattatgtccagatacccaggactgcattttgagaccacagcactttctagaggaaaactccagactgctactagattccttgttgtactccatggccagc

SEQ ID NO: 11093 - DNA, 454 bp, Homo sapiens
attaggatggcacaagagtgaagtgagcacacctccaggggaccgtcttcagctcggttcttgttgagtggggaagaggtggtctgatataggaaaaaacttgctttggtcaaccccgaagctgaagagatgggttttccatgagatctgtctctgagtccagtggcttttcttaccccagaaaaaccaggagaaaatgatctttcctatactgcagtctcccttgatttcactcctgtaggaggagcgatatatggtttttagttctaacttggtatctgcaggtagtgctggggggacagaggtgggagcaccactctaagccatttttatgttacaaatggcaaaacaaaattaatgcgttgacctgaaataagaatgcatgagttatagaaactcagggctgggtgcagtggctcattcctataatcccagcactttgggaggctgaggc

SEQ ID NO: 11094 - DNA, 125 bp, Homo sapiens
atttaggggcggttggctttgttgggtgagcttgtttgtgtccctgtggaggacgtggttggtgattggcagttttcgcattttttttttttttysttttttttaaaagtkggaaataattttat

SEQ ID NO: 11095 - DNA, 67 bp, Homo sapiens
actccaagtgcggggccgccgagcccactcaccccagaacttgcgctggcccacaagcaccctgcgc

SEQ ID NO: 11096 - DNA, 489 bp, Homo sapiens
actgcaacagactatggctgttagagcttagacccacactatcccatgggtgctcatccacagggatgatccctatgcaagtatagaggcttgcaagcttgggcaccaaggtagtaactctcttttagtccacacgcacacctccagtctcttccccagggtggaaacaggccacaagctggccccattagtgcccaggcaggtctggttccaggccctcatgcagactgcgaaccactgtctccacttctccatctccgccacctctctggctgcccataggtaaggctgccttattttcagacctttaaaatgtaatacatcttgaaaacatgcttctcccttaacaactgaggctactttccctacacatagcctttggggaaagctacccccaggggcatcaaagtggtttctaatgaagctagaaactgtgacatgtgacatagaagataacgtcctctcactaaagaaaacagagcaaagtgc

SEQ ID NO: 11097 - DNA, 387 bp, Homo sapiens
  misc_feature 276,283: n=a, g, c or t
ctgaggtgttcccagcactggactctgcagagctgggcttcctttcccctccctttctccatatgctgcaagatttagttagtacaaatccccagcagctgcagcctgaggctcactttcaggtgcagctggagcaactgcgtccatgggctttctgaatcgtgaagscaatcttcaggscctcattgctamggggggcgacgtggawgctgctgtggagaagcygagacagtcgtargagscttattcattcaaaccataagttttcctctgtgnctttttnccatatyctagktccctaggtctyccatttttgaatacaggstgsattatwaaccaaatttactatgaagtcctttgctgtggaggcaatgttgttccagagts

SEQ ID NO: 11098 - DNA, 132 bp, Homo sapiens
ttgtcagttacgtttattaccaatatcttttcatgcaaattctttctaatctttctacttcatggcttgctctttcattctttggtattttttgataaatgaggttttaattatttttttttttttgaaata

SEQ ID NO: 11099 - DNA, 395 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggc

SEQ ID NO: 11100 - DNA, 485 bp, Homo sapiens
tcattttcctttatcttccacatcagatctctcagcaattcatgttgatttttttctccaaaacaaatcatgaatttactgccatcatctagtccaggccactctcatgtattcacatgggttgttgtatcagtctcttaattggcctcacattatttatttgccaaattcttctttacttatcatccagagatattttatcaagatgaaaattgatcatattattattctaccttaagcacttcaatggctttccattcaacttaaaataaaatggaaatttgacatcccctccaaggctctgtatgatctggcctgcctacttcgcaacctcctctcttaccagtccttcctcttagttatgatgcctccattatactgatcttccagggcctcgaacatctaccaagctcttgcttgcctcatgttttctctatggtctggaattttacccttccattcttcatctgtggacctcttaccag

SEQ ID NO: 11101 - DNA, 422 bp, Homo sapiens
aacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagctaggttcaacccttgcctcaagaaatcagatgggaccaatttagtgtccttccacctgtgagccaagcccccatttgaggacatctatcgtattcttgtgtgctgggtctcaaatagaatttttaaagattaaaa

SEQ ID NO: 11102 - DNA, 517 bp, Homo sapiens
acacttagaccgaatgccaaaaattaataccaagcatttaatgaatctgggatactagcattgtaaatgatatcttggtacagaagctagaattacaatggcctggtacagtaagaatggaaatgggaagagaagatattcacgtcattagctttcttttctccctagggcttaatatacacaaggccatagagctagacccaggccatggaggagcatggaggaccgcaattctaaaagctttgccagcttaaaagtaagtgcatccaggaagcagctgaaacttcacgcagatttgtggatatagacatgaagggaatatggcttcctttgtagtgagttctgtctgcagatggacactcaaaccatgaaaagctcagcctacgccgggcagtcgacatcgtggctccggccagcaattcttccactagatttaatgagagcgtggaagtccctgaacaacctgaaggcacatttgaggagaagcacacactcagtcaggggaatggagccagaa

SEQ ID NO: 11103 - DNA, 304 bp, Homo sapiens
taactttaggcaagataatcttctgtgagggctgatatgatcaatgagagtaagacattagaaatacaagaattgtcctgctgctcacccatcagcattttcagtttctccttgcaaaagtagtaattaactttgtactttgagctgtatgttcagttagtgataaaccgtagataaaaagcagatttaattggctgaccccaggtaagacttgcctctctcatgtaccctttgaaggtttaacaaataaaatttgagggaaaggttgatgttacttatagggtgtgttagttagttttttggg

SEQ ID NO: 11104 - DNA, 457 bp, Homo sapiens
aatgaagtagtgttatgtcatcagaatgccataagaaattagagggggtagctgagatggccaactaaaagcagctagtgtgcactgctgtcatggagaggaatggaacctcctcaacacaggggaactccccagtccagggaagtgttcccaactgttaatttgttatccagtctcstcatgcaccatattgaaaacagagccttcagttaatcataactcagaaacccatagcaaattgtaaaaatggccacatcataaagtcttctcatcctgtatgcacactcatttatgactttacagttcttcccatcaagagatgaagtctattctttactccttgaatttgggcttagctatgtgacttactttagtggatgggacattagcaatgtgtcaggagcaaatgcttgawaagtgcttgtgcattggagtttactctctggatggtctttgg

SEQ ID NO: 11105 - DNA, 476 bp, Homo sapiens
gagtagctcttgccagtaggccgggactagctgtctcggggccttccatccgcttggccccacaggttttgttttgttttgttttgttttgttttgtttgagatggagtttcgctcttcttgtccaagctggagtgcaatggcacaatcttggctcactgcaacctccgcctcccgggttcaagtgattcttctgcctcagccccctgagtagctggggtaacagcacaggaaaaagaagataaagtaggagagggatcagtttcacattcagtcctaagcagcaacacggttgagatgtaatcataaaagcaaatatttcacccaggacatggaaaagcggcggatcaccagaaagcagagagtcaaacgctgcaasaggaagcagtaagaagacgccacgtttggagcaaggtcttatttacacctgccatggtcatcggctcgctcttttaggtctccccaacccggccccaa

SEQ ID NO: 11106 - DNA, 108 bp, Homo sapiens
atttaggggcggttggctttgttgggtgagcttgtttgtgtccctgtggaggacgtggttggtgattggcagttttcgcattttttttttttttscttttttttaaaa

SEQ ID NO: 11107 - DNA, 446 bp, Homo sapiens
cttatgattaaattattagtccaattttatataggagaaaatagactcaaagattagttttgcctaaggtcacacagctaataatttatctgaaccagtatgactcgtttcaaatcaccatgtaaaaagtgtttgggttcttcttaagtgcttatcataggttatcattccacaggagtactatgaagtgggattcttttcaattgtgtgagaataatttcatttttattctataataatgattttgaagaaatatgttagctagaaatcttagaagaaaaaatattttaataattttcaagataagaagatatagttgcttaagagagttccttggaaaaaaacccaacatcgaatatgctaggtttcacagtaaacctttggaagttccagctgagtgcttttgctgaatctctatgaaaaacaaaatccattatttttttaga

SEQ ID NO: 11108 - DNA, 397 bp, Homo sapiens
tacactgctggatctgctgtgtggacttgaccctgaccagggagctccaaaaaccggtgatgataacatgatgtaattgagagtgaaaggaaggcaactgagaggataagagaacgtaaacaagaggcagggtgaagccaagagaccagaagatgatggtcattgaaaagagattttgttacagttcaagagaagcaagcacaacatgccatgccttcatcttctgctatgattgaacaagagattaggacgcagacaacacagacttaagaggtgatcatgtgaggatacagcaataagatgaccatctataagccaaagataggcctcagaatgaatcaaccctgttgacacctgaatctccagaactgtgagaaataaattttcatggccgtga

SEQ ID NO: 11109 - DNA, 379 bp, Homo sapiens
atacaaaatggaagcctgggatagagatcatctcctaggaaagggggaggccacccaaggcctgtcagggggagggctccacttctcagcccatctgcagtaggtccacattcggggtaggcaagagcaaggcctgctggaaagggaaactgctcatcaagaaactgagggaggctgggcacggtggttcatgcctgtaatcccagcactctggaagtccaagcagcactggctccttcttagtcccatggaagcacagatcaacatcattgcccttgcaaacttctctcagcttaggagagtctactcgctctttgcacattgttgacatgaaatgaatattaaacaccaaacctcatagaggccagccctgctggcg

SEQ ID NO: 11110 - DNA, 488 bp, Homo sapiens
taggtttttaaaaagtatcttgatggttcttttctatttataatttcagactttcataaagtgtaccaagaatttcataaatttgttttcagtgaactgctttttgctatggtaggtcattaaacacagcacttrctcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcat

SEQ ID NO: 11111 - DNA, 414 bp, Homo sapiens
aaagggtgtcctgcctgggagagcatgttgtcctgcttgagagagaaaaggacacagatgaagagtcacatagggtgaagtatagagtggttgagcgccccgtctctacacttcaccttttgtatctcttcatatgtatcctttgtaatatactttataataaaccaataatcgcaaatggagccccactctgttgcccagactggagtgcagtggcgtgatctcggctcaccgcaacttccgcctcccgggttcaagtgattctcctgcctcagccttccaactagctgggattgcagtgtcatgatggccccaatgtgactgcaacttctaggtgttatgaaacaaaagggacaacaacaacagcagcaaagtttccttaatctgaataawacatatttatatttaataaaa

SEQ ID NO: 11112 - DNA, 399 bp, Homo sapiens
aagggcacactttggagccagcattttcggcctcggaaatgagacccagagcgcctcgcrrgcagccccaacctccccgcagacgacatgcgacaccgcccgggtgacccaggctcgggaatctctaggcttcacggacgcagaaccagggaagacacgcctcaatgcgcgtgtgcaactctatcccgtcctttaaagaaggccatgtggctcttcaccaatcggaatcctgctttttccctggtcccgccttattcccagacttccggcgtctcgctggccgcaaaacaaccctaaactacagggctcggcgactcccagagacttctgggtattgtagtcctaaaggttcagagcgacaagagcacgttttagtaaaaagcagcttagaataaaaaa

SEQ ID NO: 11113 - DNA, 432 bp, Homo sapiens
atattcacagtcagctttaaagctgtagtcactcctctggggtctgaataaacatggccattcttgatagacatgttgactgatggactgagagatatagatacatgccatgagatctctttatgaggaaatgaaatcagtatgtggaagagatatctgcactctcaagtttactgaagcattattcacaatcatcaagatacagaatcaacctaagtgtccatcaacagagtccttaggatgtttatacataaaatgtccacaaatacgaaktggtcttacagaactggggatagtacctctgatatcgtttgagtgaattgctagttacataccaccaaaagctatgactggaccagaggcaaacaccttgatgcaaggccacctcgtccattggttggccatgaacgatcaagtcattttgggaaaaag

SEQ ID NO: 11114 - DNA, 471 bp, Homo sapiens
acaggtgtgcgccacggcgccggctccaaagtcaacgttcttaacgtctgccttacactgtctccatgttcttacctttcatccattttctctggctcatcatcttgtccatttcccttctcagggtcaccacctccctcagacgtttctgggacagatccaagccagcagagcagctgctcgctccagagccgtggtgtcttcctggtgcatcagcgccaccgcgtgsaaaaacagggcaactgtaggaatcgactttccatctatttggagctcatcagtgcttttcttttagactcatatggcaggaacaagaagtgcacatgccaaaagaaaggcagaggactgcaggagcaagacgggttgcaaggggcgtgatgrctagcacaatcctggcccctcttcttccagcattattaagacacagtagaataatagtgtatgagttattgtgacagtagcacttttcaa

SEQ ID NO: 11115 - DNA, 452 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaat

SEQ ID NO: 11116 - DNA, 474 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaaattttttgtagagacagggtctcattatgttgc

SEQ ID NO: 11117 - DNA, 376 bp, Homo sapiens
  misc_feature 147,160,358: n=a, g, c or t
catacagattaatttaatataaatttttttttattatactttaagttttagggtacatgtgcacattgtsagggttagttacatatgtatacatgtgccatgctggtgcgctgcaccactaactcgtcatctagcattaggtatatntcccaatgctaknsctsccccctcccccsaccccaccacagtccacagagggtgatattccccttcctgtgtccatgtgatctcattgttcaattcccacctatgagtgagaatatgtggtgtttggttttttgttcttgcgatagtttactgakaatgatgatttsbaatttcatscatgtccctasaaaggacatgaactcatsatttntgatggctgcatagtatt

SEQ ID NO: 11118 - DNA, 434 bp, Homo sapiens
  misc_feature 102: n=a, g, c or t
agtttcttaaccgctttcggctgttggtcgcagggctaccgcctacagtcccagcaagcgccgggctgcggggtggtgagcagtcccggagagggcgcaabngtggacctctctgcttccaaacctatgctggccactgattctgtgccatccctggctaaggggagtgagtccagagagggacttaaggggcaagtcggggctgggcagtgagtagagtgtgacgctgcgaagtgcacctcatctttgcctaaatcgggcgggtctcagcctcaccccacctctcgctgctcagctcggtttccctccagagcatcacgcctcctccagcacaggagccgcctgctttcctagggctgctgtggaactgggcctgagggtcccagacgctgtccattgtgctgccgccctccgcgctctccagccagagcgcc

SEQ ID NO: 11119 - DNA, 457 bp, Homo sapiens
aacaggcgtcgcggtttgtcaaggaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaataagggaaacagctctgtgctgccccagaaccacagctttgtctacagaccaggattctgaaactaaaagaaaaaatactttttatcaacctgtgtcagtggacaaggatcccagctccccaatcaaccactcatccagtacctctaactggcaaaccagaagatacaactgagatatcagatgcttacacagtcattgatgttgcctacaatcctgatgttcttcatgcagcagaaaaggaccaagtgaaaaaaatcagttaattcagat

SEQ ID NO: 11120 - DNA, 421 bp, Homo sapiens
gatttctgaaatcccaagtcaatttcctcgtttctctcctctaagcttctatatatagaggataaatacatcagagttaatagttgcctaatttagaatgagaagcaactggcaactgcccaaaatgctttgacagtaaggactattccccaaatctggcgaaagtccaggcctgtttatcatacagagagaaccaccaccacacagcagccagattctgtgggatattttggggaaagcacccaggatacggacaacttgggttgtagatctggttttgccttttctggtcacgactcttgtgagcctcagtttccccacctgcaaagtgagacagaacctgctagcacctgtatgcaagacccctgctagatgtctacacgaggcatcccttttcatcatcatattcactcgtcagcca

SEQ ID NO: 11121 - DNA, 399 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtga

SEQ ID NO: 11122 - DNA, 168 bp, Homo sapiens
gatcttaagacaaaaaataaaaatttaaaaattggccgggcacagtggctcacccctgtaatctcagcacttttggagactgacgcaggcagattcacttgaggtcaggagtttgagaccagcctggccaacatggtgaaattccgtctctaccaaaaaatacaaaaa

SEQ ID NO: 11123 - DNA, 469 bp, Homo sapiens
atgaatgctagcacagtgaaagaataatttggtatgaacaagcctataaaagagaggggacttaagtgcgtctggtttaccctccgagaacaatgcagctgccaaaccaatctggaagctccgacatcattgttctataaaccccacaatctgctctgactgcaggaagtgcatttaatgggcaacatttttgatctcccctgaaaagtttgggttttgtataagtgctgttgtgagataattcttcaagataatgacttgctgaccaaatccctgaattgacctaggtaatattatttaatattgagcagtttggggcttgcttttgtttttgtttttcttttacaccagacaagatgaataccttatgaaaaatacaactagtgacaaatattagaacaaaatgttctgcttaaaggataagtgaaattattttcacatttttcaaagtaacaaaatcagatactgc

SEQ ID NO: 11124 - DNA, 338 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcaga

SEQ ID NO: 11125 - DNA, 446 bp, Homo sapiens
actttgaagttagtgagatagttgtctcttgctatagatttttgccacttgtatttcttctgattttcttgtccaggtactcttgatcatttttctctttaaatttttctttttaaaaacttcttcttattattattatttgagataaaagtcccactctgtgacccaggctgggagtgcagtgctgcaatcacaactcactgtagccttgacctcccaggctcaagcaatcatcccacttcaacctcctgggtagctgggactacaggcgcgcatcagtttccagctaatttttaaattttttgtagaagcaaggtctcgctatgttgcccttgaactcctgacctcaagtgatcctcctacctcaacctcccaaagtgctggtttactggcatgagccactgcacccagtcgggtttcataattttctaattgatcattaaaca

SEQ ID NO: 11126 - DNA, 398 bp, Homo sapiens
  misc_feature 309,329: n=a, g, c or t
aataggcagctgcagcagtggagtgacaggatagagaaacaactgtagaggagcaagagatgatggtgactcagaccaaagtggaagcagtggaggtgaggagagctggtcaaattccaggaatcatggtaattgtcttgcgcaaagaatcttcctttaatatggcagaaatattagtgtgaaagacagaggactctgaaaagcaggagcaggaaatttaagaaaaacagcaaaagcagacatgaagccgaagaaccacagaggagccaaattacaagcagtacctgaaacacattcatcacagtcaanaggaagtgaagagacacagnagggaagcgagatamtgagatgctgccaagtatcccagagtccatgatggagtagagatgaaacaatag

SEQ ID NO: 11127 - DNA, 478 bp, Homo sapiens
tatgctataatatatgcttatgatttctaaaaattatgcagtatacacaaagggcataaagtcaaaaagtgtgtctccctctgtgactttattctcataccccagaggtatataatttcttgtattcttgtgtagtctttaagaaatgttatcgtttattttatatatggctctctctctgtatgcctcttcctgttcttattttaaatgttcaagtttgtgacttggttcttgtttaacttggttgtctttccatattgccaccttccagctctaacattaatgtctccaggattccattatatggatgtccctttggagaacatttgtttatagacttttctactaaaaatattgttataatgataatatccttatgcatatatgaagattactcttgattctgcctgactggaaactttattaataaagtagacattattctattttgaggctcaccagctgtgtaggtatgatc

SEQ ID NO: 11128 - DNA, 481 bp, Homo sapiens
gattaccgttctgctgtggttagcgttccctcatccattggggtcgaggtcttgtaggtccatttggggcctattgaagattttttacgaatccatgcattttcttattaaaccttcattacgggcctggaaaatagatactgtgtttctatagtacaaatgccatcttctcagggagcccttgcccagacatccttttctaaaattgcaaccctccctttcccttaatgtacattctccctaccttcgttctcttccattccccccattcactttagactcatcaccatttaccttatacatttaacgtacatttgatgattttctgaggacctgctccgccctagcatgtaaagtccacgagcacagcrttttgttcttgctctctgctctgtcccagagactgggggagagagagaccctctcattttgttttatattgttttatactcagtacctgttttaagaagaaacaacaagg

SEQ ID NO: 11129 - DNA, 397 bp, Homo sapiens
  misc_feature 383: n=a, g, c or t
ttcttttctcctgaactacatgattctaattggaatgttcatttgcctctttttactcttttaaatgcttgtaggtggcttggggtgtgctatcgtgctgttcctactcagtaaacaggtgtgatgagttaasaagaaataacactgtttgagaactagctttgaataataatttttccctttgtacatgacctgctgaatttcggtacagtgtttttgtagctaacttattttgtcatgcacataatgtatatttgttatgcactacttttgtatatcttgtttttccaasagtgaacatttttaggcacacttttcactggggatatctctttatgcaatacctcaatttttcatattgcaaagagtagctttttgtactnttattactgagaga

SEQ ID NO: 11130 - DNA, 474 bp, Homo sapiens
  misc_feature 344: n=a, g, c or t
caaacatataacaaacaaatgatgttaactttctaaaactcaacatagataaacaaatcctatgcgtgaaaaagaaagtatgtggtcacttccccgtattgtttctaatcttcttccaagctgacatatataatctcaataataaagarattcatcctccctaaagcaaataaaagagtcctaatgaaagtaatgtaccccactagcattcagaccctaaaaacgacaaatgtgatcttagagaagaatctaatgaaaacaattacattaaacatagctcttctgtgctcagtgctcagtaagtgagcagcaggctctctctgtctagcttacagaatacaggnggtagcagtttgcaaggcgcagcgttttaatgtgattggactataacaggcaatctatttacagcatgctctggggagcttataaacaartgttgagtaatttcagccagcagtaattacccttgcagct

SEQ ID NO: 11131 - DNA, 460 bp, Homo sapiens
gaactgtgtggagtggcagcaactggaggaagcagaatgtccccgagcaagattgtcaagagaaaaaagttacatgtataaaatatacagtagaattggaagatggatctaatgagaataacactaaggaaacaccatccttcaaaaactaaaagctccttgatgagacaccaggcgaaaggcaagatgccagagtataaatgactttgagacaagaaaatgaagtgtcccagaagaggaaatgcacatcagccattttcatttcacgtgggaagaacaatatgagacaaacaacctaagattaaatgaaaccagttggattggagagatgcatttacattttaccacctggataagtgtattttcctcttgtggctttataggcttgggggctattgaaaaatatctgtctataaattgaatcaacactcattaaactcattaagagaaatgtagttag

SEQ ID NO: 11132 - DNA, 214 bp, Homo sapiens
actatagcttcagtctctaatcctcccgcctcagccttccggtagctggaactacaggcggasaccatgcgcmkatttttagtagagacgggtttcgccatgttgcccaggctagtctctccaactcctggcctcaagcgatcctgccgctttggcctcctaaagtgcttggcttacaggcgagccaccacgcctggctccagacttttktttt

SEQ ID NO: 11133 - DNA, 509 bp, Homo sapiens
aaacgttggggaggttggagagggacgtttacctggggccggtccccactagtgaagaagaagtaaaatattcacaagatgaagatttttccagaagggactttgagtcaaagatggctttttatatttgacaagtcttgtcatctgtaatgaagatcattgtgaaacagaagattgattaaagccttgtaacattggacctagattagagatttagaaaagaaagtcaaaattagtcactttagtgttagtgttcccatttcataatatttattctttcttctaaatagatttagggagtagaaattaaaattcaatgctataccaaagggtatactaatatttgtttggstttttttccctttttgtgagggagaaaaaagtagataacgaaaagctatagtcattcgtaatgaaatatactaaacagaattttatgatgtcagttcttggcattatatctacgtaactgatttaattgtggacatatgggtatctgtcagattttc

SEQ ID NO: 11134 - DNA, 312 bp, Homo sapiens
  misc_feature 198: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccanaaaaaatttagccaggcatggtggcacatgcctgtagtcccaagtagctgggattggaggtccccaccaccatgcctggctaattttttgtactttcartggagatggggtttt

SEQ ID NO: 11135 - DNA, 469 bp, Homo sapiens
agtggatggcttgactccaggagttcaagaccagcctgggcaacatgacgagaccttgtctctacaaaaaatataaaaattagctgggtgtgatggtgtgggcctgtagtcccagctayttggaaagctgaggtgtgatgatcacttgagctcaggaggttgagactacagtgaaaagagatctcgccactgcattccatcctgggtgacagagcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagrtgttgaaaccactgcccagagtgacaataaaatcacatggtccattattcgtgagcacatgggagacatcctctataaactttcctccatg

SEQ ID NO: 11136 - DNA, 495 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagattttgtcacc

SEQ ID NO: 11137 - DNA, 53 bp, Homo sapiens
ttttctacttgtctatgaatgacaacttgaattaagacaacgcaggctgaaaa

SEQ ID NO: 11138 - DNA, 468 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactagcttcataagcgarggagaaataaaagcctctacaaaca

SEQ ID NO: 11139 - DNA, 415 bp, Homo sapiens
aaatctgcctcacgcaatctctgaaacattaacaaactagaaatgagagagatttctgcaggtgctttcacaaaacaacattgccatgagctaagcctactctgtaatatgaagttatatttcatatgtacacatatatatcccatccacatatattcgatttacatttttgaaaatgacacacatgttcaatcaaattaacaagattaacagaagaaagtttagaaaatttacacagaaagtacatcacatttttctaataatcattttgatagagcagcttagaatctatgctttcaacaaagcaagaagcttacgtaagagaaaaccaccacaaaacacgagattttcaatgtgatcatcactgctactgttaactagaaattacccagtaaatgtattgtgaactgcgaaa

SEQ ID NO: 11140 - DNA, 102 bp, Homo sapiens
aaatcttactgtacttgaatgtgccctgttttgttagcacacctagacttgctgtaactgtactcatgtcccagtatgtacgttctttctatgaaagagaaa

SEQ ID NO: 11141 - DNA, 121 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaaaaa

SEQ ID NO: 11142 - DNA, 437 bp, Homo sapiens
gcgartcaaactgttgctgtttgctgatgatgtaatcatatacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccacagattcaatgcaattcccaccaaaacaccaccatcattcttcacaga

SEQ ID NO: 11143 - DNA, 439 bp, Homo sapiens
agaaccttccgacagtatgtctagaggtcagtttggacagggacaggaacctctagacatgtttttctgggtgaacgagataagcggagaaatcacctaccccccgcagaaggcagatgcacctgctgtttctcctgagagcccacaaaagaagcccccatttcagcccaggagtgtgcaggaggctccttgcagtccccagggcccgcctgcacagaggcctgcccttgcacctccatctaagccttctctgaaagactcaggctcaagaaacccctgcccatctgcacccacctgggccaggccaaagccggaggagtgaggagcccccaccgttctcagcaatccctgtcaccatctcatcaccaggagtgactctgcccatactcggacccctgggaccagcccttcagccaccggtctcgacctctcctctcag

SEQ ID NO: 11144 - DNA, 540 bp, Homo sapiens
acatccatacccacgcttattaaaaatacatatccccctccacactagctttttcttttaataaaaaaaaattgaactcttaacaaagcgccagttacttattccacagacagatgaacttagtattttgtttttgatttttcattacaagaacaaatatcttttggttattttgagtatttatgtgacatttatttggaaacagaacatgttctcgtgacaatgaaaatattttgtatatgatacaaaagaaatttaaatgttaatatgaaacttgttctagcataatatactaactatactcatttgggagttaaggttagagcatcttttgagaatgaactgatctatgatgatctacaagtatatttttgatagagctgaaggttaacacttctactgccaacacttatgtattttaatgatggaagtttaaagtctttcatggtatttgaacttttctttgacttaggcacattcgaaatttatatctttttttgggctgggcacagtggctcacgcctgtaatcccagcacttt

SEQ ID NO: 11145 - DNA, 449 bp, Homo sapiens
cattggctgttcagaatcccagcacttagacgtgagagaactacacaggtttagagctggaaggacaggtgtgaaccacatatctgaacaatagcaaccgtgatttgtcaggtgccatgttaaggactatattacctctttaattctcccaaccacccaacaggataaatgctactatgatcttcatttttctgatgaggaggcagaggcatttggagatgtagtgggccgaatcattgccccctaaaagctatgttcaagtcctaactcctgggacctgtgaatagggccatatttgaaaataaggtctttgtaaatgtaatcaagtatctcaagataaaatcatcctggatttagattgggccctaaatccaacaactgatgtctttataagagaaaggaagatctgagacacagagaagacggccatgtgaagacaaaggcagatc

SEQ ID NO: 11146 - DNA, 481 bp, Homo sapiens
aataaagggtgtctttgtcaattcattcagtactaagagtgtttttgcacctagcatattttactttgttatttgtcattatttggcattcacaaattacagtttttacccagtgccttgtcatgagttacgtctaaagagagtaaatcttgctgagatacttggcatctttgagttttgagacggtctatttatgttaatggagtatcactgaatattaggttattttgattgtgcattctctgttacacattttatatcgctttaattttatttatggtgctgtcacacaattttctcttttcatcttatgtttttttcctgcaaacctgaggttgatgagtagctagggaaacaaaaagggagagattatgtgagcgtgtgtgtcaggcacagtgtgtccatatgatgggaggcaaggacagaggcagaggggacagcaagggagagawatgaaaatgatacagtgtgcagctgggcg

SEQ ID NO: 11147 - DNA, 273 bp, Homo sapiens
acaggattagcacatcagaacaagccccagaactgctgctgaacccgaggtcctcccccaggccctgcatccttcagaggcattctctgcccatgggcttgcactcccagaggaacacagtctacaagatctagcatcatacttatttggaatacactggatgtaagaaaaaagaagaatgtscaatgccaacactattgttaacattatataaaaggtactaaccaagagaaatataagagaatgaaaatgagagttaaaaacgtacctagg

SEQ ID NO: 11148 - DNA, 240 bp, Homo sapiens
gagattatgcatctggagtgggaagaagcaacacatcaaaaatatgaccagaccatccacggcggctcatgcctgtaatcccagcacattgggaggctmaggtgggaggatacgtggagcccaggagttcaagactaccctgggggctatatggcgagacatctttattaaaaaatgataattaaagttcaaaaaaaaaaaaaaaaaaawaaaaaaaaaaaaaaaaaaaaaaaaaaaaaa

SEQ ID NO: 11149 - DNA, 362 bp, Homo sapiens
acctcactcaggtactaggcaaagatatatctcacaaccacatctgtggaaaggtccagagaagagcttaacaattccacacatgtcctggcttcaggtggagtggctcacacctgtaattccagaactttgggagtccaaggcagacagatcacctgaggtcaggagtttgagaccagcctggccaacatggcaaaaccccatccctactaaaaatacaaaaattaactgagcatggtggcaggtccctgtaatccaagctactcagagggctgaggcagaagaattgctcgaacctgggaggcagaggttgcagtgagctgagttcacgccactggactcaagcctgggtgacagagcta

SEQ ID NO: 11150 - DNA, 491 bp, Homo sapiens
ttttttcttaaatatcaagctgttctttgaacagggaatgaacatgagtttttgtaacgtgactgaagttgagtttaagtaggaagcgcaggaagttcccaagtgccaggtgtgtgtagctcagagttccttttacagtgaggtgtctctcactgggggagcttccaggatcctgagcagactggacacaatcatctctcccttcctctatgtcaagcactgttacaaaagactgtgagcaaatttccatctaaatattaataattctgaagaagaggcaaaactgttgaatgcaagcaatacctattgttgaagaaacccacaaatttctgattctaagatcaggggatacaacaaaatctacaagtcatttcaaatagcacacaggaatcaaactttggtaaatcatttctgaggcacaattaaatatattgtagcactatgttaattaattatattaaatgtcgattcatcttgaaaaaaaaaaaaaa

SEQ ID NO: 11151 - DNA, 438 bp, Homo sapiens
  misc_feature 34: n=a, g, c or t
acaatgattagtaaccaccacatgtccctgcctntcaaggaaatccctcccgccttgtctctagacagccaagtcccacggcctgtcctctactcttccagaatcctgttgttctgacagcagggagggcaaatccatgcagcatctcccgccatgacctccagcctgtagaggagaggcgccacaggacctttacaggcacgccgctgttcccctcacccatgcatttcttaatgccttggtgaggagaatgcctctgggkcttccttggtgggagctaaaggwacaaagcctcgctcaattatgttttgaagagtacacagagactgccaggctkagggacgatgcaagagaatagaagagatgctcacagagaaccacagaccacacggccctagagtcaggggcagcaccagccactgtcagctgctcatttgt

SEQ ID NO: 11152 - DNA, 98 bp, Homo sapiens
cacctgctccccgaggctgatcgttaacagccgtgggcaggggttgggccagggtacagctgtcaggacctcactggacaggaccggagaggaccccg

SEQ ID NO: 11153 - DNA, 503 bp, Homo sapiens
atttcatcatgagatttggaggggacaagcatccaacccatatcaggagcccatcatcttaaattatgtggaggctgggttgctattttaatagtttgctatccttatttttccttgttttttcagatgttgtcttctaaggcattcatttcaaagcctattggtcttgtccctttagcaatgccaaaggtaggaaatttcactttgcttttcaaagttttttagttgactttgtagccttttaccctgcacggttttaaaattcagcaaatatgctgaggggagataccacctttaagcttgaggtccttgcgtgaaactttttaggagaattagtctcctagtgttgttattccagccctgtgtgaacaccaaaagctgtcctggcttctgtgttcctcagcaacaatattttacacaggtcaggcctcaattttcagcctctaacccaagcaataattaggaaatactcccagggaaaagacagatactggtcatctaaa

SEQ ID NO: 11154 - DNA, 479 bp, Homo sapiens
agttagagaacattagcagcagcaaagtggttatctcaaaacagatacataataacttcttagtgatctgcacccactgtgtgtggcccattcattacaaggcaccaaagctttagcctattgtgtttaattcccttaaagttcatgtgactgtcaattcctgttatccacaatttagagaaaaattagaatgcttgaggaaacaaattttgaagtgaccaattttattgtaccttaatgccctgtcacatggctttgcttagttcactaagggaaaaaaaatgtgtgagaccttggtgttttatgtcctactgtaaataattatatcgatttgaataacatctggaaaaatcttgaagccctttacttgaaatgattttatgaacaggcactacattcactcaaccactttagtagtgtcactagtgtgatgaaatgtggctgtgaaagacctgagacataatcatttggatagccag

SEQ ID NO: 11155 - DNA, 493 bp, Homo sapiens
cttgagattataaaaatatttaattatatttcttctagtacttttttggacttaaaaaaaataagttgttaatatagctgaatttatttgatgtgggatttgtagtagggaatcatatttcccccaaatgcctagccgttgtactatcacttattgagaaatatacttttcctactgaattaaaatgtcacctgtaatataataaattaaaatatattaatgactggatctctttctggcctctcctgttttgtgaccagtgccagggtattcttatttctattttagcatttaagtgagatatagtgtatttaaatacctaaatgatctttgtgtaaataagattttaaaggtttaawatgaagcatagtgtagatttattagtttagttctacccatatctccttactgagtttactcccttcttatgcttaagacaagcatttccatttcaaagcaacaaaaataaaatacggtagcccacataagcagg

SEQ ID NO: 11156 - DNA, 476 bp, Homo sapiens
tttgggttatttttcatgtgttcgaatgccaccataaaatattctttttttgtgtgtaatcaatctttttatatctgagaaacctggatattgtaattctagttttggaggtttctgaatatcttcttttgaagtgtttttacatgccacatggagagagatgcaaacacagtcccagttgttccagtaacccaacctagaaatggagtctccttatgttgtcctgacttgtcttaaactcttggcttcaagtgatccttccaccttggcctccccaaaactggaattacagatctgcagcttgcattccctcccaggtggtgttttatgagagtatgccctcataaacttcctgtatgcaaatctgcacgtgagagtctttcttagagcaccagacctaagacaattagtcccaagagaggatcaagaaaacagatcctaaattggaatgctgaatcatcagtaaatgtgaaaaa

SEQ ID NO: 11157 - DNA, 370 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggc

SEQ ID NO: 11158 - DNA, 566 bp, Homo sapiens
ttcaaatgtttttcttctgcaatcatctttgatcttgctgctcagatcctttcccttcctttctgggttcccatagcactttaatttttctctatttatctcaatttgtagtgtgttatactcaattgtccaagtgacccatgtgtcctctggaatcatcctggctttgagattctaatggcactgacttgaatgcccattgatgtgagctgcgaacttggtcttctcctaattagggttttgggggtgggactgtagagaggtgcccattaaaatcacctgtatcaccctctagcacttttatgagttaatttttatactcacttcttttctccaattctaattgcctttaatgatcaagaatgagaatctgattcagggtgtttaaaataaattattatggaggattttaacttttttgtttagttggtttatattttctacactttctgtacggggcatgcgttgcttttatacttagaaaaaagtattatggctgggcgtggtggctcacacctgtaatctcagcactttgggaggctgaggcaggtggatcatgaggtcaa

SEQ ID NO: 11159 - DNA, 293 bp, Homo sapiens
attctggcggctgggcacagtggctcaagcctgtaatcccagcactttgggaggccgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaaa

SEQ ID NO: 11160 - DNA, 505 bp, Homo sapiens
agaaaactggtctcagggaaagagtagggatggagaggctgccttccacataaaggtttttaaaatctgctgtcaaatccccagatgaaataattaggtagacatttgagaacatgaaacacttgtgaccaaatcgtatgtattttcagaatgaaagcttgtgtgagaggatcagtttggcctaagttatctaagtaatagtttctcctttcacttaaaatactcagactcaaagtgtactaatcatttatataaaaatattttttagagcaaataagggaaagacaaaaatatcaagagaaaactaaagccagagtacttcatggctgaattttctttctccacaattttcccctcaaatgctctaactccctatttcattgtttgggataggaatttgtatagtgaagacattgtattctgggaaaaaggtgacttgcttgtgtctctcccatagcctttgstatattgtgcamcttcagtcaattgtttaaccccacgagga

SEQ ID NO: 11161 - DNA, 176 bp, Homo sapiens
attcatttcagttcagtggacttgaaatactgctttttatcttgctagttagagagatttttgagtagttcactaggtgacaacctgccgttttctaagtacgagactagtcaacagttggttattaaagcagaaaatactgctaaaaaaaaaaaaaaaaaaaaaaaaaaaaaaaa

SEQ ID NO: 11162 - DNA, 394 bp, Homo sapiens
atcctaggacacccaccccagcctcctaattggactctctgattctgtcattagtcacactattcttaaagcctctctcattgctcaggcattttctgtcaggagacatcatcagctcagtgccaaatacaaggtgaaggaaaaataattgacctggawttgaaagawtgaaacattgacttcagaatttattcagaccatggcactgtacaatctgatttccaaagcagaagaytaggaccatatatcaactccccmatctctctccaawttaatattcacacacatycactttcaacyttccttttggcgccccttagcagaactattctctttgaaaagaaagttmaccagcagaaytaaactcggtcmagaggawaggaaggtgtggatg

SEQ ID NO: 11163 - DNA, 126 bp, Homo sapiens
tcagatcaactcgtttttataatggtgttgttgtggaactgaaagattggggatgatttggttttttccttggtccacaggtaggtgtcacaattgctttgaaaaaaaaaaaaaaaaaaaggtcag

SEQ ID NO: 11164 - DNA, 460 bp, Homo sapiens
catggaatgttttttcatttgtttgtatccgctctgatttccttgagcagtggtttgtagttctccttgaagaggtcctacactttccttgttagctgtattcctaggtattttattctttttatggcagttgtgaatggttgttcattcatgatttggctctcagcttgactgttgttggtgtatagaaatgctagccatttttgcacattgattttgtatcctgaaatgttgctgaagtttcttaccagcttaaggagattttggggacctggtgtggaaactcacacccgtaatcccagcactttgggaggcgggggtaggtgcatcacttgaagtcaagagtttgagatcagcctggccaacatgatgaaactgagtctctacaaaaattagccaggtgtggtgggtcacacttgtaatcccagctagttgggaggctgatgtgggaggatcactt

SEQ ID NO: 11165 - DNA, 478 bp, Homo sapiens
aaattccaccagatgtacaaagaagagctagtaccaattctactgaaactattccaaaaattgaaatcaaggaggagggactctctatgactcattctatgaagccagcatcaccctgatatgaaaacctggcaaagaaacaacaaaaaagaaaactacaggccaacatccctgataaacatagacacaaaaatcctcaacaaaatacaagcaaaccaaactcaacagcacatcaaaaagttaatttaggctgggtgcaatggctcatgcctgtaatcctagcactttggaagaccgaggcaggaggactccttgaacccaggaatttgagaccagcttgggcaacataggaagaccccatctctacaaaataattagccaagtatagtgatgtgtgcctgtagcccagctactcagaaggctgaggtgggaggatgacttgagcccaggaggctgaggctgcagcaagccatgttgg

SEQ ID NO: 11166 - DNA, 80 bp, Homo sapiens; identical to SEQ ID NO: 10797

SEQ ID NO: 11167 - DNA, 311 bp, Homo sapiens
ttcttatttttttttggagataagcccttactctgttgcctagattggagtgcagtggcamcttcatggctcactgcagccccacctcctggagctcaggtgattctcccacctcagctttctgagtaactaggacttgagtgcacaccaccatgcctgactaagctgttctttattcttgtttgtttgtttgagtgaractctccatcacccaggctarattgcagtggcagggtcctatctcagctcactgcaaccaccgggtcctgggttgaggcgattcttgtgcctctgcctcccaagcagctaga

SEQ ID NO: 11168 - DNA, 488 bp, Homo sapiens
attcgtgtaattgttaatatctcactttcttggaacatcctaacttcaacctctgaaggaaagggattggcactcaaaggactcaaaaagccctgactttgcttcccatcctggggaagtcagagcaaatcacagaccaactgaaagaaggagtttccattaacactgacataggaatctttacaaaaatcttccaatcatatgaggattgcttttgcctagacataagggctacaaaatgcctacacctggccaaagggtctaaattgctccagcagccaagggggaaatcagcctgacccatttctaccaaatattcttattctcagcaaatctacaactgatgagtgggacatctatggctttaaggagagtctgatgtgtgaattgtagcttgaatttgtattaacattctcatctgccagccacttcctcagctgccggaggatctttgcaccatcttttccaccctcagttatgtggccaca

SEQ ID NO: 11169 - DNA, 507 bp, Homo sapiens
gttaccttctcaacatggcgagcttgctggacgtcacgtcgccttcgccttttccgctgcggactctgctcaccgacctcctcagtagagccggccctgctcactaccgcgcccacgtgtcctgttgtgcttcattcccacaggccgcataagataaaccttgctatgctggagattacttaggtaggccaggatttcttgaaaccaaaactttactgaatcacctcttcaccatctgtatgccgtgcatttgctgagagataaaaacattcctgtgaaagatgcccttccctgcaccgggagaaaagaagcattctgcgaccaggagccatagcgaagataattctgtagaaacagaccgtggtaaaataatgcctatcttcctgcagcctccccacgtaatttagttacttttccacagctgcttctttttgctcaacctaatatcaaagcagttaggtattgccatttctttgggtcttcattttcttattcaggctcctgtgc

SEQ ID NO: 11170 - DNA, 495 bp, Homo sapiens
  misc_feature 489: n=a, g, c or t
atacaccctcatccctctatatgagcaaggaaaaaattaagcatgataaaatatatctagagtgttctccgtaagaaagaattactttttagggaaaaaaagtatttattagagccttctatcagctgagagaagagaaatgcccccactgcagaccgcttgtcttcatgcttcacctaaggaggaaaataagatgatgtttgtcttgtgaaaagatatatcgggctgggcgcggtggctcacacctgtaatcccagcactttgagaggacgaggtgggcggatcacctgaggttgggagttcaagtccagcctgaccaacatggagaaaccccatctctactaaaaataaaaaattagccaggcatgttggtgcatgcctgtaatcccagctactcaggaggctgaggcaggagaatcgcttgaaccgggaggcagaggtagcggtgagcaagatcacaaccattgcactccagcatgtgcacaagangtgaga

SEQ ID NO: 11171 - DNA, 309 bp, Homo sapiens
  misc_feature 258,304: n=a, g, c or t
tctacctccagaagtccagacacctcccctgtacctctcgtaccacagaggacaggtctcctccagctgtgcscccactcccctaaaagccttgtattcscccctgcaggttccctctggccccaccaggagaagaagatggcctatgaaaaatcaactgatatctctgatgtctccaggtcaatgttcctgtaccatggctggaatatccagacaagassaaagaactcagaaaagcsatggctcctgttcatctgnccttgtcctgctacbagatgccaaaggaagagtttccsccaagtcnagagt

SEQ ID NO: 11172 - DNA, 529 bp, Homo sapiens
aaggtatttttaccttccttttttgaaaaacttgaaagacaacttacgatttgaaattacctgcatttttgcaatataagcaaccattaattcatgacaagctgctcaaaaatcaattctatatgggaatattccagttacatgtcctgaaatctggcaaacctttgtctcaatggctagaaattatctggctgaggaagtcagtgagccaaactacatggactgttctaacctcattcttccaagtaaaatcagaggcataaaaagattctttgtttctgtttttcacactatatttctctttttgatctgcttacttagtatagctcttatgtttgtctaagagaatatggcccagatttttatatcagtttaatatttcaccataataaatgttttctttagaagacattcttgtccataaactgaaattcaaaccacaaaaggaaaagtttattaagaacaaagtaaacttggtcagaaatacactaactaattttattaataaaaattcgaaaaaaaaaaaaaa

SEQ ID NO: 11173 - DNA, 482 bp, Homo sapiens
ctcctggctccgcccaccgcagtccgctcttatttccggagtggaagagaaatggcaccttagacccttgctggggatagttactgaaaggggcacttttttcttttacagcccataaagagcgctttcccagatgtggtctccctgtgttgcccaggctgctctggaactcctgggggaaagtgatcctcctgcctaggccttccaaagtgttgtgattacaaacgtgagctacctgcctggccaaggatctggaatttttgttgttaacactccaggaggaaacctggctgaggataatgactgagattacttattgtaagagaaggctgctgaagtttagaaaaacacacctatccaccatcaggcgggccactggcttcacattcttcttttatctaaaaaattgaggcctccatcccagagagatctgtgctaccatatcactaactccaacacagtgactgggtcctaatcaagaa

SEQ ID NO: 11174 - DNA, 127 bp, Homo sapiens
attattacacgcttgggttttgggctcagcacccccacccataaacccgccggctttttgttgcgcctgcgscttcccgcgaatattgaacttcggagtctcaaaaaaaaaaaaaaatgcgaaargc

SEQ ID NO: 11175 - DNA, 391 bp, Homo sapiens
actgttctagacactgattatgttgtaatcttgaataatagttgcccatttatttctgcaccttttgtaaattttgaaatctttgaagatgtaaacctcaccttaattcctattttatcttcatgggccagcacattgctaggcaaaggtaaacaatgttgtggaaggaagaaattgtggaaagagaaaagggaaaatagggtcaaagtttggcaagacttactggagcccctgctgggccctgtgcacccccagagcctcgatctcctctggctcctttaaggcctggaagcaattgagaccccatggaccaggtgggcctggttccccgggtggtccagtgttgggaacaccaccgtcacaagcacagaaacctgagtctcctgggaga

SEQ ID NO: 11176 - DNA, 282 bp, Homo sapiens
ataaattagctgcagaccttgatgactatttcatctcctagaataaatgaagaatacagtcatacatcacttaacaatgggaatatgttctgagaaatgctttgttaggcaattttgtcattatgcaaacatcacagagagcacttacacaaacgtaggcggtgtagcctactagataactaggcgatatgatagagcctattgctcccaggccacaaacacgcacagcatgttactatagtgaataacgtaaggaaatggtaagtatttgtgcaataggaa

SEQ ID NO: 11177 - DNA, 437 bp, Homo sapiens
cacattctgagattttaggcaaacatatctttggggggccaaaattcaatcccctaatccatgttagtaaccatgcagtgttccttcttatttctatgttgaccttttcagctctttctatttattgttattatttttgagatggagtttcaatcttgttgcccaggctggagtgcaatggtgcaatcttggctcacggcaacctccgcctcccaggttcaggcgattctcctgcctcagcctcctgagtggctggtatgacaggcatgcaccaccatgcccggctgattttgtatttttggtggaggcggggtttcgctgtgttggccagactggtctcgaactcctgatcttgggtgatctgccctcctcagcctcccaaagtgctgggattagaggcgtgasaccatgcctggccagctctttctaactaaaaa

SEQ ID NO: 11178 - DNA, 122 bp, Homo sapiens
acagtggcttctcagcctcccctggcccaactgaggctgttgctagatatgtttttcctgtatcaggtggttcatttctttttttctttttttttttgcctcttgatcttttttttcttttg

SEQ ID NO: 11179 - DNA, 522 bp, Homo sapiens
tcattagtagaatttcaaaattttatattattatctatcaatgtctaacccaaataagtcactattacgcctagatgtataaccaaatcatcaaaaacttgaaccgattgttcaaatctaggaggtaacttaattcaatgtttgacattggtatttgactatataacctattccgagtctcatacaatgtaactgacactagatagttcaaattagtcaaaccaatttaagtactgcgtcaaacaagcagatatccactttataaatatctagcctaacattttggaaactctttgctggtatgaacattcaggcaacattttcagcctttaactacgattatgatacaatggttataccactggattttatcaattattagaattatatgttcaaatgcttggtaattcctgaatgtgtaatgatgaccatcaagctttactgaatttcctcgaattttacagatttattttatattcacactttaatacatatttatttaaagattactatctgcaagac

SEQ ID NO: 11180 - DNA, 137 bp, Homo sapiens
attctcttgcctcagcctcccgagtagctgggactacaggcacccgccacctcgcccggctaattttttgtatttttagtagagacggggtttcactgtgttagccaggatggtctcgatctcctgacctcgtgatc

SEQ ID NO: 11181 - DNA, 386 bp, Homo sapiens
  misc_feature 19: n=a, g, c or t
aagagttctcttctcagangggcttcgcaacagacttttgtcactaaaagcccaggtgactccccagatgcttacggatattaaaaccgattatgctgaaggagtggaaggagagtcaagtaaaagaagaagatcaagtaaaaagaactggggaacagtgactttgtttccccttattgtacctcctttctccttttgtgctttcctggaaacatcgaatttcaaaaagaagcttacaaagtccaccatacagcttgcaggtctgaatggaagtcaacagtttatatttgaatatttgatggaagattgctttcatggcttatgatattaaaaacagcaasaacaaaaaaaccattcttatttccaagaccagaaacctcccgtgt

SEQ ID NO: 11182 - DNA, 473 bp, Homo sapiens
  misc_feature 418,421: n=a, g, c or t
acggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcagagtaaaaatacagagtcagcttgtgatggcattccctcaaaacatggaaggaattgcagtaatgaaagtcatcatgtattctaagagactgttctgcgagasacaacacagacggggctaaagcagggattgtctaagcccagtgtggaggaaccatcaaggatttcagcacgtttttttagccattgtgagaagcaaaagtgctcaggagttaagagaagcagacgtccgaaattatctccatgcattaccaaaaaccgtgggcacmgngcnacggggaaaacttaccaggtacaatgagccagtgactgttactgaatttctt

SEQ ID NO: 11183 - DNA, 278 bp, Homo sapiens
atcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaattttttgaatttttagtagagagtgggtttcactatgttggccaggctggtctggaacgcctga

SEQ ID NO: 11184 - DNA, 478 bp, Homo sapiens
ctttttgcttagtacgcttttctgctattcctgccgcataactctctcttccccaggcttttcccatctccatcctattctctcgcaggcaggtttttcttccgcctctctggggattttcgcgttggttctccctgcccccaggagtgaggctggtaacgcccacgcctacctccggtgctgggggaaaagattacttcccagatgcagtatttacatctcctccgccctactcttccaaccctgcctgaaataagtgtggttctcctgtctgtcagactatgaagagttctcaaatatgtctttcccagcgagggagaggagagtgagtatccaggaactttaatgcgataggacatcaatatgagtgtttatagggaaagccagtgatcctattgttagacgcgaaatcaagacatatgatctgattttttgttttactttttgtttttgaggtataacattcagtaaagcgcac

SEQ ID NO: 11185 - DNA, 518 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagattttgtcaccaccaggcctgccttacaagagct

SEQ ID NO: 11186 - DNA, 307 bp, Homo sapiens
agatcagatgtatttgaatcagaatggcacacagggcccctgaattggttggcagagcctatgggactgctccaagtgaagggaatctccatgaagacaattatccaagagaaatagcctatctcagcaggcatcgttctgctttgcttattgagccaacatttatgaagcatagacttcataccgagctcaatgcaaacagactcacctctagcaaggctcaagggaggcaacaaaagaaatagaaaacacggcccttgtcaacaaacctaggattaagttggagtggccgggcgaatatactgag

SEQ ID NO: 11187 - DNA, 502 bp, Homo sapiens
aacgcaaatcatcctgaaagcaacaagaataatggttgtaataattgtttccaggcctgggaccctgcatcttgttttttaagttgacctgatgaactagtaattgtaggaataaactgaatgtttgccagcaggagtcactctaggcttcctaataaaacgttagtaaattaaactctgtccttaaagctctgaaaggctgaggtgattgtgtgatatcagatggctttagggaaacactgactcttttcgttaagcatagcagcattcttagattattccttgggccttcttttgttcaccatcggttcttggatcttgttcctttcaagattggtccttaatgcatttttaaaaagcaacgtatatgggtaaggatatcaatatcttagtatgctgtattctgtatgttagctcattttggctttctaggatgaactgactctatcccacatcatgtaacttgaaatgaatagactcatatccttttccactgattgct

SEQ ID NO: 11188 - DNA, 408 bp, Homo sapiens
atcatctcagccaccttttttcacatgcaacttgttaaacgttgtccaaggatgagatggaatgaaatgacacctttagtgtacagataacatggacggaagttctgttgtaacaaggctcactgtttccaaaatcaaatcagtgacaaaaccatgagatcataggatttggaaggtgaaaaatcatagcattcaggactgcaggtgccaccagctaattgggctcactgggctctgaaactgcaaggaggtgctgtgacaagttactgagaaccaagaaactttggtaacccctgaaatttggtgaaaaaatgaaatcaaaactgtgtaaatacagtcaacaatctcaccctttcgtgtatgtgtacgcacatgtgtctgtgttaaaatggtgtaaaawatacacca

SEQ ID NO: 11189 - DNA, 488 bp, Homo sapiens
aagtaagtgatgattgttttggcttctgcagtagcctcattgatgatctgccattaagaagctttcaacaagcaaatttttcaaaaacttgaccttctgaaaggaggtgcccacagctcataacctacctgaggttatttgggtctcaggaaacacacagcacgtgccaatgttccaagaatgaagctctggttcccagcttctgctgctccaacttctatagcagcaaggagaaaagagtaacagacatactgatcacatctaattagaagggaaatctcccagatgcagtcaatgtgtgaaaaccaatcactagaaaggaaagaaactgcccttcctttaaggaatgtggaatctttccttttgaagatcaagatttggagcccataatcctgtggatggatgacgccaacattcagctctgckcttattccccataatttctccgcttgacctgtgacgaatcagcttctgcctttccaggggac

SEQ ID NO: 11190 - DNA, 461 bp, Homo sapiens
  misc_feature 204: n=a, g, c or t
atggatgtggtcgtctccctggtcactatcatgttggacacgggcctgccctgttttcgcggccaatcaagttcttgaagcacaggtttagccccaacatgactgagcgcgaggctgcaaatttcatcatgaaggtcatccagagctgcttcctcagcaacaggagccggacctacaacatgatccagtactatcagaatgacntcccctactgaggaggggaccttcgagggcctctgcccatgtgcccttgaagctgccccacaatcatggagccctgcrcctacccgscctgccgccacatgcagtggaggagaggcctgtggccgaagagcctggtagcgcctcctggggcagcacgtgggtggcgcaggcttagtaacgccgtggactgcagcgacaatcagtggatggtgctgtctatgcacaggtgtgagtcctctgtttgcactggacatatt

SEQ ID NO: 11191 - DNA, 428 bp, Homo sapiens
aagtaggaatatgccaagggaaaaagatgggaaaagcactccaagcagaaggaagattgtgtgcaaggatacaaaggcttaataaatacgtcacttccagacaactacaagtagttcacagctggtacacagaagatggtgttagaaaccaagacctgggtgctacgtgtgcttgttgctacaggggtgtcgtttccagatcccttcaactaacagagtgaggttcctcactttcggctagcccacagtctacctctagcaattcatcaaaattatcatttaattaccgaagttatcagtggsttctaatccaggggtcagatcaacatcacaactgggtagtgctctcagcctcstssatctsstgstscttctscttcacaagcatttttcccccaataaatcssttgsacatctaatcgcaaaaa

SEQ ID NO: 11192 - DNA, 80 bp, Homo sapiens; identical to SEQ ID NO: 9659

SEQ ID NO: 11193 - DNA, 130 bp, Homo sapiens
aagaaggagtgtgctagtaagtgtgcacgtacgatggaaaatgaatgaagaatgaggacattccaccactctccaagttatcaagatgaagacccaagatggtggcattcactctgaagggagatgtccc

SEQ ID NO: 11194 - DNA, 83 bp, Homo sapiens
attttgcatttccaccagcaatatatgatagttcgtttatttcacatctttgacagcatttagtgttgtcagggttttttttg

SEQ ID NO: 11195 - DNA, 139 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctag

SEQ ID NO: 11196 - DNA, 470 bp, Homo sapiens
  misc_feature 414,465: n=a, g, c or t
cataattattactaatcacaatgaaatgaggattataggaatcataattttggaatacatatttacatttatataaatataatgcaaagaaaattcaacaccattttgtatttgacaatgttttctgtgtggtcaatataccaaataaggcaaatacgtcttttggagttcagcggacccaatacttaaaaggttaattaggtagaaaaaaaaaagacttaatttacaatttgatttttcaaagtttttcaaatattaaaggtttaaaacacttcatatcacaaaatggaatcccagataaccacacatcatttatttagaaaataactcawtttcaaaaagtcaaaaatctctactcattgatagagaagggagactcatctctccaaacaagaaccattaaagacagcwtgnggccgaccacatctgtctcttctctctcggtgtttttcagtttatttarwnggcga

SEQ ID NO: 11197 - DNA, 391 bp, Homo sapiens
ataatgctctccgcgacggaatgcgcaatcgccggcgacggctccggcacttcgctctgtgaagtaccattagccgcgggaatatcagtatgtgagaacgtggccatggacaagaattccaagtagtggcacttctgtagacgacgcggcccttttggggttactacagcccaggaaactcacatgcgacacggcgccastgaagtccatctagacccccgcagacccaaggtcacaagttgagaaccccctgccgtggacattcttctgcacctagtggtgaagcaggtggagctgcaccttgctccgcccatttggagactggttctgcacatatgagtgtgccctgcagcgatcctgcaatccttcgtgactaacaaggactttctgt

SEQ ID NO: 11198 - DNA, 104 bp, Homo sapiens
aaaaaactggtttggtccgcttccacgctgttggaggtttgttcttttgctgtttgcaataaatcttgctgttgtttgcaaaaaaaaaaaaaaaaaaaaaaaaa

SEQ ID NO: 11199 - DNA, 55 bp, Homo sapiens
attcatttcatgggtagagaactgaaacccagagaaaatagaaatgccaccacct

SEQ ID NO: 11200 - DNA, 499 bp, Homo sapiens
tttactcctcccacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaaactttaataaaacttta

SEQ ID NO: 11201 - DNA, 307 bp, Homo sapiens
agttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaac

SEQ ID NO: 11202 - DNA, 492 bp, Homo sapiens
atatagcaagttgactattcaaaccaaaaggcctccagttgaagttgtgttttaatttaagcactagtagggcccagcaaatcaaatattgaaagatgctaaaattagtctgattactttgtgagtcatcaaattgatttgactgtccttgcccttcatataatgtcccaatagacacttaacctgactctacttccttgaatttggcaaagtaagcacgatcattggagttactgcttttgggattatttatttatcacatcacctctgccatcattacttcccactcgtctttgtttggcttactttctactgtgcttctctctatcaaatctttgcacctccttaggaagatctggaagtcacctctctgtaaatctgagaagttattttcattgttgttggatgataatgcttaagccagtgttggaggctgcacaagtaaattacatggttttagaagcacctcctccttccatctgtgctgtttgg

SEQ ID NO: 11203 - DNA, 494 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagattttgtcac

SEQ ID NO: 11204 - DNA, 68 bp, Homo sapiens
acatgacgctcaggtccgggtggccgcggcagcgcgsgccagctcgcactcgtcgcgattcagcaaac

SEQ ID NO: 11205 - DNA, 515 bp, Homo sapiens
cctttttctccaatcgcatgaagccgccagtcgtgcttcctaagtgaatgccgtctatggagcagagctggttgccaactcttacaccagctgactccacctcgggatcacataggaagtccaccaacaccactcaagaagggatggcagagtgaggacttcttgtatccagagattctggggcctttatgccttggaattcattgcggtcgagtgggcatcacacacttcctattttggcgtcgtaaatatgcaacatgtcccggactctttctacaaacaaaaaataaacacaaaaataataacagttaaagtgcctgggctgcagaaatgcgacgttagcctctgaatggaccttgagaagaactggggggaaaattctggccttagaacacagctctttttawatccttaaccacagaagagctccctctgtctgggagaatggcttcttcagttgagcacacagtgggacagctgtaggagtgtgctgagcccaaacacatcagtaacgt

SEQ ID NO: 11206 - DNA, 108 bp, Homo sapiens
aaaaaaaaasaaaacaaaacaaaacaaaaaaaacacgagtttttaaagargggttgatccccagtcagagtcatctgggaatggagagttcccaggagaaacaagagc

SEQ ID NO: 11207 - DNA, 108 bp, Homo sapiens
gattggctgaacaaatagtccgagggtggtgggcatccgcctcccgacaaggcagaccaggccccctgcaggtcccctatccgcaccccggcccctgagagctggcac

SEQ ID NO: 11208 - DNA, 381 bp, Homo sapiens
actcctcaacttaccccaggcagaaaaacagaagacacccgtcagaatgaaggcgtccagctactgccatcaaagaaacagcctccttcaataagccactttggagaaaacatcaagcaattttttgagacgattttttcaaagaaagaaaggaagccagcaccagtcactgctgagagccaaaaaacagtaaaaaacagatcatgcgtgtacggcagcagtgctgaagctgagaggctcatgacagcagttggacagataccggagagaacatgtcactttgccatgcgcgccatgcctcgaaggtaaatcagcaaagacagcagtttcaagccccagtctgtgggtttccctgcaaccacagacacccgttctactcag

SEQ ID NO: 11209 - DNA, 205 bp, Homo sapiens
attcattgsccctgtaacctgtcaaagaagagctaagggagctttcggggttggcttcttggaggctgctttctcctttacttggaaggcttcgctagtgatgtacccatacatgattcagatgagcagcaaaggcaacctcccctcaattctggacgtgcatgtcaacgttggbgggagaagctctgtgccgggaaaaatgaaa

SEQ ID NO: 11210 - DNA, 96 bp, Homo sapiens
actcacaagcttctcggscccgaccttcgccctgggaggktctggccaggtgccgggaggggcgctgtgtccagggcgawccccccaaagcagcgk

SEQ ID NO: 11211 - DNA, 257 bp, Homo sapiens
acarrtatttaccgccgcgcggagagtgagggcccaagtccgccctgctccgccacttaggccgccccagacgcttccctcggggctgccaccgggtcgggcgcggctgccgcggctcgcgggccttccccgcaccggcgcggcccaaccgccaccgaaccttctggaagcggcggctgcctgggccctcacgccgccagaatcgtacgcccgcgcgagctctctgcagccttggcggcctgggaggcggggctcgs

SEQ ID NO: 11212 - DNA, 247 bp, Homo sapiens
actgtggtcgggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttc

SEQ ID NO: 11213 - DNA, 201 bp, Homo sapiens
aachwtgttgctgctggagatcaatgaagccgagtgaatgggggctgaatgtgcgagtccatagctgaagaggagcgccagatggtggaggaatacacttatttatgaaactgtcttgagttcttcttgaattgccagttttcagcctcctcatgcctccgtctcctttagacgacagggtagtagtggcactatctaggc

SEQ ID NO: 11214 - DNA, 381 bp, Homo sapiens
caaatataagatttttcattttgataaatccattttatcattcttttataatttgtgcttaagaaatctttgtctaatttggccgggtgctgtggctcacgtctgtaatcccagcagttttggaggccgaggctggcggatcacttgaggtccagagttcgagaccagcctggccagcatggtgaaaccccacctctactaaaaatacaaaaaaaattagccgggcgtggtggctcatgcctgtagtcccagcttcctgggaggctgaggcaggagaatggcttgaacccgggaggtggagtttgcagtgagccgagatcacgccattgcactccagcctgggctacagagcaagactctgtcccaaaaaaaaaaaaaaaa

SEQ ID NO: 11215 - DNA, 285 bp, Homo sapiens
gagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttc

SEQ ID NO: 11216 - DNA, 251 bp, Homo sapiens
tcatgataactaggtcaatacacaccattatcaaggttacattcatgaaagccttttaactggtggtggacatgagataagaatgggaacctctccagcaagcatccttttttgaatatttttaggtgcaaatttcttcattctgtatagcatttcagctcatcttctgttgaagacagaatttgctgccagggacctaccaaaccatactcagcccaagcagcatctstaaggcaaagaactttgcctgt

SEQ ID NO: 11217 - DNA, 207 bp, Homo sapiens
  misc_feature 24: n=a, g, c or t
atrtstrtcactcccccatctcanatatcccccctaatcctggataccatttgttgaaagatgttattactctagctgaacttacaagagactttagaccagggatctaaattacagtggccttagtgaccttgtccttatcttcttaggacagctgagaagccactgggacttagagcctttaaaaggagattaactgtcccaaam

SEQ ID NO: 11218 - DNA, 334 bp, Homo sapiens
ctccssttcccgctcccaggaacccatccagcctcaggaactgcccccagccatcgagccttggctacttaagggacctgggcccaatccacagctgggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatgcggcccaggaggggctattggctctgcagagtgagctgctcaggatcacgctgcctgacttcaccggggacttgaggat

SEQ ID NO: 11219 - DNA, 245 bp, Homo sapiens
gctccgtcctgcggctgcccactgccctcctacggtccaccatggccctgctgcactccggccgcgtcctccccgggatcgccgccgccttycacccgggcctcgccgccgcggsctctgccagagccagctcctggtggacccatgtggaaatgggacctccagatcccattctgggagtcactgaagcctttaagagggacaccaatagcaaaaagatgaatctgggagttggtgcctaccgg

SEQ ID NO: 11220 - DNA, 235 bp, Homo sapiens
  misc_feature 224: n=a, g, c or t
attgatcagagatgtctgcatgaggaacagaggctgctttgtggattggggagctccccattagcggaggcagagccagatttcacactgagcagctgcagtcggagaaatcagagaaagcgtcacccagccccagattccgaggggcctgscagggactctctcctyctgctccttggaaaggaagaccccgaaagacccccaagccaccggctcagacctgnttctgggctgs

SEQ ID NO: 11221 - DNA, 321 bp, Homo sapiens
catctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtc

SEQ ID NO: 11222 - DNA, 281 bp, Homo sapiens
aatatgatccacttcctcctcagggaataaaggctcagggaccggcagttctactctggagcccaccagcctctcagagcctccggtgactggcctgtgtctccccctggatggacatgtggacggcgctgctcatcctgcaagccctgttgtycccaatgccccattccacacggcccgggaaatggccaatgccaaggagatcgctcggactgtgcakatcctgggtgcagacttcatcctgtctstaggggacaatttttacttcactggtgtgcaag

SEQ ID NO: 11223 - DNA, 306 bp, Homo sapiens
actcttcttttgagacggtctaatgatgcctgggtggtgccttcgtaggatggtcgtcacacctgaacaagggggtccctggccccaggccccatgctttactgggccctgttctgtccctcttctggcatcatctcccatggagaaaagaatgtgttgaagccaagaagatgctccccccgcaagaatatcatctctgctagaacaggggctggagtgtaacggcatgatctcggctcactgcaccctcgacttcctggattcaggtgatcccctcacctcagcctccctagtagctggtgtgtc

SEQ ID NO: 11224 - DNA, 169 bp, Homo sapiens
aatattgtatgtgtggtttgtgtatctgctgctgctttttcaccattgatcacaaggggcagtcatctgattccagggaatagaagatggaggcttgctctggcgyggwtccgctatggaagtgatatagkkcctttctctaaagwggatgaggaacaaatgaaatatw

SEQ ID NO: 11225 - DNA, 260 bp, Homo sapiens
ctagagcggtccttggggagacgcgggtcccagtcctgcggctcctactggggagtgcgctggtcggaagattgctggactckctgaagagagactacgcaggaaagccccakccacccatcaaatcasagagaaggaatccaccttcttacgctatggsaggtaagaaagtactcattgtctatgcacaccaggaacccamkkctttcaacggatccttgaasaatgwggctgkagatgaactgagcaggcagggctgc

SEQ ID NO: 11226 - DNA, 270 bp, Homo sapiens
  misc_feature 55: n=a, g, c or t
aactccgtagtgtgcacttggtgagggcagcagctcgscacagctgscagccatntgtccattcacccatctgtccatctggcagcccgctgttcagacctgtctgtctgtccgsccatytgtaagcccatctctgtcccattgkctatctgaccatctttctcttactggcctctttgtctagctatctggcctatctgtcgatccatcttcgtgtctgtcttcagcccccacctgtttgtccatctgtccaattacctgtgactctgk

SEQ ID NO: 11227 - DNA, 481 bp, Homo sapiens
ttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgktctcattaatgaatacttcctaatatcgktggctctactaatattttccaatttgctgggatgtcacctagcaatagtttggattatatagaaagtaaactgkggkcaatacttgcatttaattagacgaaacggggagtaattatgacacgaagtacttatgt

SEQ ID NO: 11228 - DNA, 318 bp, Homo sapiens
  misc_feature 133: n=a, g, c or t
actatccgtgcggccaggcggaggtgagtgcgcggcggccggatgggcgggacgggcgtggaggacgccgagcaccgtggcgcgcgctyacgttcgsgttcccaarggctgsgctyccthaagcgcagtgccnaraactcggagccagcccggsccgggggaccctgctggccaaggaggtcgtcagtccggtcttgtcttccagacccggaggaccgaagcttycggacgacgaggaaccgcccaacatggcctcggagagtgggaagctttggggtggccggtttgtgggtgcagtggaccccatcatggagaagt

SEQ ID NO: 11229 - DNA, 425 bp, Homo sapiens
  misc_feature 385: n=a, g, c or t
aaccactctgasttggagattaggggctcagacagccgtggatgagagtccagctctactacttattagccttgattagaccgtgagasggatgggaaagactggtgcttggggtggccatctgacccctgatggacaggagaccaggacaagcccacaggatgagccggagggtccaggaggagggagttgagagctcctgctagggttgacacattctggtaaggagttcatctgctgtccaccatgggagacaataaaaaggtcaacacagctcccacctcgaagcagctgcsaktttattacatgaagtgtcaggctgtggactgcaggcatgccattttgtcttcaagaacagaattcccgggcacacgaatgattccanggttcctccagcactttggtattacttgaaagactactgg

SEQ ID NO: 11230 - DNA, 356 bp, Homo sapiens
agttggtgaacttgctgcctccagagaaccttccctggtgtggaggcagccagggacccaggatgctccggacctgttacgtgctctgttcccaagctggtvccccctccagggctggcagtccctgagctttgatggcggggccttccaccttaagggcacaggagagctgacacgggccttgctggttctccggctgtgtgcctggcccccactcgtcactcacgggctgttgctccaggcctggtctcggcgactcctgggctcccggctctcaggcgcatttctccgagcatccgtctatgggcagtttgtggctggtgagasagcagaggaggtgaagggctgcgtgcaga

SEQ ID NO: 11231 - DNA, 248 bp, Homo sapiens
ataagctgcactgcatggttgctgctggatgtgttgtgttcctggcttccctctggatgctgacagaaacaagggaatttctgctgaagtgacaaggcaagccagagccaaagcaggttggacccagcttgtccccacagagacgtgtgcttccctctctctctgagagcgacctgttaaccgsaaatacctggaagtctgggasatggagaacgacccctsgagasgaagagagtcsatctctctca

SEQ ID NO: 11232 - DNA, 407 bp, Homo sapiens
  misc_feature 319: n=a, g, c or t
atccgccccggccaacagggttcagagagcaaaccagtcaggtctcctgaccccaagcccaaggaaaacagacacatgccacccgaaaggtgaagatttttggtttacggatttcttttgttttatttttaagcacgttttgacaacagcattacaatagccaaaagcaaacagcccaagtgtccacggacaggtgagtggatcaacacaatgtggcctagccmacggacggaacgctacgcagccatgaaaaggaaatcctgaccaggctacaacatgggcggaccttgaggacgtcgcactcagtgaaataagccanaaacaaaggtacaaarcctgtgtgactcccctcctaggcrgtccctagagtcgttggattcacagagaccaaaagtggaattgggggt

SEQ ID NO: 11233 - DNA, 62 bp, Homo sapiens
agaagagcaggaggacgtctgagccatgctcgcggcgatgggctctctggcggctgcctctg

SEQ ID NO: 11234 - DNA, 201 bp, Homo sapiens
tagagccctcagtggaatgagggtgaamtgctattgccggcgstcctgttttaccgcgtcasrtgctggtgcatttatttcgggtcgggattcggggtggcccattcccaggcaggctgctaccgcccctccgcttccagacattctcagctgtcaggtactctgatggctaccgcagctcctcsctcctccgggccgtgg

SEQ ID NO: 11235 - DNA, 102 bp, Homo sapiens
agcaagggatggtttaacaaaatgaaggcactcattgcagcactgcttttgatcacattgcagtattcgtgtgccgtgagtcccactgactgcagtgctgtt

SEQ ID NO: 11236 - DNA, 405 bp, Homo sapiens
tagatattgagttcttttaatggatacatccacatgctccaactacaaagataatccatgtttaaaggatgatccaagacatgggaatctcaaaatgccttatgaatcatcagagatcaaacagattgagtcatccaggattatttacattttttatgttgcaatgctttgaaaattggtaatagtatagagttcactccctgttgatgctaacagcaattggccttgacaagcatttcccaaagcctgctttgtggaacactagacctgtggcattctcactaactttaggtaaaacatatacccacatatttccagaatacgttagctcatgcacagcacagtccctgagtgcagaatcccatttatgttctttaccctagtagaatttcctttaatcccttg

SEQ ID NO: 11237 - DNA, 473 bp, Homo sapiens
catattcgtatcatttacttgattttctctttagctgttgctttttttattgattggtaaaaagtctttatgtaataactcctgtcatattttgggaaggtgtagaagttgaaattttaggaatcacagaacacccagaaataatgttcaaagacagcaaaccttgaaaacctataatgtgtgtgtgtgttcacagctccgccgcatgcaagagatgattgcaaggatgcaggcgcagatgcagatgcagatgcagggcggggatggcgatggcggggctctcgggcaccacgtgtaaggtgatgtgcacatatcaagaagtcagaggtaggccctgttgtcccttagcctggaagacaggcagttactaacattgtgtcagcttaaatatgacaggttcctccttaagcctcattaatattttgcattttgaagtaactccatcactaatcttaaacaaggagagattgctc

SEQ ID NO: 11238 - DNA, 362 bp, Homo sapiens
gctcgcggcggcggcgacggcggcgggaggttcggttgtcgcccgttggccgcgcggcgccgcgctcggcggccgccattgcagcttgttttcacttgctttttaaagacaggaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatyctgtatgggaaaatcmtccacctggagaaaccttttgcagtccttgkcaaacacactcctggggatcav

SEQ ID NO: 11239 - DNA, 343 bp, Homo sapiens
atttggtaaactgggtcgtagaccagggaagtgacttggatgagataaactaaggcaaaatctaaagtgatttgcagaactgaggaaagaaacaagatttatgctctaatgctacaggaagaagaaattaatcgcactgcttcaagatataaatggaaagcaaaagcgctacagatcagtaatgttcttacctatacctggatggtcagccacaatggtcacgcgatactctttacagaacacctggtaggccgacatgttcttcttttttggstaatgccgcmtagaagatacamcaggcmscagcmtggatggagcaaagaggtcattatcctgagaaaat

SEQ ID NO: 11240 - DNA, 151 bp, Homo sapiens
atrrggaagaaactcccaacattataaggaatgaactccggacacaccgcctttaagaactgtaacactcaccgccagagtccacgtcttcgtcttcatttttgaagtcagtgagaccaagaacccaccacttccggacatcgtatagcct

SEQ ID NO: 11241 - DNA, 358 bp, Homo sapiens
aaccgtgttgtagaactcggcgatagcaggcacgatggtgtagttgtcctcgcaccagtccacctccgagctaccagcctgcagctggtcccaccagtgcggggcgcccatggccactccggggcattggagcagctgctcgcgcagctgagaagagcccagagctgctgcggaggcaaaacgcggcgacagccagcggcgaaagcggctttatgaagcaccgggtaaccgccggatgtgcgcctcccaactggcctcccgcgctccgccccgsctcgcctagcctgcgggaggttactcgttcgccagaccctccccggcccctccccctggaagccacgcccaccgtggggcgggg

SEQ ID NO: 11242 - DNA, 310 bp, Homo sapiens
acgttgctagtgggcgcggctggcggggccgggggcggyagggggctagcgtccggctgagcccggcgggttcctgcacgcggacccacgctttgtcgggctgctctgctgagtgacaccgccgtggcatccgaggagctgyggtccagcctgcgcggcgggaagcggcggcggcggctccagcgtcctaagagaagaaagaawttgactgatgggcgtaagcaagaaaaagagaccgaggcaagtttcagagaagtartggaagatttttyaaaaaagctgywgaacaagaaagaaagthtgcttggga

SEQ ID NO: 11243 - DNA, 370 bp, Homo sapiens
ccttaattagactcaggaaacaatgggtttttgttgtcgttgttgytgytgatgttgtttttttatatgcagkcttgctctgtcacccaggctggggtgcaatggtgtcatctcgattcactgcaacctccgcctcccaggttcaggcgattctcctgccttagcctcccaagtatctgaactacaggcatgtgccaccaagcctggctaacttttgtattgttggccgggctggtctcaagctcctgacctcaaatgatccacccgcctcagcatcccaaagtgctgggattacaagtgtgagccaccgcgcctggccttgkttttgttttcttatactcataaatagagtgttattgtgggggtgggg

SEQ ID NO: 11244 - DNA, 103 bp, Homo sapiens; identical to SEQ ID NO: 8028

SEQ ID NO: 11245 - DNA, 186 bp, Homo sapiens
acacacgccccaaacgcacctcggcgagcywyycgaggaggaaaactagkggggcagagccctgaaccacctctctttctccataagcatctcaagacttggaaactaagaggacagaccttttcctcctccttcccgccctccttcccacctccgacagacccaagagcaggagcgggggcgccw

SEQ ID NO: 11246 - DNA, 444 bp, Homo sapiens
attggcgagcggctggagcgcggggtttcatgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattatctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgrggdatcttcctgatgaatttacagcaagactt

SEQ ID NO: 11247 - DNA, 374 bp, Homo sapiens
acgtcatcgccgcgcgccggcttgccaggagctgsagggggargtaggcggggcggcgcgtgrcctaaggcctctctgccgcgcgcgcagagccaaggcactgatgtttgamckggaaacttsrmaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgtyatagtttctccctgagttgtaagaggcatggaaatatacatgaaactgaagaac

SEQ ID NO: 11248 - DNA, 418 bp, Homo sapiens
agtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgargtccgtaaaagtcagtcaactgaagaacaccatcaaatctttgaaacaacagaa

SEQ ID NO: 11249 - DNA, 169 bp, Homo sapiens
  misc_feature 169: n=a, g, c or t
aatcagttcccaagttctaggcggaagaggcccaagagacaccactttctcgctttcagacgtgtctacataagaccacaaaagaaaccgaggcaaaaacaaaaaaaaaaaaaaaaaaaaaaaaaaaaaaaaaaaaaaaaaaaaaaaaaaaaaaaaaaaaaaaaaaaan

SEQ ID NO: 11250 - DNA, 467 bp, Homo sapiens
tattttttacattttgctttagaggcagggtcttggtctgttgcccacactagaatgcagtggtgccatcacagctcactgcagccttgaacttctggactcaagcgatcctcctgcctcagctagctgactagctgggaccacaggtgcttagcaccgtgcctggctgatttttcctggtctcattgttgctggggctggccttgaactccaaacctcaggcaatcctcctgccttggccacattttatgttgggattacaggcctgacccaccatacccagcctaatactatttttaaaaacaaaaagtaggaaatcaattttccttttaaatgaacactaaattataagaattaacttgggtaatctatgcaacattctcactttttttttttttttgagatggagtcttcctctgtcttccargctggagtgcartggtgtgatctgggctcactgacacggs

SEQ ID NO: 11251 - DNA, 288 bp, Homo sapiens
gacwwgasscatcctactgaaagggagcagaggaagaggacagagacattttctttcttttctttttgtggacgcaacggcatgtgcctgtartcccagctacttgggaggccaaagcaggaggatcattckwagtcagaagtttgaggctgcagtactttatgatcacacctgtgagtagtcactgcactccagcamaggscaacacagccaaagaccctgttcctttaaaaaaaaaaacamcmcaccaaaaaaaaaaacccaaccaaccaaaaaaaaaaaaaaatk

SEQ ID NO: 11252 - DNA, 250 bp, Homo sapiens
gacggcttctggcgggtggcggtgttgawggcgaragcttgcttggcccgtgtcgcttctgtcccaataayckgacggwgagtgagggcackagggtcsctgtcgggggctgtcgtmttccacgtacacgtcgtcgtgaggagcgcagtccggactcttcccgcaacccctccggctccctttccgcacgcctcgaggcggcggcggccaccgagacagcagcgcaccttcccccatcccttccccttat

SEQ ID NO: 11253 - DNA, 219 bp, Homo sapiens; identical to SEQ ID NO: 9948

SEQ ID NO: 11254 - DNA, 74 bp, Homo sapiens
cagacactgtgctaggagaatggaaaacaattttgaacaaaactgtctacctacatgattttttttttttttga

SEQ ID NO: 11255 - DNA, 219 bp, Homo sapiens
atgaagtaggaagatgaagccaagtcttatcgccacatctctagtatattaagattatatatggccaggcacagtgattcatgccwataatcccagcactttgggaagctgaggtgggaggatcacttgaggccaggagttcaaggttgtagtgaaccttgatcacagcactgtaatccagcctgggtgacagaggagtgtcccaaaaaaaaaaaaaaa

SEQ ID NO: 11256 - DNA, 56 bp, Homo sapiens; identical to SEQ ID NO: 9962

SEQ ID NO: 11257 - DNA, 72 bp, Homo sapiens
cagacactgtgctaggagaatggaaaacaattttgaacaaaactgtctacctacatgatttttttttttttt

SEQ ID NO: 11258 - DNA, 447 bp, Homo sapiens
aaggagctggagggggaggtaggcggrgcggcgcgtgacctaaggcctctctgccgcgcgcgcargtacggggcagaagtcgcagagccaaggcactgatgtttgaactggaaacttcaaaacgtttaataagagtcttcaggatgggtttgaactagacaagctagaaatttcttwagaacaccagctctagcatgcatctcccacttttggctttcctggagaggagcttgaagaggtggttctgcagacagccacagtgatactcaggaaaccagaggaatggatttracttttctgctaggattctttgttatagtttctccctgagttgtaagaggcatggaaatatacatgaaactgaagaacctgcaagaagggaagtggaactttccatgctgagtgaaaactaaccacgtggcagttgtgactgaaaacacttraacc

SEQ ID NO: 11259 - DNA, 219 bp, Homo sapiens
atgaagtaggaggatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaaaaaaaaaaaaaaa

SEQ ID NO: 11260 - DNA, 219 bp, Homo sapiens; identical to SEQ ID NO: 9948

SEQ ID NO: 11261 - DNA, 219 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaaaaaaaaaaaaaaa

SEQ ID NO: 11262 - DNA, 282 bp, Homo sapiens
gacaagaggsatcctaggaaaagggagcagaggaagaggacagagacattttctttcttttctttttgtggacgcaacggcatgtgcctgtagtcccagctacttgggaggccaaagcaggaggatcattcgaagtcagaagtttgaggctgcagtactttatgatcacacctgtgagtagtcactgcactccagcacaggcaacacagcaagaccctgttctttaaaaaaaaaaacaaaaaacaaaaaaaaaaamcccamccamccaaaaaaaaaaaaaad

SEQ ID NO: 11263 - DNA, 219 bp, Homo sapiens; identical to SEQ ID NO: 11261

SEQ ID NO: 11264 - DNA, 219 bp, Homo sapiens; identical to SEQ ID NO: 9948

SEQ ID NO: 11265 - DNA, 73 bp, Homo sapiens
cagacactgtgctaggagaatggaaaacaattttgaacaaaactgtctacctacatgattttttttttttttg

SEQ ID NO: 11266 - DNA, 224 bp, Homo sapiens
gwcwagaggcatcctaggamagggagcagaggwagaggacagmgacrttttctttctkttctttttgtggacgcaacggcatgtgcctgtagtcccagctacttgggaggccamagcaggaggmtcattcgaagtcagaagtttgaggctgcagtactttatgatcacacctgtgagtagtcactgcactccagcacaggcaacacagcaagaccctgttcttt

SEQ ID NO: 11267 - DNA, 399 bp, Homo sapiens
  misc_feature 280: n=a, g, c or t
tattttttacattttgctttagaggcagggtcttggtctgttgcccacactagaatgcagtggtgccatcacagctcactgcagccttgaacttctggactcaagcgatcctcctgcctcagctagctgactagctgggaccacaggtgcttagcacgtgcctggctgatttttcctggtctcattgttgctggggctggccttgaactccaaacctcaggcaatcctcctgccttggccacattttatgttgggattacaggcctgacccaccataccnagcctaatactatttttaaaaacaaaaagtaggaaatcaattttccttttaaatgaacactaaattataagaattaacttgggtaatctatgcaacattctcacttttttttttttttk

SEQ ID NO: 11268 - DNA, 168 bp, Homo sapiens
tatatgtagaagataacaaagcagctgtgtacagtggcttgtgcctgtagtcccaactattcaggaagctgaggctggaggatcccttgagcccaggagtgagagactgcagttagccactgcactccagcctgggcaagagtggctcctctctctcttaaaaaaaar

SEQ ID NO: 11269 - DNA, 219 bp, Homo sapiens; identical to SEQ ID NO: 9948

SEQ ID NO: 11270 - DNA, 219 bp, Homo sapiens
atgaagtaggaagatgaagccaagtcttatcgccacatctctagtatattaagattatatatggccaggcacagtgattcatgccwataatcccagcactttgggaagctgaggtgggaggatcacttgaggccaggagttcaaggttgtagtgaaccttgatcacagcactgtaatccagcctgggtgacagaggagtgtcccaaaaaaaaaaaaaam

SEQ ID NO: 11271 - DNA, 228 bp, Homo sapiens
gwcaagakgcatcctaggwwaggkagcagaggaagakgacagakacattttctttcttttctttttgtggacgcaacggcatgtgcctgtagtcccagctacttgggaggccaaagcaggaggatcattcgaagtcagaagtttgaggctgcagtactttatgatcacacctgtgagtagtcactgcactccagcacaggcaacacagcaagaccctgttcttaaaaa

SEQ ID NO: 11272 - DNA, 219 bp, Homo sapiens; identical to SEQ ID NO: 9948

SEQ ID NO: 11273 - DNA, 219 bp, Homo sapiens; identical to SEQ ID NO: 9948

SEQ ID NO: 11274 - DNA, 219 bp, Homo sapiens; identical to SEQ ID NO: 9948

SEQ ID NO: 11275 - DNA, 189 bp, Homo sapiens
tatatgtagaagataacaaagcagctgtgtacagtggcttgtgcctgtagtcccaactattcaggaagctgaggctggaggatcccttgagcccaggagtgagagactgcagttagccactgcactccagcctgggcaagagtggctcctctctctcttaaaaaaaaaaaaaaaaattaaaaagcaaas

SEQ ID NO: 11276 - DNA, 219 bp, Homo sapiens; identical to SEQ ID NO: 11261

SEQ ID NO: 11277 - DNA, 219 bp, Homo sapiens; identical to SEQ ID NO: 9948

SEQ ID NO: 11278 - DNA, 118 bp, Homo sapiens
aacacgggaacacccacctttagagatgagacacaagcaggagaagagggattaaacctgctagttttggaaaaaaaaaaaaggaaagaaaagaaaagaaagaaagaaaaacaaaaaa

SEQ ID NO: 11279 - DNA, 469 bp, Homo sapiens
ttgattttatccatttatatgtatgtgaaatctttgattatactgtcacatgtcccctgaggctctgttcattttttatttcctttctgttcttcagattggttaatttctgttgttccgtcttcaaatatactgattctctgcccctccattctgccattgagcctatccattgaatgttttttgattttttaaaaaaattctatttggtactactttgcatcttcagtttttggctgagacattctaatttgtaactcacttttaaaaatttgtctctatcgtgttcttaattgctcattgaaattgtttgggccaggtgcagtggcttacgcctgtaagcactttgggagaccaaggcaggcagattgcttgagctcaggagttcgagaccagcccggccaacgtgggaaaactccatctctattaaaaatacaaaaactaggccgggtgctgtggctcacgcctt

SEQ ID NO: 11280 - DNA, 207 bp, Homo sapiens
atgaagtaggaagatgaagccaagtcttatcgccacatctctagtatatyaagattatayatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaam

SEQ ID NO: 11281 - DNA, 219 bp, Homo sapiens; identical to SEQ ID NO: 9948

SEQ ID NO: 11282 - DNA, 136 bp, Homo sapiens
aacacgggaacacccacctttagagatgagacacaagcaggagaagagggattaaacctgctagttttggaaaaaaaaaaaaggaaagaaaagaaaagaaagaaagaaaaacaaaaaacaacaacaaacagaaaaa

SEQ ID NO: 11283 - DNA, 206 bp, Homo sapiens
atgaagtassragatgmrgccaagtcttatcgccacatctctagtayaytmagattayayatggccaggcacagtgattcatgccwatmrtcccagcactttgggaagctgaggtgggaggatcacttgaggccaggagttcaaggttgtagtgaaccttgatcacagcactgtaatccagcctgggtgacagaggagtgtcccam

SEQ ID NO: 11284 - DNA, 219 bp, Homo sapiens; identical to SEQ ID NO: 11270

SEQ ID NO: 11285 - DNA, 206 bp, Homo sapiens
atgaagtaggaagatgmagccaagtcttatcgccacatctctagtatattaagattatatatggccaggcacagtgattcatgccwatratcccagcactttgggaagctgaggtgggaggatcacttgaggccaggagttcaaggttgtagtgaaccttgatcacagcactgtaatccagcctgggtgacagaggagtgtcccar

SEQ ID NO: 11286 - DNA, 219 bp, Homo sapiens; identical to SEQ ID NO: 11270

SEQ ID NO: 11287 - DNA, 111 bp, Homo sapiens
aacacgggaacacccacctttagagatgagacacaagcaggagaagagggattaaacctgctagttttggaaaaaaaaaaaaggaaagaaaagaaaagaaagaaagaaaam

SEQ ID NO: 11288 - DNA, 219 bp, Homo sapiens; identical to SEQ ID NO: 11270

SEQ ID NO: 11289 - DNA, 219 bp, Homo sapiens
atgaagtaggaagatgaagccaagtcttatcgccacatctctagtatattaagattakatatggccaggcacagtgattcatgccaataatcccagcactttgggaagctgaggtgggaggrtcacttgaggccaggagttcaaggttgtagtgaaccttgatcacagcactgtaatccagcctgggtgacagaggagtgtcccaaaaaaaaaaaaaam

SEQ ID NO: 11290 - DNA, 74 bp, Homo sapiens
cagasactgtgctaggagaatggaaaacaattttgaacaaaactgtctacctacatgattttttttttttttga

SEQ ID NO: 11291 - DNA, 136 bp, Homo sapiens
aacacgggcacacccacctttagagatgagacacaagcaggagaagagggattaaacctgctagttttggaaaaaaaaaaaaggaaagaaaagaaaagaaaraaagaaaaacaaaaaacaacaacaaacagaaaaa

SEQ ID NO: 11292 - DNA, 219 bp, Homo sapiens; identical to SEQ ID NO: 11270

SEQ ID NO: 11293 - DNA, 219 bp, Homo sapiens; identical to SEQ ID NO: 11270

SEQ ID NO: 11294 - DNA, 206 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaa

SEQ ID NO: 11295 - DNA, 136 bp, Homo sapiens
aacacgggaacacccacctttagagatgagacacaagcaggagaagagggattaaacctgctagttttggaaaaaaaaaaarggaaagaaaagaaaagaaagaaagaaaaacaaaaaacaacamcaaacagaaaaa

SEQ ID NO: 11296 - DNA, 219 bp, Homo sapiens
atgaagtaggaagatgaagccaagtcttatcgccacatctctagtatattaagattatatatggccaggcacagtgattcatgcctatrrtcccagcactttgggaagctgaggtgggaggatcacttgaggccaggagttcaaggttgtagtgaaccttgatcacagcactgtaatccagcctgggtgacagaggagtgtcccaraaaaaaaaaaaam

SEQ ID NO: 11297 - DNA, 219 bp, Homo sapiens
  misc_feature 12: n=a, g, c or t
atgaagtaggangatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaaaaaaaaaaaaaam

SEQ ID NO: 11298 - DNA, 399 bp, Homo sapiens
tattttttacattttgctttagaggcagggtcttggtctgttgcccacactagaatgcagtggtgccatcacagctcactgcagccttgaacttctggactcaagcgatcctcctgcctcagctagctgactagctgggaccacaggtgcttagcacgtgcctggctgatttttcctggtctcattgttgctggggctggccttgaactccaaacctcaggcaatcctcctgccttggccacattttatgttgggattacaggcctgacccaccatacbbagcctaatactatttttaaaaacaaaaagtaggaaatcaattttccttttaaatgaacactaaattataagaattaacttgggtaatctatgcaacattctcacttttttttttttttk

SEQ ID NO: 11299 - DNA, 206 bp, Homo sapiens
mtgaagtaggaagwtkmmgccmwstcttatcgccacatctctagtatattaagattatatatggccakgcacagtgattcatgcctataatcccagcactttgggaagctgaggtgggaggatcacttgaggccaggagttcaaggttgtagtgaaccttgatcacagcactgtaatccagcctgggtgacagaggagtgtcccar

SEQ ID NO: 11300 - DNA, 193 bp, Homo sapiens
atgaagtaggaagatgmagccaagtcttatcgccacatctctagtatattaagattatatatggccaggcacagtgattcatgcctatratcccagcactttgggaagctgaggtgggaggmycacttgaggccaggagttcamsgttgtagtgaaccttgatcacagcactgtaatccagcctgggtgacas

SEQ ID NO: 11301 - DNA, 129 bp, Homo sapiens
aacacagggwacacccacctttagagatgagacacaagcaggagaagagggattaaacctgctagttttggaaaaaaaammaaggaaagammagaaaagaaagaaagaaaaacaaaaaacaacaacaaa

SEQ ID NO: 11302 - DNA, 128 bp, Homo sapiens
aacacgggaacacccacctttagagatgagacacaagcaggagaagagggattaaacctgctagttttggaaaaaaaaaaaaggaaaraaaagaaaagaaagaaagaaaaacaaaaaacaacaacaaa

SEQ ID NO: 11303 - DNA, 72 bp, Homo sapiens; identical to SEQ ID NO: 11257

SEQ ID NO: 11304 - DNA, 219 bp, Homo sapiens; identical to SEQ ID NO: 11261

SEQ ID NO: 11305 - DNA, 144 bp, Homo sapiens
aacacgggaacacccacctttagagatgagacacaagcaggagaagagggattaaacctgctagttttggaaaaaaaaaaaaggaaagaaaagaaaagaaagaaagaaaamcaaaaaacaacaacaamcagaaaawtgcaaaac

SEQ ID NO: 11306 - DNA, 101 bp, Homo sapiens
aacacgggaacacccacctttagagatgagacacaagcaggagaagagggattaaacctgctagttttggaaaaaaaaaaaaggaaagaaaagaaaagaad

SEQ ID NO: 11307 - DNA, 136 bp, Homo sapiens
aacacgggaacacccacctttagagatgagacacaagcaggagaagagggattaaacctgctagttttggaaaaaaaaaaaaggaaagaaaagaaaagaaagaaagaaaaacaaaaaacaacaacaaacrgaaaaw

SEQ ID NO: 11308 - DNA, 219 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggrgttcaaggttgtagtgaaccttgrtcacagcactgtaatccagcctgggtgacagaggagtgtcccaraaaaaaaaaaaam

SEQ ID NO: 11309 - DNA, 136 bp, Homo sapiens
aacacgggaacacccacctttagagatgagacacaagcaggagaagagggattaaacctgctagttttggaaaaaaaaaaaaggaaagaaaagaaaagaaagaaagaaaaacaaaaaacaacaacaaacagaaaaw

SEQ ID NO: 11310 - DNA, 489 bp, Homo sapiens
attttcttgccgtgatggccgccgccgaggcagggagttgagggtttctgcctttcggagggtttggggggctgtcggtcccgttagaaggccaccaacagccccccaggttgccaagggcctgttagttgtgttcctggaaggtgggcaagcagcctgatgggttaacattgggatttgccgtcgttatagcggtcaaggggcctgtagcggctgcagggtcggtgagggttcccagccggccggaccttggtcgtctggcattctgcctttgaaatatctgggtggccggcgcctaggcatatggggttgtgctttctgtgttgtggtttgtagcttgcatcctccactgttcttagcgcatttggctctgtccatatggctgttggtactcatggccctatttggggttggactgggctctttttcttgggtctggtgggatttaagcaagaactggaattttgtaagatgtacagcagtgtcctg

SEQ ID NO: 11311 - DNA, 219 bp, Homo sapiens; identical to SEQ ID NO: 9948

SEQ ID NO: 11312 - DNA, 61 bp, Homo sapiens
cwgatttcattagttatacagatactcatttgtgtgtgtgtgtttgtgtatagctgtatgc

SEQ ID NO: 11313 - DNA, 419 bp, Homo sapiens
  misc_feature 283..286: n=a, g, c or t
tcctgaggagtgctttasttccaactatgtgatsaattttggaataagtgctatgtggtgctgcgaagaatgtatattctgttgatttggggtggagagttctgtagatgtgtattaggtctgcttggtgcagagctgagttcaattcctggatatccttgttaactttctgtctcgatctgtctaatgttgacagtggggtgttaaagtctcccattattattgtgtgggagtctaagtctctttgtaggtctctaaggacttgctttatgaatmwrrgwvnnnnhtgtattggatgcatacatatttagtatagttatctcttcttgttgaattgatcccttgaccattatgtaatggccttctttgtctcttttgatcttcgttggtttaaagtctgttttatcagagactaggat

SEQ ID NO: 11314 - DNA, 207 bp, Homo sapiens
atgaagtaggaagatgaagccaagtcttatcgccacatctctagtatattaagattatatatggccaggcacagtgattcatgcctataatcccagsactttgggaagctgaggtgggaggatcacttgaggccaggagttcaaggttgtagtgaaccttgtatcacagcactgtaatccagcctgggtgacagaggagtgtcccad

SEQ ID NO: 11315 - DNA, 207 bp, Homo sapiens
atgaagtaggaagatgaagccaagtcttrtcgccacatctctagtatattaagattatatatggccaggcacagtgattcatgcctatratcccagcactttgggaagctgaggtgggaggatcacttgaggccaggagttcaaggttgtagtgamccttgatcrcagcactgtaatccagcctgggtgacagaggagtgtcccaaw

SEQ ID NO: 11316 - DNA, 111 bp, Homo sapiens
aacacgggaacacccacctttagagatgagacacaagcaggagaagagggattaaacctgctagttttggaaaaaaaaaaaaggaaagaaaagaaaagaaagaaagaaaaa

SEQ ID NO: 11317 - DNA, 206 bp, Homo sapiens; identical to SEQ ID NO: 11294

SEQ ID NO: 11318 - DNA, 144 bp, Homo sapiens
aacacgggaacacccacctttagagatgagacacaagcaggagaagagggattaaacctgctagttttggaaaaaaaaaaaaggaaaraaaagaaaagaaagaaagaaaaacaaaaaacaacaacaaacagaaaawtgcaaaac

SEQ ID NO: 11319 - DNA, 110 bp, Homo sapiens
aacacgggaacacccacctttagagatgagacacwwkcasgagaagagggattaaacctgctagttttggaaaaaaaaaaaaggaaagaaaagaaaagaaaraargaaaa

SEQ ID NO: 11320 - DNA, 219 bp, Homo sapiens; identical to SEQ ID NO: 9948

SEQ ID NO: 11321 - DNA, 450 bp, Homo sapiens
aataacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatacygaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgaggaggattttctgktttggaaaacaccattagaaccagaccagctttgttttgggttagagagagta

SEQ ID NO: 11322 - DNA, 219 bp, Homo sapiens; identical to SEQ ID NO: 9948

SEQ ID NO: 11323 - DNA, 60 bp, Homo sapiens
cagacactgtgctaggataatggwwwacaattttgaacaamactgtctacctacatgatt

SEQ ID NO: 11324 - DNA, 219 bp, Homo sapiens; identical to SEQ ID NO: 9948

SEQ ID NO: 11325 - DNA, 72 bp, Homo sapiens; identical to SEQ ID NO: 11257

SEQ ID NO: 11326 - DNA, 171 bp, Homo sapiens
tatatgtagaagataacaaagcagctgtgtacagtggcttgtgcctgtagtcccaactattcaggaagctgaggctggaggatcccttgagcccaggagtgagagactgcagttagccactgcactccagcctgggcaagagtggctcctctctctcttaaaaaaaaaaar

SEQ ID NO: 11327 - DNA, 225 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaaaaaaaaaaaaaaactggaa

SEQ ID NO: 11328 - DNA, 221 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccavaaaaaaaaaaaaack

SEQ ID NO: 11329 - DNA, 219 bp, Homo sapiens; identical to SEQ ID NO: 9948

SEQ ID NO: 11330 - DNA, 237 bp, Homo sapiens
gacaagaggcatcctaggmaagggarcagaggaagaggacagagacattttctttcttttcttttygtggacgcaacggcatgtgcctgtagtcccagctrcttgggaggccaaagcaggaggatcattcgaagtcagaagtttgaggctgcagtactttatgatcacacctgtgagtagtcactgcactccagcacaggcaacacagcaagaccctgttctttaaaaaaaaaaacw

SEQ ID NO: 11331 - DNA, 153 bp, Homo sapiens
tatatgtagaagataacaaagcagctgtgtacagtggcttgtgcctgtagtcccaactattcaggaagctgaggctggaggatcccttgagcccaggagtgagagactgcagttagccactgcactccagcctgggcaagagtggctcctctc

SEQ ID NO: 11332 - DNA, 219 bp, Homo sapiens; identical to SEQ ID NO: 9948

SEQ ID NO: 11333 - DNA, 219 bp, Homo sapiens; identical to SEQ ID NO: 11261

SEQ ID NO: 11334 - DNA, 207 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaaa

SEQ ID NO: 11335 - DNA, 121 bp, Homo sapiens
aacacgggaacacccacctttagagatgagacacaagcaggagaagagggattaaacctgctagttttggaaaaaaaaaaaaggawagaaaaraaaagaaagaaagaaaaacaaaaaacam

SEQ ID NO: 11336 - DNA, 187 bp, Homo sapiens
aacacgggaacacccacctttagagatgagacacaagcaggagaagagggattaaacctgctagttttggaaaaaaaaaaaaggaaaraaaagaaaagaaagaaagaaaaacaaaaaacaacaacaaacagaaaaatgcaaaactgcagaacacgcrgtgraggttggattcagaggacatggggat

SEQ ID NO: 11337 - DNA, 220 bp, Homo sapiens
  misc_feature 220: n=a, g, c or t
atgaagtaggaagatgaagccaagtcttatcgccacatctctagtatattaagattatatatggccaggcacagtgattcatgcctataatcccagcactttggggaagctgaggtgggaggatcacttgaggccaggagttcaaggttgtagtgaaccttgatcacagcactgtaatccagcctgggtgacagaggagtgtcccaraaaaaaaaaaaan

SEQ ID NO: 11338 - DNA, 219 bp, Homo sapiens; identical to SEQ ID NO: 11261

SEQ ID NO: 11339 - DNA, 219 bp, Homo sapiens; identical to SEQ ID NO: 9948

SEQ ID NO: 11340 - DNA, 185 bp, Homo sapiens
ctatactaaaaatacaaaaattagctgggcatggtggcgggcacctgtagtcccagctactcaggaggctgaggcaggagaatgacgtgaacccgggagatggagcttgcagtgagctgagatcacgccactgcactccagcctgggtgacagagcgagactccatcccaaaaaaaaaaaaaaaa

SEQ ID NO: 11341 - DNA, 162 bp, Homo sapiens
tggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgc

SEQ ID NO: 11342 - DNA, 198 bp, Homo sapiens
tatttttagtagagacacggtcttgctgtgttgctcaggctggtctcgaacgtctggcctcaagcaatctgcctgtcttagcctcctgaagtgctgggattacaggcgtgagtggcctgtattttctttcttatttattctgtggtaaaacttttaaaacacagacaacatctgtgtaatccaaaaaaaaaaaaaaaa

SEQ ID NO: 11343 - DNA, 498 bp, Homo sapiens
tgacagtaaggaaggagcagcacacacacagaggaaggagtcaggtacgcagccctgtgctgcttcccagaagcacaccagccagcagaactgagcccctagcacagttttggggagcaaagtctctgcagcttaacccctccacccccgcataatggagcttgtgtttttccacgctggagatgttggcttcaagcacgcagaaggagctgcagcatcataatggcatcccagagcagcgagccgaactcaaaatcctctccccaaaagcaaatcctcagacaccccagtaactacctttttattccatccaagctgtgaactttcaatgcattcggctctgagaagggagtaaaatatctttgtgctcacgaacgcaaacgggcagaaagtgaggactttgtagatgggcacgaggctgcattttaatgtcactgkgccttctacgcaaagctgbttattgccctgttgaaaacagacccmaaaaaaaaaaaaaaa

SEQ ID NO: 11344 - DNA, 388 bp, Homo sapiens
cccttccgtgctgagccgcctgcaggacgcggccgtggtgcggcctggcttcctgagcacggcagaggaggagacgctgagccgagaactggagcccgagctgcgccgccgccgctacgaatacgatcactgggacgcggccatccacggcttccgagagacagagaagtcgcgctggtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcggstggtgcacacccaggagccg

SEQ ID NO: 11345 - DNA, 426 bp, Homo sapiens
atacgggaatcgcggagcttagctgtcgccacctcgcgccgggtccgcgcggcccacgggaccccccactgacgcccccggccagcggtccacatggacgtgcggggccctgaagcccccggcgggcgcgcgctgcgggacgcggcagaaaatctatttcaggaacttcaggaacattttcaagctctgacggcaacattaaacctcagaaatatccttttctacctttaacaaatgctgtgattctttcggactggtagattatcatggagtatctttttgttgtctggtagtagtaggtaatagtttacttaggatttcccagtatttacttctgtgcttttatgtggcttcctgatgtgttaattacccctcacctatagcaaaagctgtacctycggccgggtgcagtggctcacgcctgta

SEQ ID NO: 11346 - DNA, 430 bp, Homo sapiens
attcacctcgcggccacaggagctcagcgccggcgccgcgccgcccagccccgccgagaggggcgcactcgccgccgcggggcccgccgccgctcaccgcagccccctcctggcgacccgcaagtgatgctgtgattgttgcctgcggactgggaagcacgatggctccaaaaggccagcggggccgagaagcagggacagagaccagcatttaagggatctctggtgggggcctccctggagttctccacatgtaaatatagcgaaaaaagaaaacactacgttactagaataaacacgtcctaaaatttctgtgcaaaaacacctttttgaacagcaaagatttcacccaccaaaacaaggaagcaagaagcttccacagtgtgcaggatccgaaacaggaccggcccsgcgttgggtgagagtgggg

SEQ ID NO: 11347 - DNA, 440 bp, Homo sapiens
accgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtc

SEQ ID NO: 11348 - DNA, 382 bp, Homo sapiens
agggaagcttggttaaaaacagttatggcagtgggagtcgaagcgagggtctgaagttcacgactactagaaggggaggggagtggaaaggctctcastgaaaaaggtattagaattatttctgaattatcagtctctcatttgtgctttggagaagcasaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtc

SEQ ID NO: 11349 - DNA, 483 bp, Homo sapiens
taaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggargggggaacatggg

SEQ ID NO: 11350 - DNA, 410 bp, Homo sapiens
aaaagcactcttggacacacagccaatctctggttgtgatatttccccattgattccttccttgttaacaaggtcattttaatggttcagaagttggagcagcagaagctgggaaccagagcttcattcttggaacatkggcacgtgctgtgtgtttcctgagacccaaataacctcagataaggaaactaatactaagtgagagaagatgtttgctgacagatgttcttgccctaagtcagtggcttctgaaacttggctgcattaaagtcacctgtggcactttttaaaaatacctgtggagcaacaggaacgctcattcattgctgcaattgtactttttgatatttacccagaaagactgaaacttctgtccacacaaagatgtttatagcagctttattcataat

SEQ ID NO: 11351 - DNA, 427 bp, Homo sapiens
  misc_feature 84,93: n=a, g, c or t
aagtgcccgcgcascggtttccggtgcaggtggggaaaatggcggtgtctacagtgttctcgacttcgtcgctgaagctaaacnagccccagnaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataamcctctcctaggacatacatgtaaatgcacaatgtgactcattctcatacttttttgttcagctctgagcctcaaaagtgat

SEQ ID NO: 11352 - DNA, 342 bp, Homo sapiens
atttccttctcacattgcaacaattattccttctcagcagtcccctagtcttaactcactccagcattaactcagaagtccacagaacaaagtctcatctgagacaaagcaagtcccttccgttgatgagcctgtaaaatcaacaacaggttagttacttccaagatgcagtgggggtacagggatgggtaaatgttcctgttccaaatgggagaaattggccaaaacgaagaggctacaggccccatgcaagtccaaaactcagcaggacagtcattactacccacgctttgttacattgaggacccaggttagattcttgcttgtcttgcttttagtggr

SEQ ID NO: 11353 - DNA, 330 bp, Homo sapiens
actgtaggggaggcggggctggagggagatggcgccgcgctcccggatgaacagagaaagagacaggataagggcctcgctctgttacccaggctggagtgctgtggtgtgtttgtgactcaccgtagccttgaactcctgggctcaagcaatcctcccacctaagcctctggagtagctgggactacagttctccttcaccttcctccatgagtagaggcagcctgaggccctcaccagatgcagatgcccaaccttgaactttccaaccattcagagtcattagccaaataaaccttttatctttataaatcaaaaaaaaaaaaaaaa

SEQ ID NO: 11354 - DNA, 409 bp, Homo sapiens
  misc_feature 59,106,339: n=a, g, c or t
atagccacggtagtcgtggcgaccaagcaacccggcaacgcgagtcaacaacaacaacngcccggccgacccccacccccrscccccaggcccggcccggggaccncaggacgtcccgtccccttcccaacatcgactccgagacctccgaaaagcgtttccgcagacagaagtggggagaagcggagagacggggtttcgccatgttggccagactggtctcgaactcctgacctcagctgatccacctgcctaggcctcacaaagtgctggaattataggtgtgagccaccgtgcccggcctgatctcattggatctttgcagcaatttgatgaawngggtgttctcgttatccccaggtgacaggcaactgaggcccagaagaaggaattaaaaaaaaaaaaaaaa

SEQ ID NO: 11355 - DNA, 471 bp, Homo sapiens
aaatttgttaatagagtagatctcatggtgtattcctatcacaataaaataaatattaaaattaaataaaacagaccagtacatagcatgtgtggtcactgcaggagataaagcctgaagcagagaggggaaagacaaaataacaggcttctcccctcttcctaccttccaaatctcaacccagtggctccattgactccacctacctggaagctggttagccatggaggtggtgaaacatgtgttgcaggaatcagcaccccaagaaacaagcagaacaggggaaaaccagggaggacaaagagaaaagtgactgacagagtggaagaaaccaaatctatcaatgcatagaaccattatattttgggagagatacttctcatactcaatcaaaagtaagacttgttggctgggcatggtggctcatgcctgtaatcccaacactttgggaggccgaggtgggcggatcac

SEQ ID NO: 11356 - DNA, 307 bp, Homo sapiens
aaggaargggaaggggaagaggaggaakggaaggaagggaaggaaaggaagaaggaagtttgcctcttgaatttttctagtctgaacctttctactaaatatctattgtgttgttcgacagttatttgtaaacatgaggtcagattctgggcaactttaggcatctcaaaagtttgttgtatgtgcaatcaagagtaaagatccggctgggtgcgatggctcatgcctgtaatcctagcattttgggaggccaatgtgagcagatcacctgaagtcgggagttcgagaccagcctgactaacatggr

SEQ ID NO: 11357 - DNA, 107 bp, Homo sapiens
  misc_feature 107: n=a, g, c or t
ctggaaatatttgtagatgtaagttatgatcagcatttagcttgcctatccattgttctggttcaaagagttttgcatgttagccgatctcaaaactaaacatcttn

SEQ ID NO: 11358 - DNA, 330 bp, Homo sapiens
  misc_feature 152,292,316: n=a, g, c or t
ttaaatttttaattttttgtgggtttttgttttgttttgttttgtttttgagacggakyttgctctgtggmccaggctggagtgcagtgacacgatctcggctcactgcaagctctgcctcctgggttcacgccattctcctgtctctactnaaaatacaaaaattggcctggcattggcacacgcatgtagtcctaactactcggggggctgacgtgggagaatcgcttgagcctgggaggcggaagttgcagtgagctgagattgtgtcactgcgctccagcctgggtkncagagtgagaccctgtctcagcanaaaaaaaaaaaaaa

SEQ ID NO: 11359 - DNA, 192 bp, Homo sapiens
acaatatttaagttctctgcttctgcatttggttggtttcctgaagcgcagccctgtgaataacaggtggsttttcatggatgtctctagtcagagaaaaatgataaaggcttaaattgaggattaacagaagcagattaacctcagaaatcctgtctggctggcagatttcaagtaaaaaaaaaaaaaagg

SEQ ID NO: 11360 - DNA, 464 bp, Homo sapiens
attatgatctagtatgatttcttctgcattatcaggtaaccacaggtaattcataaatattatccgtggaatttacttacttaatatctgtatgagtctttatattggcatgtgaggtttttcatagttcagtaaaagcttgactcagtcagagggatcacagaattacatgtttctttttcacccaccaacattttgttgaaaatcttgttaaagtgcattctttcttttttttgatgtactatatggaatgtaagaccattttttaaggtaataattggtagtgttaatatagtaacatagataaaatacaagggaatttgatttaatctggattgatgccttggaagacttaaaatctttatagaaacctttcctcaaggctgggcttggtggctcccasctgtaatcccagcactttgggaggccaaggtgggtggatcacgagatcaggagattgagac

SEQ ID NO: 11361 - DNA, 74 bp, Homo sapiens
caattgtgttcgcagccgccgccgcgccgccgtcgctctccaacgccagcgccgcctctcgctcgccgagctcs

SEQ ID NO: 11362 - DNA, 523 bp, Homo sapiens
acacacttcscmcagagaagcctccgagcgcggccgccattccgggcctcaagcccataaagaaaaaataccggagaggttctggcaccatttcggggtgccaaagcagccatggaagagcctgcagctccctcagaagcccacgaggcagccggggcccaggcaggtgctgaggcagcaagggagggtgtgtctgggcmrggaccttcccgtctgtgagccctccgggaatctgctgctccagattcagccctgccacatgcggcaaggggctgggcccccttccctgtagctccagtccctgcccacctccgcagaggaggcctgaggctgccccagcctcaggadkaggagcctggcccagtccgtttgccaagccgaagcagcggcatttggacaaagcagatcatctgcaggtgaacggcatgggattctgagaaccagggaaggagagccaagtcataaaaggatcggtgccgagtgagtcctttgaatggktcatggaacagaacttctcagtctt

SEQ ID NO: 11363 - DNA, 415 bp, Homo sapiens
  misc_feature 172: n=a, g, c or t
agaggacgagacagcgagaggaacagcgtccggggcgacccccagtccaccgcgggggcctggcgcgcttggggcaaaggccctaggagaccccttctggccacaaaatcgagtatgacagaaaagggccagcgggggcgctttccttccagggccacttgccggaatgtmngagggacggagagacgtccggaaaaggctgccacgctcggagcgctgcgccaggccaggcacctaggccaggggagcggagacctcgtgggagcgggcagggggacctttcccctctcccgggcttccacccaggcgcctccccgctgtgaacgccgccgcccaggtgaaggggaaaccggccacgtttccggacctcggcggggcacacggtctccggttttcaccggctctgtcttggagc

SEQ ID NO: 11364 - DNA, 447 bp, Homo sapiens
cttcttgtttttcagactgtcagcatcaataaggccattaatacgcaggaagtggctgtaaaggaaaaacacgccagaaatatccttttggatgttgcttggaagaccgaccctgagggaggtcagctcatggggactgaggtcagggccaggctgccttgctcagctccaggaaggggcaaccctgcacaggccaggtccctgcagcttctgatgacggcagcttctcagagagggctggctgcagagaccacagaccttcagggtggcagacaccaaaaaggctgtggagcccaggcctttcaacttgccaaagatcctgctcctttccttaggacttaagcactcctttttttctttttccaaaaggggtcttgccgtgttgcccaggctggagtgcaatggcgtgatcatagctcactgcagcctcaaactcctgggttcacg

SEQ ID NO: 11365 - DNA, 281 bp, Homo sapiens
ctaaacttgatagttttctttaaaatggactataatattcaaattatattaatgagggtttccttattaattaatgaattaaatgttttgcattttatatctgtgtaacagtatatccttttaaaatattaatcttgtggccgggtgtggtggttcatgcctataatcccaacactttggggggccaaggcaggcagatcgctcgagctcaggagttcgagaccagcctgggcaacatggtgaaaccctgtctctaccaaaaagtaaaaaaaaaaaaaaaa

SEQ ID NO: 11366 - DNA, 505 bp, Homo sapiens
atttattctccagctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttkgggacgccttcctggtcccgaagaaacactcccaggacaggacagctggaacggggtccccagcagggccggactg

SEQ ID NO: 11367 - DNA, 306 bp, Homo sapiens
ttaacattaaggccgggcgcagtggctcacacctgtattcccagcactttgggaggccgaggtgggcagatcatgaggtcaggagattgagaccatcctggctaacacgatgaaaccccgtctctactaaaaatacaaaaaattagccgggcgtggtggcaggtgcctgtggtcccggctactcgggaggctgagacaggagaatggtgtgaacccaggaggcggasttgcagtgagctgagatcacgccactgcactccagcctggatgacagagcaagactctgtctcaaaaaaaaaaaaaaaa

SEQ ID NO: 11368 - DNA, 440 bp, Homo sapiens
  misc_feature 369: n=a, g, c or t
ttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgacamccgcacccggcagagttttataatgaaaaattaactaatattctagtatgaagtgaggaggatactgaacaggatgtggctaaagcnaacctgggacagccatggggtggcttggtttcttcactccagtgttgtccctaccatttcgcagcattgat

SEQ ID NO: 11369 - DNA, 498 bp, Homo sapiens
taaaatcttgttgaattttaaacttgtttggaaggtgtgtcctgattttttttcttgcatctttcttgagcttggatacttctttccatgttttatcctaaaaacgtggtattgtatacacgtcttttaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccwwttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccaacaa

SEQ ID NO: 11370 - DNA, 439 bp, Homo sapiens
tttttatggatgcatagtattccatggtgtatatgtgcgacattttcttaatccagtctgtcattgatggacatttggcattgcttcgttcaagcctttgtgttcagatctgccctgttatcagagacaagttgatgtcaacttacctcttatctctgatcaataactgttgggcttcctgtgggttgactgaagacccataagattcatgagacccatacgatcatgtgggttgatgatctccaccattctgaatctcaagaaaccaaagatgattcttgaatgtgtgtttttgttaagatccctttggctgaaggaacagaactcaatcctgtctagcttcaaaaaaaacgagaggggcagcatttatatgtttactgtgttttgaggtgtagtgcatgaacaattgaatgcacagaaactcttggactcaaaaaaa

SEQ ID NO: 11371 - DNA, 341 bp, Homo sapiens
taataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaagbactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattca

SEQ ID NO: 11372 - DNA, 278 bp, Homo sapiens
agaagcgggastgaggggagagagaggccggtcctggtctggccgctgcggctgctagcccgaggtctccaagccgggctgcggctccatcctcggctcctgggcaccgtctgcgaggctccgcgaccagagtgagaaagccgcgggcgcaaccgcgattycatgtcagccaaggacgagcgggccagggagatcctgaggggcttcaaactacagtaaaccggaaactggagaattgagagatttcagaagcaacgttttcatctgattggaaatac

SEQ ID NO: 11373 - DNA, 325 bp, Homo sapiens
aatttggggagcagggattggagccgggaggtggggaaagccagcccctccgttcccamtctccggggtcgctgcgagcacagtgtctcagccargggcaaggccsgggramtcctgsgrraaaccmcgggscggagagcagcagccgcgcgggcccagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcttcctgttaaaattctcaaaagca

SEQ ID NO: 11374 - DNA, 644 bp, Homo sapiens
cgtttgttaattggttgaatttaaacattggacagtgtatatatgtcaaaacatcgtgttgcacatggtaatgtacactattatctgtcactttttaaaaagttaaaaaaaattaatgttatagatcctgtaagtaacagaatttcaacttagatcagtattaagttagtacaagattagcaagggtagggtttattatgtagctattaataattgatgattttcttttggtctcatgctaaaatagaatgtccctgagtaggtgatatatatcttggaagtacagatgatctccaacttatgatggtttgacttaaaatttttgttgtataagccatattcattcagtagaaacaccttcagtagacactgtatgttgtattttgaattttggtctttcccaggctcctgatacatggtatgatgctctcttgtgatgttgggcagtggcagtgagccatagttcccattcagtatactgtgttgccaagtggttttccccgactgtaggctaatctaactgatctgagcatgtttaaggtaggctaggtaagctatgatgtcagtaggttaggtgcaagyaatgttcgtttgagactaggtcttgctctgtcacctasactggagtgcagtggtacatcatg

SEQ ID NO: 11375 - DNA, 610 bp, Homo sapiens
ttactttgtctcctgtgctgaagtgcagtggtacgatcttggctcggtgcaacctctgcctcctgggttcaagcaactctcacgtctcagttacctgagcagcggggattacagccatgtgccaccatgcccagctaacttttgtatttttagtagagacggggtttcaccatgttgggcaggctggtctcgaactcttgacctcaagtgatccacccacctcagcttcccaaattgctgggattacaggtgtgagccactgcgcctggcctcaagagaaatctaataaagtattgtggagctccagggaggtgtatgagtacacatcttgttagagacattagaaaagtctttttaaaatgggtgtggaggccaggcacagtggctcatgcctgtaatcccagcactttgggaggcagaggcaggcggatcccctgaggtcagttcaagaccagcctggccaacatggtgaaacccgtctctactaaaaatacaaaarttagccaggtgtggtgtcaggtgcctgtaatcccagctactcaggaggctgaggcaggagaatcacttgaacccgggagcagaaattgcagtgagcctagatcacactacg

SEQ ID NO: 11376 - DNA, 489 bp, Homo sapiens
  misc_feature 2..3,30: n=a, g, c or t
dnnttaadatttttgaggtctgttttacwnagawggacgttgagtttccggagacctgagtcccacgtccaaagtctagtcactgaggggtggagcagggaggacagttacagacagcagagctcagcttctgtggggctggggctcatcctcaagactccagcctgctccatcctcccagcccccaagggctttaggctgatggaggacgcagaacactgttcattaaaatagaggtctatgatttagcacagcaagagtgacaaaagagtgtttgttattagttccaaacagggagaaaccacggtgggctgactggcagggaagagttgattgawwgactgcagagcccgactgtgtgggaggaggtgggcagccaggggagggacacatacctgggcatcatgtcctggtggttggagactcctgaacacatgggagcctcgtgggagccctcagggaggtgcaagctggagaggatcgggtcac

SEQ ID NO: 11377 - DNA, 482 bp, Homo sapiens
caaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgata

SEQ ID NO: 11378 - DNA, 295 bp, Homo sapiens
actttagctgccatcttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgtgaagttccctgaaggagcgagacagggagggacagggcagaggaggagtgacctgcagagcaagtttgaattggtaaatagaaaacaagaataaaatagtttgctgtttacattccaaaaaaaaaaa

SEQ ID NO: 11379 - DNA, 63 bp, Homo sapiens
aaagcccaatacttagagtcccaattttgtctcatttgccaaaaaaaaaaaaaaaaaaaaaar

SEQ ID NO: 11380 - DNA, 334 bp, Homo sapiens
agattaaatctattaatttttctctagcccatgtaagaatcccatttatggctgggcgcggtagtcacgcctgtaatcccagcactttgggaggccgaggtgggcggatcaggaggtcaggggatggagaccatcctggctaacacgatgaaaccccgtctctactaaaaaatacaaaaaattagctggccgtggtggtgggtgcctgtagtcccagctactcgggaggctgaggcaggagaatggcgtgaacctgggaggcggasttgcagtgagccgagatcccgccactgcactccagcctgggcaacagagcgagactctgtcccaaaaa

SEQ ID NO: 11381 - DNA, 437 bp, Homo sapiens
caaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtasctgggdtgacaggvacccgccaccacacccagctaatttttgtacttttagtagagacgaggtttcgccatgttggccaggctggtctcgaactcctgacctcaggtgatccacccgcctcggccttccaaagtgctgggattactggcgtgacamccgtgcctggccagaataggttttttctttcaacttgatcagtagaaaatggacatcaagtttgaacagataaatcatggacagccttattgtgattgaaatgcttgtaggty

SEQ ID NO: 11382 - DNA, 105 bp, Homo sapiens
acagttgctgctaactgccctggtgtgtgtgagggagagagagggagggagggagagagagcgcgctaskgamavsagcgagtgagcaagcgagcagaaaagagg

SEQ ID NO: 11383 - DNA, 401 bp, Homo sapiens
  misc_feature 375: n=a, g, c or t
ataatttgaaaaatgtcatattttacaagagtgtattctgtcatcttccaaaaatattgaaggtggagtttttttttcctttattacattttattttttaatttttttttctttttttcttttgttttctgtagagatgaggtctcactatgttgcccaggctggtctcaagcgatcctcccaccttggcctcccaaagagctgagattacaaaggcctcccaaagagccactgcacccggcctattacattttaaatgaggactaatagaggccaggtgccatggctcatgctgtaatcctagcacttggggaggccgagatgggaggattgtttgatgccaggagttcgagaccagcctggtgaacatagcangaccccatcttaaaaaaaaaaaaaar

SEQ ID NO: 11384 - DNA, 326 bp, Homo sapiens
atgggacatagtcttaaaaatgtctgaaacaggctgggcatggtggctcacacctgtattcccagcagtttgggaggctgaggtgggtggatcacgaggtcaggagaccgagaccatcctgaccaacacggtgaaacctcgtctctactaaaaatgcaaaaattggctgggcatggtggtgtgcacctgtagtctcagctacttgggaggctgaggcaggagagtcatttgaacccgggaggcggaggttgcagtgagccgagataggccactgcactccagcctggcagcagagtggagactccatctcaaaaaaaaaaaaaaaa

SEQ ID NO: 11385 - DNA, 233 bp, Homo sapiens
  misc_feature 201: n=a, g, c or t
ggtgtccgcgtttggagctgggcgtgcgggtctcagtggcggcctcggcattcggggcggcgggaggcgcmggtrcatccccgggacggccaggagcaaagacggagaggagaggggggttagasmaaggaggymttgtgtctgtgtgccttaggggaggaggggactgcaggaatcgaataaacgcakcgagctgcgcgnggctgctggaagcccaggcgggggaagggggc

SEQ ID NO: 11386 - DNA, 292 bp, Homo sapiens
  misc_feature 292: n=a, g, c or t
tatatgtttggctgggtgtggtggttcacgcctgtaatcccagcactttgggaggccgaggcaggcggatcacaaggtcaggagatcgagaccatcctggctaacacggtgaaaccccatctctactaaaaatacaaaaaattagccgggcatggtggtgggcgcctgtagtcccagctactcgggaggctgaggcagaagaatggtgtgaacctgggaggcggasttgcagtgagccgagatcgagccagtgcactccagcctgggagacagagcgagactctgtctcaan

SEQ ID NO: 11387 - DNA, 493 bp, Homo sapiens
cctttagctgccatcttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcataggaggagaggaaggcgatgcgacggacaggcgcacccgctcaggctgactctcgggggcgaggtcgagccaggggcggctgcctgggggcgaggcgacgctgtctcaacctccacctcgcggcggaacccgaggacaagagcctcagatgaaagaaacaatcatgaaccaggaaaaactcgccaaactgcaagcacaagtgcgcattggtgggaaaggaactgctcgcagaaagaagaaggtggttcatagaacagccacagcagatgacaaaaaacttcagtt

SEQ ID NO: 11388 - DNA, 525 bp, Homo sapiens
  misc_feature 463..465: n=a, g, c or t
ctctgtgcgccgcgagagggaggccgcctgcagcccggctgctcggccgccgcgggccctgctccgggggttcagttttaatgaagaatccctgctcccttctcgcgcccctcccgctttctgcccacctccctggggtctggaaggagagggtcgcccctccccgctttggctgctaaactctctggctctccccccggccgctgcctgggttctggtggcttccttcctcctccttgtctgtcggagctcaagggacaagccctttccctggcgcgtgcctggtgaaaccctcgcacccttccccacccccacaagcctttggcatggcctgggagactccgggcatcttcaacccagccagggacaagggtccgcggagggtctggagcccctcgtgggcctggtgccacggawkcccacccctgccctccaggagcccctgggaaggcagcactctggnnnvggaggaagccagacccagctacaagggagggavcctcggctgatgcaaagaggccggag

SEQ ID NO: 11389 - DNA, 543 bp, Homo sapiens
cmaaaagttgttaatgctcactacctatatctatttgtygagaattaamaattcttatattctattaycyyhcyytttattcattggaatagttgtgtaacaacatgtcctctcatctactattttgttacccagttcacctaggaaaggcaggataaatgtytgaytttytttccccttcattgaccagttttcaagataattaatcagttcccatcatgagagatgatgtttgasctaagacctgaatgaagagccagctattcaaatatctggaggaagaggccaggggtggtggctcgtgcctgtaatcctagcactttgggaggtgggcagatcgcttgagctcaggagtttgagaccagcctgggcaatgtggcgaaactctgtctctacaaaaaatacaaaaayyagctgggcatggtggtgcatgcctatagtctcagctgcttggagagctgaggcgggcggatcgcttgaacctggcagtttgagactgcagtgagctttgatcacaccacagcactccagccggggcaacay

SEQ ID NO: 11390 - DNA, 372 bp, Homo sapiens
actccccagctgcattcccggaggcgccctttcgacctggaggccgggtctgctggccacagggctgccgcactggctgggactgccagctgggcctggagacgctggtggctgtggactccccagcttggagcagtccctctttgtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaacaaaaaaaaaaaaaaaa

SEQ ID NO: 11391 - DNA, 302 bp, Homo sapiens
aaaattgtggcagtttctggccgggcgcagtggctcacgcctgtaatcccagagctttgggaggccgaggcgggcggattacctgaggtgaggagttcgagatcagcctgggcaacacggtgaagccccgtctctactaaaaatacaaaattagccgggcgtggtcgcacatgcctgtaatcccggctgctcgggagcctgaggcaggagaatcgcttggacctgggaggcggaggatgcggtgagccgggatcgcgccattgcactccagcctgggcaacgagtaaatctccgtctcaccr

SEQ ID NO: 11392 - DNA, 521 bp, Homo sapiens
tccctccttacggggcaaggttggcagtccaggaatggtggggaggcgggtgtgatataacaggaatcagattctagcctcagatatttctgtttctttcccccagactctgggatgtgaagaggcattcttgtttctcaagtcctggttcttccacatactacttctgtgacttaagacagtttattctttctcagcccccatttgatcatctgtagtatgggaaggagtgtaataataaatactacccatttgagagggttgggaggaaagagatcatgtgtgtaaaatgcttagtactgataaaatcttagtgtttgctgagatgatgatgatgatgagtgattatgatggcaaaggtgatgataaaagtttgcaggggctgggcgcagtggctcacgcctgtaatcccagcactttgggaggctgacgcaggaggatcacgaggtcaggagatcaagaccatcctggctaacacggtgaaaccccgtctytactaaaaatacaaaaaaaaaaaaaaa

SEQ ID NO: 11393 - DNA, 353 bp, Homo sapiens
agtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctggagatgctcagtcccagtatactttaaggaagagaaatataaaggaaatttagtatgcctccttttctttaaatgaagaatttagtttcctttacttcttaaaaggagaatacctgttcttgtataacgtkactgcamcagacattctgaaaaatcagcaagaagcaaaagctggaaatags

SEQ ID NO: 11394 - DNA, 377 bp, Homo sapiens
atgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcm

SEQ ID NO: 11395 - DNA, 212 bp, Homo sapiens
agcctgaccaacatgttgaaaccccgtctctactaaaaatacaaaaattagccgggcatggtgtcacgtgcctgtaatcccagttactcaggaggctgaggcaggagaatcgcttgaatccaggaggcagaggttgcagtgagctgagattgcgccactgcactccggcctgggtgacagagcgagactccatcccaaaaaaaaaaaaaaaa

SEQ ID NO: 11396 - DNA, 458 bp, Homo sapiens
catgtaaattaagttctagagaagctctccgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttc

SEQ ID NO: 11397 - DNA, 148 bp, Homo sapiens
gcgccctcgcagtcaccgccacccaccagttcctatatcgggccccccattcatccactcacactcccagccaccatgttacactggactctaagccacttcttactccagtagtaaatttattcaataaacaatcattgacccatgc

SEQ ID NO: 11398 - DNA, 147 bp, Homo sapiens
tacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaa

SEQ ID NO: 11399 - DNA, 375 bp, Homo sapiens
cacaagattaaatgaaggagatagatattaattacataatttcataaataattgattgattaaaactatggtaagtgctggctgggcacggtggctcacgcccataatcccagcactttgggaggctgaggcgggcggatcacggggtcaggattttcagaccagcctgaccaacatggtgaaatcccatctctactaaaaatacaaaaattagctgggtgtggtggcatgcgcctgtaatcccagctactcaggaggctgaggcaggagaatcacttgaacctggggggcagaggttgcagtgagccaagattgtgccactgtcctccagcctgggtgacagtgcgagactccatcccaaaaaaaaaaaaaaaa

SEQ ID NO: 11400 - DNA, 234 bp, Homo sapiens
attcagatttgagacctggagtgataaagagttacacatggccaagcactacacttcagggctcacagccccctgagatgaagtctcactctgtcatctaagctgaagtacagtggtgcaatcatagctcactgctatcttgaactcctgggacttcaatgatcctcctgcctcagcctcccaagtagctgggattacagggaagacaaaaaactatgaaaaaaaaaaaaaaaa

SEQ ID NO: 11401 - DNA, 77 bp, Homo sapiens
catgcttgattaaaaattgcaggccaggcacggtggctcgtgcctgtartcccagcattttgggaggccagggcags

SEQ ID NO: 11402 - DNA, 394 bp, Homo sapiens
caattcattatggtgttgtgctttttaaatacactttttttgttgttgttgttgagaaagggtgtggctctgtcgcccagcctggagtgcagtggtgcagtcatggctcactgcagccttgacctcccggggtttagtgatcctccgccctcagcctcctgagtggctgggaccccaggtgagtgccaccacacctggctaattttttcattttttgtggagatgaagtcttgctatgtttcccaggctggtctcagactcctgggctcaagtgatcvwcctgcctctgcctcctgaagtgctgggattacaggcatgagccaccatgcccagtctgaaatatactttcatagtaaaccagttataacaaaaagactcaaccacttcatctaaa

SEQ ID NO: 11403 - DNA, 406 bp, Homo sapiens
aacaattagagatactttatttatttatttatttatttgagatggagtcttgctatgtcacccaggctggagtgcagtggcacagtctcagctcactgcagcctctgactccggggttcaggcgattctcctgcctcagcctcccgagtagctgggattacaggcgcccgtcaccacgcccggctgatttttttgtattttttggtagagatggagtttcaccatgttggccgggctggtctcgaactcctgaccttaagtgatctgcccgcctcggcctctgaaagtactgggattacagcataagccactgcacccagccagacaattagagatattttagaggagagtacaagggaaaactttcagagtggaaggaatggttgtcccaaagaaaaaaaaaaaa

SEQ ID NO: 11404 - DNA, 350 bp, Homo sapiens
aaaaaacctaaacgtctcttctggatctccagaaaaaaagtgctgctctaggccgggcgcagtggctcacgcctgtaatcctagcactttggcaggccgaggcgggcggatcatctgaggtgaggacttcgagaccagcctagccaaaatggtcaaagcccgcctctactaaaaatacaaaaattagccgagcgtggtggcacgtgcctgtagtcccagctgcatgggaggctgaggccggagaatcacttgaaccctggaggcagaggttgcagcgagccaagaccgtgccactgcacttcagcccaggtgacagagggagacgccctctcacaaaaaaaaaaaaaaaa

SEQ ID NO: 11405 - DNA, 64 bp, Homo sapiens
cagttagcccagatcatgccagcctgggtgacagaacaagactgcttcttaaaaaaaaaaaaaa

SEQ ID NO: 11406 - DNA, 193 bp, Homo sapiens
ccccatctctcctaaaaatacaaaaaattagccgggcatggtggtgggcgcctgtagtcccagctactcgggaggctgaggaaggagaatggtgtgaacctgggaggtggagattgcagtgagcagagatcgcgccactgcactccagcctgggcgacagagcaagattctatctcaaaaaaaaaaaaaaaar

SEQ ID NO: 11407 - DNA, 294 bp, Homo sapiens
cattttagaaggatctatttggaaggatccatttggaaggattgcttgagcccaggagttcgagactagcctgggcgatgtgatgagacactgtatttacaaaaatacaaaaaaattaaccaggtgtggtgacatgtgcctgtagtcccagctattcgagagcctgaggtaggaggatcacttaagcctagggaggccaaggctgcagtgagccgagattgcaccattgctctgcagccagcctgggtgacagagtgagaccgtgtaacaaaaaacaacaaaaaaaaaaaaaaa

SEQ ID NO: 11408 - DNA, 460 bp, Homo sapiens
ttactactagacctaagaaatgagatagatggcaactcaataatagtggggaactttaatactctactgacagtactagacaggtaatcaagacagaaggtcaacaaagaaacaacagacttaaactatactctagaaccaatggacttaacagatatttacagaatattctacccagcaactgcagaatatacattctgtttataagcacatggaacattctccaagatagaccatatgataggccacaagaaaagtctcaataaatttaaggaaattgaaattatatgaagtactttctcagaccacagtggaataaaattgaaaatcaactctgaaaggaacctgcaaaaccatgcaaatatatggaaattaaataatttgctcctgaatgatcattgggtcaacaatgaaatcaagatggaaattaagaagtttctttgaattaaacgataatagh

SEQ ID NO: 11409 - DNA, 401 bp, Homo sapiens
cacctgtgtattctcttcagtgaatcatctggatgtcttttgcccactttctttttttttcatttttattattttcattaatttttttctttggccactggaataaagactcaccattttctaactgagtgatgttttttaaatatatattttttagagacagggtctcactctgtggcacagagtsawttgtagctttgaactcctcagctcaagctgtcctcccgcctcagcctcatgagtagctagtactacaggcacatgccactacacctggctaatttttttatttgtttgtggagacagggtcttactatgttgctgaggctggtgtttaactcctggactgcagtgaccctctcatctcagcctcccaaagtgttgggattacaggcatgcgc

SEQ ID NO: 11410 - DNA, 428 bp, Homo sapiens
cagggttgttgaagatcatatatttgtagctgtgtggccttattactgggttctctgttttgttccattggtctaagtgtctgttttgtaccagtaccatgctgttttggttactgtagcctgtatcatagtttgaagttgggtagcttgatgcctccagctttgttctttttgcttacaattgcctttgatattcaggcgttcttttttttccttgttccatttgaattttaaaatagcattttctggttctgtgaagaatgtcagtggtagattaataggaatagcattgaatcagtaaattgctttgggcactatggctattttaatgatattaattattcctatctatgagcatggaatgttttcccatttgtttgtgtcatctgtgatttcttcgagaagtgttttgtagttctctttgtaga

SEQ ID NO: 11411 - DNA, 203 bp, Homo sapiens
tccattatgggaggctcattaaaagttggaagaakgccgkgcgcggtggctcacgcctgtggtcccagctactcgggaggctgaggcgggagaatggcgtgaacccgggaagcggacttgcagtgagccgagattgcgccactgcagtccgcagtccggcctgggcgacagagcgagactccgtcccaaaaaaaaaaaaaaaa

SEQ ID NO: 11412 - DNA, 326 bp, Homo sapiens
atgggacatagtcttaaaaatgtctgaaacaggctgggcatggtggctcacacctgtattcccagcagtttgggaggctgaggtgggtggatcacgaggtcaggagaccgagaccatcctgrccagcacggtgrracctcgtctctactraaaatgcaaaarttggctgggcatggtggtgtgcacctgtagtctcagctacttgggaggctgaggcaggagagtcatttgaacccgggaggcggaggttgcagtgagccgagataggccactgcactccagcctggcagcagagtggagactccatctcaaaaaaaaaaaaaaaa

SEQ ID NO: 11413 - DNA, 99 bp, Homo sapiens
caaaatattawaaataaaaggttgggacaaaagaatagcatgagaacacatggaagtaaaaagcagggatcacaatattgcttttctgttaaaaaaaaa

SEQ ID NO: 11414 - DNA, 57 bp, Homo sapiens
tagccaaaaggcagagaagtgatgaccctgtctttaaaaaaaaaaaaaaaaaaaaaa

SEQ ID NO: 11415 - DNA, 428 bp, Homo sapiens
  misc_feature 232,255: n=a, g, c or t
caatgatagattggataaagaaaatgtggcacatatacaccatggaatgctatacagccataaaaaggataagttcatgtcctttgcagggacatggatgaagttggaaaccatcattctcagcaaactaacacaggaacagaaaaccaaacaccgcatgttctcactcataagtgggagttgaacaatgaaaacacatggacacagggaggggaacatcacactccagggnctgtcagaggatggggagctaangggagggatagcattaggagaaatacctaatgtagatgacgggttgatgggtgcagcaaaccaccatggcatgggtatacctatgtaacaaacctgcacgttctgcacatgtatcccagaacttaaaagtataataataataataacagctgaaattaaaaaaaaaaaaaaaa

SEQ ID NO: 11416 - DNA, 307 bp, Homo sapiens
ttctggatgagtgtagtggctcacgcttgtaattccagcagtttgggaggccaaggtgggagaattgcttgagcctaggagtttgagatcagcctgggcaacataactagatgctgtgtctacaaataataaaaaaattagctgagtgtcgtggcctgtgtatctggtcccacctactcgggaggctgggatgggaggattgcttgagcctaggaggtcaaggcagtagtgtgttgtgataatactaccgtactccagcctgggcaacagagtgagaccccatccctccacaaaaaaaaaaaaaaaa

SEQ ID NO: 11417 - DNA, 466 bp, Homo sapiens
cctttatttgtttctcttgtctgactgctctatttttgtactcattattagtgccatgttgaataacagtggtgaaaagtaggcatccttgtcatgttccagatcttggaggaaaggctttcagtttttcctagagacaccaaggaatgcagcaagagcaaactttcatctctgtgatcccttgccaagtaattagaaaaatcagtattctaacttttttttttttaaagagataatttagggccgggtgtggtggcycatgcctgwagtcccagcacttttgggaggccgaggcgggcggatcacagggtcgggagattgagaccatcctggctaamacggtggggccctgtctctactaaaaatacaaaaaaaagaaaattasccgggcacggtggcgggcacctgtggtcccggytactcgggaggctraggtgggaaaatggcgtgaacccaggaggcggac

SEQ ID NO: 11418 - DNA, 316 bp, Homo sapiens
cagaaaatcttaaaatatgtatcatcgagggctgggcgcggtggctcacgcctataatcccagcactttgggaggccgagacgggcagatcaggaggtcaggagatcgagaccatcctggctaacacggtgaaacccagtctctactaaaaatacaaaaaaaaattagccaggcgtggtggtgggtgcctgtagtcccagctactcaggaggctgaagcaggagaatggcgtgaacccgggaggcggasttgcagtgagccaggatcacaccactgcactacagcctgggcgacagagcgagactctgtctcaaag

SEQ ID NO: 11419 - DNA, 306 bp, Homo sapiens
tgtcttaaaaatagggaaatgtggctgggcgcagtgcctctgcccgtaatttgggaggccaaggcgggcggatcgcctgaggtcgggagcttgagaccagcctgaccagcatggggaaaccccgtctctactaaaaatacaaaattaactgggcgtggtggtgcgtgcctgtggtcccagctacttgggaggctgaggcaggagaatcacttgaacccaggaggcagaggttgcggtgagccaatatcacgccattgcactccagcctgggcagcaaaagtgaaacactcaaaaaaaaaaaaaaaa

SEQ ID NO: 11420 - DNA, 136 bp, Homo sapiens
agaacagcctaggtaactttgcaagactccatctctgctaactttttttttttttaaactgggctgggtgtggkggctcamacctgtaatcccagmactttgggaggctgaggcaggcggatcatgaggtaaggag

SEQ ID NO: 11421 - DNA, 249 bp, Homo sapiens
atccatgccagtacagcctttgagaccagtctggccaacatggtaaaaccctgtctctactaacaatagaaaaattagccaggtgtggtggcatgtgcctgtaatcccaactactctggatgctgaggcaccagagttgcttgaatctgggaagtggaggttgcagtgagctgagactgcgccactgcactccagcctgggtgacagagaaagacactgtctcaaaaaaaaaaaaaaaaaaaaaaaaaa

SEQ ID NO: 11422 - DNA, 608 bp, Homo sapiens
  misc_feature 537: n=a, g, c or t
cacttttatagctgaataatatttcattgttcatatcacattttgtttgtccattcgtccactgatgggctttgaattgtttccaccttttccctatttgaatactgctgctgtgaacattttgtttgaacatctgttttcagttctttttggtatatactaaggattggaattactgggtcatatggtattttaggtttaaccttttgaggaaccaaaaaaagtttcaaacattaattggtttgccttttaaattgagaaatttaaacattgtatttatttatcgtgtacaatctgatgttttgaaatacatatatgtatgttgtggccgggcacgtggctcacgcctgtagtcccagcactttgggaggtcgaggcgggtggattacctgaggtcagaagtttgagaccagcctggccaatgtggtgaaacctgtctctactaaaaatacaaaaaattagccgggcttggtggtaggcgcctgtagtcccagctacttgggaggctgaggcaggaaaatcatttgaacccgggangcagaggttgcagtgagccgagattgtgccactgcactccagcctggtgacagagtgaaactccatatcaa

SEQ ID NO: 11423 - DNA, 430 bp, Homo sapiens
cagtggctcatgtgtgtaatcccagcactctgggaggctgagacaggtagatcatttgaggtcaggagttcaaaaccaacctggtctacatggtgaaaccccatctcaactaaaaatacaaaaaatacaaaaaattagccgggcgcggtggctcacacctgtaatcccagcactttgggaggtggaggcgggtggatcacaaggtcaagagatcgagaccatcctggccaacatggtgaaaccctgtctctattaaaaatacaaaaattagctgggcgtggtggcgcatgctgtagtcccaactactagggaggctgaggcaggagaatcacttgaacccaggaggtggaggttgcagtgagccgagatcacgccactgcactccagcctggcgacagagcgagactccctcccaaaaaaaaaaaaaaaa

SEQ ID NO: 11424 - DNA, 480 bp, Homo sapiens
taaggaaaaactaaggaaattgcactaaacagtggacctagattaataataatgtatccatactgattcatcagttgtgacaatgtatcagactaatgtaagatggtaagaaggcaaactgagtgtgaggtatgagggaactccctgtactatctttgtaatattttttataagtctaaaactattctaaaattaaaagtttacttttgtaaaaaaaaaaatgacatctcaaacattaatatttcatttcaagttctaaatcagtgatatggtttggatatgtttccccatcaaatcccacatcagattgtaatccccactgttggaggtggtgcctggtgggaggtgaccaggtcatgggggcggtttctcagtaatggtctaacaccatccccttaatgctgtcctcaagacagtgagttctctggggccgggcgcggtggcsacsctgtaatcccagcgctttgggaggccgaggtg

SEQ ID NO: 11425 - DNA, 457 bp, Homo sapiens
acactctcccatttgtaatgaactgtaagtatattctcacaaatggatgcattttggagtaaaatatggtaactgacagttccttcttaattttcattgtagtatcattggaatctgaccaacatcctggaatttttattgctaacttttaaggaaaaaaatgaaggccgggcacggtggcttatgcctgtaataccagcactttgggaggccaaggcgggcggatcacgaggtcaaaagatcaagaccatcctggccaacatggtgaaaccccgtctctactaaatacaaaaattagctgggcatggtggtgcgtgcctgtagtcccagctactcgggaggctgaggcaggaaaatcacttgaacccaggaggtggaggttgcagtgagccaagatcgcgccaccgsactccagtgtggcaacagagccagactcatcacaaaaaaaaaaaaaaaa

SEQ ID NO: 11426 - DNA, 309 bp, Homo sapiens
  misc_feature 144: n=a, g, c or t
tagctgttatggtggccgggagcagtcatcacgtctgttctcccggcattttgggggactgaagcgggcggatcacctgaggtaggaagttcgagagcagtctggccagcatggggaaaccccgtctctactaaaaatacaaanattagcagggcatgctggcacaagcctgtaatcccagctactccggaggctgaggcaggagaatctgttgaacccgggaggcaggggttgcagtgagccaagatcacgccgctgcactccggcctgggtgacggagcgagactccatctcaaaaaaaaaaaaaaa

SEQ ID NO: 11427 - DNA, 309 bp, Homo sapiens
tagctgttatggtggccgggagcagtcatcacgtctgttctcccggcattttgggggactgaagcgggcggatcacctgaggtaggaagttcgagagcagtctggccagcatggggaaaccccgtctctactaaaaatacaaaaattagcagggcatgctggcacaagcctgtaatcccagctactccggaggctgaggcaggagaatctgttgaacccgggaggcaggggttgcagtgagccaagatcacgccgctgcactccggcctgggtgacggagcgagactccatctcaaaaaaaaaaaaaaa

SEQ ID NO: 11428 - DNA, 198 bp, Homo sapiens
aaatacaaaaaattagctgggcgtggtggcgggtgcctgtagtcccagctactcgacgctcagtagctattcagtagctactgaggcrggagaatggcctggacccgggaggtggagtttgcagtgagccgagatcctgccactgcactccggcctgggtgacagagcaagactctatctctaaaaaaaaaaaaaaaa

SEQ ID NO: 11429 - DNA, 198 bp, Homo sapiens; identical to SEQ ID NO: 11428

SEQ ID NO: 11430 - DNA, 230 bp, Homo sapiens
caaaacaaaacaaaaccaaaccatccatggaaatgttcctacctggacttaggatgggagacggagagttctccctgacagggtaaaagaagccttgacttggccgggcgcggtggctcatgcctagaatctcagcactttgggaggccgactcgggtgattcacctgaggtcaggagttcgagtccagcctggccaacawggtgaagccccatctctactaaaaataca

SEQ ID NO: 11431 - DNA, 180 bp, Homo sapiens
aaaaatacaaaaaattagccgggcatggtggcgggtgcctgtagtcccagctacttgggargctgaggcaggagaatggcgtgaacctaggaggcggasttgcagtgagctgagattgcgccactgcactctagcctaggtgacacagcgagactccgtcaaaacaaaaaaaaaaaaaaa

SEQ ID NO: 11432 - DNA, 393 bp, Homo sapiens
ctttctccccgccgcattcccggtgtcgacttactagctgcaascctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggasccsgggggccgcgccttctctcgcttcggactgcgcaacgctgcgctctgggctgacaggcggataaaacggtcccatcaagactgagaaaaagcacaccagctattggcacagcgtgggcagtggggcytacaggatgactgacttagtctacagagatcccggcgtactt

SEQ ID NO: 11433 - DNA, 378 bp, Homo sapiens
ttgcattatctaaagtctctgaaacgatgcttaaatgaagtgaggtcagaaatcaccaccataagatgccaacacaactttgatgttgaaaactcggccaggagcggtasycatgcctataatctcagcactttgagaggccaaggcgggtggatcacttgaggccaggagttcgagaccagcctggccaaaatgatgaaacccccatctctactaaaaatacaaaaattagccagatgtggtggttcacacccgtagtcccagctacttagtaggctgaggcatgagaatcacttgaacctggaaggcagaggttgcagtgagccaagatcgcgtcactgcactctatcctgggtgacagagcaagactctgtcaak

SEQ ID NO: 11434 - DNA, 291 bp, Homo sapiens
tatatgtttggctgggtgtggtggttcacgcctgtaatcccagcactttgggaggccgaggcaggcggatcacaaggtcaggagatcgagaccatcctggctaacacggtgaaaccccatctctactaaaaatacaaaaaattagccgggcatggtggtgggcgcctgtagtcccagctactcgggaggctgaggcagaagaatggtgtgaacctgggaggcggasttgcagtgagccgagatcgagccagtgcactccagcctgggagacagagcgagactctgtctcaa

SEQ ID NO: 11435 - DNA, 472 bp, Homo sapiens
ttactcttttgtactcgtgtataagtaggcacataggaaattactacctaggtcatattgttatcaacwgaataagataggaaaaagtgtggtcctacttctgcctcaacaccatcctcaccgttgacatttattgcgtttctctggactgacttcatagtttaaacgtcaagagaaggccgggctcagtggctcacgcctgtcatcccagcactttgggaggccgaggcgggcgggtcacgaggtcaagagatcgagaccatccgggccgacacggtgaaaccccgtctctattaaaagtataaagattagctgggcgtggtggcgggcacctgtagtcccagctactcgggaggctgaggcaggagaatcgcttgaacccagggaggtggcggttgcagtgagccgagatcacaccatcgcactccagcctgggcgacagagcgagacgccgtctcaagagaaataaatt

SEQ ID NO: 11436 - DNA, 102 bp, Homo sapiens
gtttgtcctcaaaaggaataaaacttttctgctgataagataaaaaaaaaaaaaaaaaaaaaaaaaaaaaaaaaaaaaaaaaaaaaaaaaaaaaaaaaaaam

SEQ ID NO: 11437 - DNA, 436 bp, Homo sapiens
  misc_feature 197: n=a, g, c or t
gggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggwwatcacgtttangaattactacasagcttttttgagcatccgtgtccgtcagtacacctcagcwyacacacctgccaagtgggtgacctgcctgcgggactactgcctaatgcctgacccacacagtgwkgagggagcccaggagtatgtatcgctgttcaagsatcagatgctgtgtgacatggctagaatatcggagctacgctgattctgcggsagcatcaccactgtggctgtctttcacagtggag

SEQ ID NO: 11438 - DNA, 261 bp, Homo sapiens
tgaaggdtctctctctctcatttgtkttggattatttggatcaragcattgtctgmtttctttttkratttcattctatgtagaraagtactcttcatagaakagcaaggmgtmaagttgtttggggycagacttggcaagtagatgtgaamattcttgatgttttaaaagtagcatataggctgggagtggtggctcatgcttgtaatcccaggacttcgakaggctgaggccgatatcacttgaggtcaggtgtttgag

SEQ ID NO: 11439 - DNA, 504 bp, Homo sapiens
actcttgaccattttgcaggggccagcaaactacagcctgtgggccaaatcattccacagtctgattttggtctttttttgagatacagtctcgctgtattacccaggctggagtggaatgcacgatctcgactcactacaaccttcacctcctgggctcaagcaatcctctcacctctgcctcccgagtagctgggactacaggtgtgtgctaccatgcccagctaattttagtatttttttgtagagacggggttttgctgtgttgcccaggctggtcttgaactcctgagctcaagcgatctaccaccttaggcttccaaagtgccacagtctgttttttgtatcctttgagctaaataattgctatcttttaaagggtgtgggggaaaaaaacccaatatgcagaggctgtatgtggcctacaaaaccaaaaatattttactatctagcctttttcagaaaatttgctaatccctaggctaggacagtgtactgcaaata

SEQ ID NO: 11440 - DNA, 506 bp, Homo sapiens
catatagtacaaaattaacactgaatccatcttaaagaaagtattttatcataaataatatacaagctggcctgcttaagaaaagaactcatttaaagttataagggcaagtgaatgagactatctgaaatgagcacataaaatactctttgattagatatttagtgaaatgtcataaaaggattttgtttcctggaataagaggagcatctgccgttatatagaatagctatagaattgtcatctttcacattttctcagtagccaaaggtcagaaatatatatagtaataccttagtatattaagaggctttcatatgtttgtttacttttttcagtaccttttctctttaaccactgtgaagaagttattttcttattcatggctagttttcttcaatgtaccttttcagttcttaataattatgaaggaatgagcttcctacatccattgtttatgcaacctttgctttatattaatgttaagaaacagtccagtcataggc

SEQ ID NO: 11441 - DNA, 452 bp, Homo sapiens
cgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcarctcggcagcagctctgagggcagctcaatgaaaaagtgaatgcacacgcccttgttggcgtggcctggcatgggcctggtgctatcggcarccgmtctccactccccgamtgatactcaattacgtgaagscaaga

SEQ ID NO: 11442 - DNA, 255 bp, Homo sapiens
gatgttgaatttggaaattggaggggacgctggtggacggattgggtgcaaggagttggtgttgatggaggagcakgacgccagagtcccasmcctggaaccgttcagagtggagcasgcwccacctgtmatctactatgtccctgacttyatctccaaagaasaggaggaktattttgcttcgacaggtttttaatgccccaaagccaaagtggacccabctctctggragaaagttacakaactggggtgggc

SEQ ID NO: 11443 - DNA, 244 bp, Homo sapiens
cacacaggtcaagtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttcccagtactagtgcgcaccarcgcctgccgcagcctcttcgggccggtggaccacgaggagc

SEQ ID NO: 11444 - DNA, 396 bp, Homo sapiens
crktaattcagttttagacacatggatagttagttttatgggcctggagctcagaaaagagaggtctggttaaagaggtaaatttgagaggcatatgcatttatatggaaaacagagacgtaggagtagatgagatcaccaaggagagagtcatgattgaggaacccaacttgaaaattttagaaaagaggaaaggactcagccagaaatatgtagaagcagttaagagagattaaagaaggaatagaggttgttgttgttcacagaagctaagtggagtagaagagtggtgtttttggaaaaattgacaagsctgattgtaaacttaatagggaaatgcaaagtgcttgtaaagatcaatgaagrttggaagattttgctatacttactattcaa

SEQ ID NO: 11445 - DNA, 261 bp, Homo sapiens
agtcagagcgagaacattccagaggtcgcccagctccggcgctgacgggtgtggaccgmrgacgtcgctgggacagcccctccccgctgctcggcggcggcacctggccmrgccgctcctcgctgcgcttcgmmtcmrcctcctcggactcggactcgggtttatatcgcgcctsacttcatyccagkcccgggcgagcagcgttgggtttatgtctttatttgacgaaaacragctgttgcscagccattggtacctgta

SEQ ID NO: 11446 - DNA, 137 bp, Homo sapiens
gagggtgcgggcggcgccttggaggttcctgctgttcctgcttttcggggcgggggccttccgggtcactgtcccgccagctgttggatctgcaccagtaacttctccaggaaaatcccccggagaggaggatctgc

SEQ ID NO: 11447 - DNA, 367 bp, Homo sapiens
acatatggtaagtgctcaaaaacttagctaattttataattgkaattgcttttacctacttttagagcacagagtctttgtcatatcattaaaagagcaaatgattgatttaaaaatcaatgaatcttctgtggacaggttatgaaaaatatgttgattaaaaaagtcttgaatgatatttatcttcttggatatcacctaattgcaagtctttctcttttctcaattaaaaaaaaaacataacataaaaatttcaggagaattgcttgactccaggaggcagaggttgcagtgagctgagatcaagcccctgcatactgcatcctgggcaacaaagcaagactctgtcccaaaaaaaaaaaaaaaa

SEQ ID NO: 11448 - DNA, 346 bp, Homo sapiens
tggaatgaattacagaaacaaaaaataaagacagaaaacaagagatggaaagcctaacgtgttcgttggagttccagaaagaaaatgggagggaggccaaggcaggcagatcacaaggtcaggagttcaagaccagcctggctaacatggtgaaaccccatctctgctaaaaatacaaaacttagctgggcatggtggcgcgtgcctgtaaccccagctacttgggaggctgaggcaggagaatcgcttgaacccaggaggtggaggttgcagtgagccaagatcgtgccactgcactccagcctagcaacagagcgaggactccggcccaaaaaaaaaaaaaaaa

SEQ ID NO: 11449 - DNA, 486 bp, Homo sapiens
ttatcagagtgttctgcaaaccagggtccaccacggtgttctagtcctttactgagcaatgctgtaggctgtgaaactaagcaacctggtcggctttactgttgtgttcagcttgggatttggactatgtctctaagtcatttcttccctgaactagtcatttatgttccattgtggtatctcctatttcatttaaaagcacttccattctttccatatattctgctgagatttgtttatggctataaatgagatatggatgggtggtcactgagataattaatatggtttagaactactgattaataaatctaacaggagaccaggakaggcatgacaagaaaatcttaaaaacaggaaaaacccaaaggagagaactaaattaccagtttctaatcatagatactatcttccatttcattgtatagcagtagtatcataagatatgccattttctcagctatctgaaaattttaaaccaatttt

SEQ ID NO: 11450 - DNA, 318 bp, Homo sapiens
rbkrraggaaagtccaatgcctgcagcccacctcagtttccttcagtccccaatttctaggttaatgctccaagatcacagccagacttcaggcccaggcctcaccatagcactagatgttgcttctagaatcaagcactgagtggcttctagaactgaggcactacatcaaaccttcagaaaggccaacgcccgtggttctcaaagtgtggtcaggccagggacccctgggagtccccakaccctttyagggtccccmymmsgycaaatgattttttataatcatactaaratgtcatctaccctttyycacccttw

SEQ ID NO: 11451 - DNA, 352 bp, Homo sapiens
kggvrktctttgacccctccatgtgactaaaatttaagtttcattttaaaacatgaagataatgatatgtctgtttctgaaccactggattgaaaatttacacatggatgagttccataatttcacatgtttaattggtcattaaggctaccttagcaactgctacatcaaatgatagcttttgactgggcatggtggctcacacctcccaaagtagtcccagcattttgggaggccgaggcakgtggatcacttgaggtcmggagtttcgagaccagccctggccaacatgggaaaaccccgtctctactaagaatacaaaaattagccaggcatggttggtgcgtacctt

SEQ ID NO: 11452 - DNA, 241 bp, Homo sapiens
cggatttggaagtcataaacgtagttttgaaagcatgagaacagaggatattacccaaaggatacatgagggataaaatgaaaagaagggcaaggatggaacctgggggaatattgacgtttaatggaagggaaatggaagagcatctcatagatggatgagaaaggagcactctgagagttaggagaatcgggatgcctgggagtcacaaaggcccaggaaagtgagaacaccaaggaak

SEQ ID NO: 11453 - DNA, 499 bp, Homo sapiens
aatagcaactcgaactgacactgccgggtcgcttcggcaccttcaaatccacttcactggacaaacctaagtacatcagaagtgccgccgtaaaaaaggcagcagccaacccttccgcgtagggatcaaagatgacctgcacgcataactgcaaatgaaagcctcgggaagagtgagaatgacggaagcgaaatggagcagtgtaatacaatgaaataagttggcaaactgaaatttactcagtaattgagatgactgacttacaggaaaccaccagctatagggaacccaggtaactaaaacaccaagacccggattcagctggtctcattacctgcctctacccacttccccattccgtgcttccctcagcggatcgcctatatgcaccgggttcttaccgtatgtgggggatgccaaccccaccttgaagaatcttatagagcttgctctcgtacagcaactggggatgcctggccttctgagattctagcttcac

SEQ ID NO: 11454 - DNA, 495 bp, Homo sapiens
  misc_feature 489: n=a, g, c or t
taaaaataactgggttaggctgggtgcagtggctcacgcctgtaatcccagcactttgggaggccgaggcgggcggatcacgaggtcaggagtttgagatcaacctggccaatatagtgaaaccgtgtctctactaaaaatacaaaaaattagctgggcatgttgatgggcatctgtaatcccagctactagggaggctgaggcaggagaattgcttgaacccgggaggcggaggttgtggtgaactgagatcacatcattgcactccagcgcgggcaacagtgcaagactccgttttaaaacaaaacaaaacaaaacaaaacaaaacaaaacaaaacaaaactgagttagagtggggctgtattcttagctacccagaaggctgaggcaggattatcccttgagcccaggaagtggaggctgtagtaacctattatcatgccacttgtactccagcctgggtgacacagtgagaccctgtctcaaaanaaggaa

SEQ ID NO: 11455 - DNA, 117 bp, Homo sapiens
aaaacacatggcgtttacgactgtctgggaagcctgacgccgtgacctcccgacgccgcgagactcaaggaatgaacataataatttcctactattctgccaccgcgatgccgaagy

SEQ ID NO: 11456 - DNA, 286 bp, Homo sapiens
gtttttttgaggtgggtttttttgttttgttttttttttttaagttatgattgaatcactttgcctttaaggtggtgtggaagtaatttaattatattcagaactcgggcaggaaacatttgcaagtctaatatttgttggattcctaaagaaacagaatgctccagatcagtttcctgtatttttgtctatcatctaatctaagagtcacaggtactgtttcctgcatttaacagtgtcagacatgtagtgccaaacccaggaatcttgctggcgttaggttttt

SEQ ID NO: 11457 - DNA, 374 bp, Homo sapiens
acagatccaggctgtctcttgcggtgcgcatgcacttaccgtatcgttatcaacgtctccgaggcagattgcgtgcgggaagaggctcccgctgaactccagcgccacgcgttcaamcgtagctaactgacctcatggcacctccaagagcagagggagcggagaggcccagtaaatattccctgaacccccgtcgcgacascgccagagcgraaggccacctaaggcagcaatttacgtcactgcctgaacctccaatctctgcctcttcctcctttaaccttacagaggaggcgggtcttccgggcttggaggcgggcttcccaactctgatgatgcagactggaagaaacctcaggaatgctttcgatttt

SEQ ID NO: 11458 - DNA, 366 bp, Homo sapiens
ataagtaagaaactggctgggcgctgcctgtaatcccagcactgtgggaagttgaggtgggcagatcacatgagtttgggtgttcgagaccagcctggccaacatggtaaaacctcctatctacgaaaaataaraaaattagccaggcatggtggtgcatgcctgtagtcccagctatttaggaggctgagggagaagagttgcttgaacctgggaggcggaggttgcagtgagctaagattgtgtcactgcgctccagcttggggaacagggagagactctgtctcccctcccccccaaaaaaaaggccaggtacagtggctcacacctctaatcccagaactttaggaggccgaggcaggcaga

SEQ ID NO: 11459 - DNA, 365 bp, Homo sapiens
tatatggaaatgcctggatatccaggctgaaatttgctaggggtcggggtcaggggcctctcatggagaacctctgctagggcagtgcagaagggaaatgtgtggtaggatcccccacagagagtccctgctggggcactgcctagtggagctgtgagaagagggccaccatcctccagcccccagaatagtagatccaccaacagcttgcactgggcacctacaaaagctgcagacactcaacaccagcccatgaaagcagctgggagggargctgcaccctgcagagccacaggggcagagctgcccaagaccatggggacctacctcttgsgtcasatgacccaatgcgagacatggggtca

SEQ ID NO: 11460 - DNA, 388 bp, Homo sapiens
tgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacg

SEQ ID NO: 11461 - DNA, 350 bp, Homo sapiens
gttcgagaccatgctgctgttctgccccggctgcgggaacgggctgrksgtggaggagggacaacgctgccaccgcttcgcctgcaacacgtgcccctacgwgcacaacatcacccgcaaggtaacaaatcggaagtacccaaaactgaaagaagtggatgatgtgcttggtggagcagctgcctgggagaatgttgactctactgcagagtcgtgtcccaaatgcgaacatcctcgtgcttacttcatgcagcttcagacccgctctgcagatgagccgatgaccaccttctacaagtgctgcaatgctcagtgtggacaccgctggagggattagggccaggatggcc

SEQ ID NO: 11462 - DNA, 373 bp, Homo sapiens
  misc_feature 205: n=a, g, c or t
ccatgtcagaatgggggcatctgccaacgcccaaatgcttgttcctgkscagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatngtggaaaatgtgtaagaccaaaccgatgtcactgtctttcttcttggatgggacataactgttccaggaaaaggaggactgggttttaaccactgcatgaccatctggctctcccaaaagcaggatcatctctcctcggtagtgcctgggcatcctggaacttatgca

SEQ ID NO: 11463 - DNA, 384 bp, Homo sapiens
actttcagccctggaagctggccaagagcgtatctttgaagcacagcaaaggatgagacttctgtgagcagcgaggattttgatatgagcgactccacatggatgtcagctgacccgcacctggcctccagcctgagccccagccaggacgagaggatgcggasccgcagaacctccacagtcaagaggacgggccccaccgcttgagccacctgtcccaaggcctgaacatcatctgcagcttggacacctctctacgggccaggaaccccagggtctctgcagagagaaatgatttcagttttaggggaagatctaggtgtgtgacgtctaattcattagccaaggacggctactgagccttggaaaaggctagtgcagaca

SEQ ID NO: 11464 - DNA, 372 bp, Homo sapiens
ccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccaccctcctaggttcacatccagggctgtgtcttccttgggggaggagatggtgtcgtttagatcagggtaaggcagtcaggcgggtgttcacca

SEQ ID NO: 11465 - DNA, 349 bp, Homo sapiens
acagatccaggctgtctcttgcggtgcgcatgcaywwaccgtatcgttatcaacgtctccgaggcagattgcgtgcgggaagaggctcccgctgaactccagcgccacgcgtcaacgtagctaactgacctcatggcacctccaagagcagagggagcgkagagscccaktaaatattccctgaacccccgtcgcgacascgccagagcggaaggccacctaaggcagcaatttacgtcactgcctgacctccaatctctgcctcttcctcctttaaccttacagaggaggcgggtcttccggggcttggaggcgggcttcccaactctgatgtgagtgacaggcccac

SEQ ID NO: 11466 - DNA, 375 bp, Homo sapiens
  misc_feature 138..139: n=a, g, c or t
atgtgggtgtgggtgcatgtgggtgtttacacacatgcctrcaggtatgcgtgattgtgtgtgtgtgcatgggtgtacagccacatgtctacctatgtgtctttctgggaatgtgtaccatctgtgtgcctgcagcgnntgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctg

SEQ ID NO: 11467 - DNA, 386 bp, Homo sapiens
gacggagcgcgggccccctcacagcgacagkgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggctccatcgagacctatgagcaggagaaagcagtcttccagttctaccagcgaacgaaataaggggccttagtacccttctaccaggccctcactccccttccccatgttgtcgatggggc

SEQ ID NO: 11468 - DNA, 398 bp, Homo sapiens
acataaaaaattttaagatgtagctaaaactgtgtattgggggaaatttattatcttaagggctagaatcgatagctttaaacaaaaattacctaggtatttatctcaataagttagaaacaaaatgcaattaaacttgaagaaagcataagaaaagttaagagaaaaaagtaatgaagaaaatgtacagtaggctaggcatggtggctcatgcctgtaattctagctctttggaaggctgagatgggtggatcacttgagcctaggtgtttgagaccagcctgggcaaccaaatgagaccccccatctctagaaaaaatttaaatattagttgggtttcattgtgcatacctccggtcccagctacacagaggctgaggtagggggatcgcttgagc

SEQ ID NO: 11469 - DNA, 453 bp, Homo sapiens
cacccagctgcgggctgttccacagtctgagggggctgtcaggccttgaagggctgaaagggagcccaccaaccccatttctgctcagcccctgccctagcactttctaagtactagtttggcctcctgtcatgggctctgagatttcagggtgccattaaaaagcctggctcgggcgcagtggctcatacctgtaatcccaacaatttgggaggccaaggcgggcgaatcatttgaggttacaagttggagaccagcctggctagcatcacaaaaccctgtctctactaaagatacaaaaattagccgggtgtggtggtgcgtgtgcttgtagttccggctactcgggaggctgaggcacaagaatcacttgaatccggtagccggaggttgcagtgagctgagattctgccactgcactccagcctgggcaaacagagggagactgtctaa

SEQ ID NO: 11470 - DNA, 283 bp, Homo sapiens
tccggtgagttcagggcggttgcctttagggtgtgtccctaattgacggggtcggggacggagagaagggtaacaccaggctgggtcggagacggcggaggcgaggaaatcctaagagcgtgaccgttgatgatgcagggaaccgtcgggtgtgaccattgagagggaaaaggtgcacattaaagatccaaagtcatgactgactccaagtatttcacaaccaataaaaaaggagaaatatttgaactaaaagctgaactcaacaataaaaaaaaaaaaaaaa

SEQ ID NO: 11471 - DNA, 446 bp, Homo sapiens
acatttataatatatttcaaaaggttgctatgaggattaaatatgttaataaattaaaatagaagtgtctgatagcatttactaaatgtttcatttactgaattgtttcatttattccttaaaacaactcagctctattctcggagccgttacttgcagctcagcattgttataaggaataaatgaaacaaaaagtacttaacatagtgcctccacataagatatcacaagctgctaactactatttttgttatgcattgtctgaagataagtcacaaagttggttcttagctttcaggtaactaatagtgaagggagaaaagcaaccacttaaagaatttacaggccgggcgaggtggctcacgcctgtaatcctagttctbvgggaggcagaggctggtggattgcttgagctcaggagttcgagaccaacctggtcaacatgg

SEQ ID NO: 11472 - DNA, 425 bp, Homo sapiens
aaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataa

SEQ ID NO: 11473 - DNA, 311 bp, Homo sapiens
caaatggtgagatgctaaaagcactttgagctttagggagttcaaagtggccaggcaaattaaagttatgtgacctatctgagaatatagcatagttctttgtgagaaaagaaagtgagatatttgtgctttgttggaaataaaaaagattttaaaaactcaaggctgggcacagtggttcacacctgtaatctcagcactttgggaggctgaggcgcagatcgcttgagctcaggagttcaagaccaacctgggcaacatggcaaaaccccatctctaccaaaaaaaaaaamcccaaaaaaaaaaaaaaa

SEQ ID NO: 11474 - DNA, 441 bp, Homo sapiens
atataatgaattagagaacattatgctaagtgaaataaaccagacacagaaagacaaatactacatgttctcagttatatgtggaatctaagacaattgatttcatagaggtggaatgtagaatggtagttaacaaaggctagggatttgggagattggggagaagatgatcaaagggtgaaaaatcttaggagaagtatgtttttttaaaaagtctattgcataatgtggtaaatatagttaatagaatattctatattacaaaattgcaaagagaaatttcaaatattttcactacaaaaatgttgagtatttgaggtgatggatatgttaactagcttgatttaattattctacattgtattcataaaccatcactttgtaccccataaatgtacccaataataagttgtcactttacaatttaaaaattgtatattc

SEQ ID NO: 11475 - DNA, 367 bp, Homo sapiens
cagtagctcaggacggaactgtatttggagacagagccttcaaagacacaaatgagttaaaatgaagccatagtggcccgaatccaacgtgactgttgccgttataataagagattaggacacagacatgtagagagaagacggtcacctatgagccaaggagacaggcctccaagacactaacctgaaccccccacttcctctttgctgccccttcactttcttgctgcccctttcccagtctctcttcacacccactcctggtctgtcctgatcccctcttctgtatcaggtttattggttgtacatataaattatactttcctttcaaaaaaaaaaaaaaaaaaaaaaaaaaaaaaaaaaaaaa

SEQ ID NO: 11476 - DNA, 348 bp, Homo sapiens
  misc_feature 275: n=a, g, c or t
aagaaaatcacagagaagcaatatatgatggacaatcaatgagaattttcaaaaactaggctgggcgttttggctcatgcctataaacccagcactttgggaggctgaagcaagtggatcaactgaggtcaggagttccagaccagcctggccaatatggtgaaacctcgtctctactaaaaatacgaaaattagcctggcgtggtggcgtgcacctgtggtcccacctactcaggaggctaaggcaggagaatcgcttgagcccggggggcagnaggttgcagtgagccgatattgtgccactgcactccagactggatgacagagcgagactccatctcaaaaaar

SEQ ID NO: 11477 - DNA, 178 bp, Homo sapiens
aacttctcctcctgcagccgggagcggcctgcctgcctccctgcgcacccgcagcctcgcccgctgcctccctagggctcccctccggccgccagcgcccatttttcattccctagatagagatactttgcgcgcacacacatacrtacgcgcgcaaaaaggaaaaaaaaaaaaaaaa

SEQ ID NO: 11478 - DNA, 149 bp, Homo sapiens
  misc_feature 95: n=a, g, c or t
acagccttgcagcdtctccggaartsgaggcgggacggcacggcagccactgcttggggtagcgggagggcagactctgggcgccactcccgggncggtcatgaacgggccggcggacggcgaagtgvactacaaaaaaaaaaaaaaaa

SEQ ID NO: 11479 - DNA, 418 bp, Homo sapiens
  misc_feature 41: n=a, g, c or t
agacgcgccaggtctgtagcaggaggccgcgcsaggggggntccccagaagcctacagtttgggaagctgaaagtctgaaatgaagatgccagcatggttggattttgtgaggaccctcttcctcgtgtacgaacagctgtcttgttttatcctcacgtggcagagtgggagctctctgatccctttatctccttacagacttgaatctcattcatgagagctccacccccatgacctaattacctcctaaaggcccccatttccaaatactgtaatattgggaatttaggggtcaacatatgaatttcagagggatacaaacattcagtccatagcacgttgattaaaaaattgcttaaagggcagcacaaagaagatgtacagccagaacagaagacttattcaaactctaaatcc

SEQ ID NO: 11480 - DNA, 415 bp, Homo sapiens
tacaaaaaattagccaggcatggtggtatgcgcttgtggtcccagctgcttgggaggctggggtgggaggatcacttgggcttggaaggtcaaggcgaggctgcagtgagccattatcagaccactgcatgccagcctgggtgacagagcaagacactgtctcaaaaatttttttaaataarrrataaataaactcttggtggggcacagtggctcacacctgtagtcctagcactttgggaggttgaggcagtattgcctgagcccaggagttcaagaccagcttgggcaaaatagtgagacccctgctttaaaaaaaaatgaaaaaaattggctgagcatgatggcgcacacctatagtcctagctactcaggaggctgaggcaggaggatcacttaatcccaggagttcagg

SEQ ID NO: 11481 - DNA, 393 bp, Homo sapiens
aaaagggaggggaggggagaatcgaggacggacggcctagccaggccaagaatgcaattgccccggtggtgggagctgggagacccctgtgcttggacgggacagggtcgggggactggatctcagcctctgatcagtttcacaaagtttgttccctaaggaaatcaaatcccattgtcacctaactctgaagatctaaatagcccttggatcagtacgggaaccccaaatcccacagggccagatgtggagtctgtgtctgcccccgtmttctctccatcctcaaagcccccacttctctccaggctgtttctttttttatgactgtaaacatagatagtgctttattttgttaataataagataatgatgagtaacttaaaaaaaaaaaaa

SEQ ID NO: 11482 - DNA, 442 bp, Homo sapiens
attgctaaggaattaggaaaacaaaggggaagaacaaatgggttttagagacagatctgggttcatttcccagactcagtcccttcctgactggctttgggcaagctacccaagatctttgagcatgagttactatggctataaggggacatctcctacatcgtagggtagtataaaacatagaacgattagaaatataaacaaacaatttgaattattgtagacactctatataagtagtacaggttgaagatccctaactcaaaaatccaaaatcagtcaggtgcggtgactcggcactttgggaggccaaggcaggtggatcacttgagctcagtctgagactagcctgggcaatatggagaaattctgtctcaaatactaaaattagctggatgcctgtagtcccagctactcaggaggctgagatgggargatagct

SEQ ID NO: 11483 - DNA, 385 bp, Homo sapiens
taagtttatttccaaagcatatagtccttgatgttgagtttatgttaaaagagcagtataagttacattgagcagtatttgttttaaagattcacaatactcacctttgggcatgaggaagggtatattattttgatatcataactgaactctgtagcatagtaatcataaaaatagtgtccttatatgttgtcatggttcagttatctttatcacctccatgtatacctgatgcactttattatatactttctccattgcattgtgattatttgcatgcctctctaccacactggggcatgagatcctctaggcaataaaacatctcattcatattttctgcaacaccttgcttagtatctggcacacaatcattgttcaataa

SEQ ID NO: 11484 - DNA, 476 bp, Homo sapiens
atccttcagtgttaccatgccaaccagcatccatcccaagagttgcctctgaataagccacagttggaggggcctcgttcgagaatctaagtggagtcaaagttctgcttcaccaaggcccacaaaatgggtgagcagcatgcatgggtatgaagaggcaagtaaactgcattgtgtcatccaagtaaaacacagcacggcctcctgccactgacagaccctgtttccataatttctggatgagaaagccaagtcatgtcagtagttaatcagctctggaggaaagtgaacacctataaacacggcagaatgcaatacttccagaaaggcttttaacacctacagaatctaaacattttgtaagaggtggggttaacaagcttgtgtgctatttgggggtggggctgagcatcagaggcaaagtttttcgtaagcctctttctctcgatggattaggcaggaatgactttcctcca

SEQ ID NO: 11485 - DNA, 426 bp, Homo sapiens
casatataattttgtatctccctcsscatccccctgaatacactgactggggtcggactgcctggattcaaatcccagctcttctaagcagaatgtgttcattatgtgcctcagtttcccagtctgtgaaacgagaataagggtagctatgaggaccaattgtaaagctccctggagtaytcagtcctgtgcccagcgtcggcatagacattcctgcctgacagtctcctgccttctcagcgactactctttcacatgccctccctctgctgtgaagtggggatgaaaaccctggtttcctgtaatcccagcacttcgggaggctgaagtgggtggatcacctgaggtcaggagttacaaatagactatagatttcttcctacatttttgtgttttaaaasgatcaagtggccgggcgcagtgggc

SEQ ID NO: 11486 - DNA, 118 bp, Homo sapiens
cttttccgcgggccccgcccaggcggctgcccgtbacctgcctgggcgcggggwactgaaagccggawggggcaagacgggttcagttcgtcatggggctgtttggaaagacccagga

SEQ ID NO: 11487 - DNA, 351 bp, Homo sapiens
agtgcctagcgcaaggttaggtgcatgcaggcggccagcttcggccgggsaaggaatggcctggacaactggggcatcgcggcgctcctcggcctcctgcagctgcgtttcaaagcagagccgacccttggtgggtagtccggggaccctgcggaccctccttgtgttgttgaaacctagtgttttaattgggactacacccagcagtgccgggagacttggcggggacgttccactgcgcaggaagtggcttcaaataacttacacgcgtcactgtgtcgattagctgctccgtgacaggcactatggtaggagctgaggctacaaagatagaacggatgggttgcaaaa

SEQ ID NO: 11488 - DNA, 443 bp, Homo sapiens
gtaagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaagtaagtaagtggtccagttgctttgtgatgtggtgggctgggaactcaatgtcttgtgatctccctttggatttctctatgcttgctgttggaatataaccaattatacctcagctgtataaattttgttttaatgtggggtactggtgtttgtggtaatcttctgacattgatctatgggagtgactggtgtgacattgaaatctgggtcatggtagattatattaaaacatcagtg

SEQ ID NO: 11489 - DNA, 140 bp, Homo sapiens
ctgtatggsycccggggcgctgggattggggagcgtgatggarttatgcatragattgrcatcatctctggaactcttggcaaggcctttggctgtgtgggcggctacattgccagcacccgtgacttggtggacatggt

SEQ ID NO: 11490 - DNA, 370 bp, Homo sapiens
  misc_feature 212: n=a, g, c or t
ctaattttaaaattgtttttggagatggggtctcaccatgttgcccaggctggtctcaaactcctcggctcaagcaatcctcctgtcttgaccttccaaagtgttgggattataggcttgagccaccattcctggccttaattaatktcttacttaagarcaaaaggggccgggcgcggtggctcatgcctgtagtcccagcactttgggangccggggcgggtggatcatgaggtcaggagatcgggaccatcctggctaacaaggtgaaaccccgtctctactaaaaatacaaaaaattagccgggcgtggtggcgggcgctgtggtcccagctactcgggaggctgaggcaggagaatggcgtgaac

SEQ ID NO: 11491 - DNA, 406 bp, Homo sapiens
aaacactgttctgtgtaaaattttgcataaaacaaaaaattgtacattaaaagaactccattattttacatcaaaaactaaaagtagccaggagtaattaatgttttaaataatttatatatgaaatatattgacggacttcagataaggaaattaaaatgattcctttaagaaccagacattggccgggcgcasggctcatgcccatctcggcctcccaaggtgctggaattataggtgtgagctacccagcccggcttatgtagatgtttttttaatgctgtacaggatatatgcatataaatgacaaaaaggtaatgagaataacttatattttaattatcattcacagctgataaaatactgggaagcattcttacctgaagccaaagccattgcctagcaa

SEQ ID NO: 11492 - DNA, 422 bp, Homo sapiens
cagcttcatctgtatccctgcaaagcacatgaactaatccttttttattgcccaaaccactatggcacatgtatccctgcaaaggacatgaactaatccttttttatggctgcatagtattccatggtgtatatgtgccacgtttttcattatccagtctattgttgatgggcatttgggttggttccaagtctttgctattgtgaatagtgcttcaataaacgtatgtgtgcatgtgtctttatagtagaatgatttataatcctttgggtatatacacccagtaatgggathgctgggtcagatggtatttctggttctagatccttgaggaattgccacactgtcttccataacagttgaactaatttacactcccaccaacagtgtgaaagtgttcctgtttctccacattctctcca

SEQ ID NO: 11493 - DNA, 132 bp, Homo sapiens
cagcttcatctgtatccctgcaaagcacatgaactaatccttttttattgcccaaaccactatggcacatgtatccctgcaaaggacatgarstaatccttkttkatggctgcatagtattccatggtgtak

SEQ ID NO: 11494 - DNA, 106 bp, Homo sapiens
tatcgaaagttaattttgtgttggtataagagagcctgaagtttgttttgtttttctcatggggtatccatttaaccatcatttattgaaaagacccttcttggcc

SEQ ID NO: 11495 - DNA, 392 bp, Homo sapiens
ttttaatgatcaccattctaactggcgtgagatggtatgtcattgtggttttgtctctgtgacagtcttgctctgttgcccagggctggaaggcagtggtgcggtggagctgctcactgcagcctccgccttctgggctcaakcgattctcccaccttagcttcccaggtggctgcgamtgcgggcacatgacaccacgccttggcttatttwtgtttttgtagatatggggttttgctattttgcctgggctggtctcgtactcctgggctcacgcctgtaatctcagcactttgggaggctgaggcgggaggatcacttgrgcctaggagttcvagaccggcctggacaacatggtgaaacccgttgctacaaaaaatacaagaattagc

SEQ ID NO: 11496 - DNA, 366 bp, Homo sapiens
aacggcgctgggacccgggctggaaggcagggcatcagctatggaacaacctgggcaggatcccacctcagacgacgtcatggactcgttcctggaaaagttccagagccagccttaccgtggcggctttcatgaggaccagtgggagaaggaatttgaaaaggtccccctatttatgacgagagcgccatcagaaattgatcccagggagaatcctgacttggcttgtctccagtcaattatttttgatgaggagcgttctccagaaggccaagacctataaagatgagggcaatgattactttaaagmawaagrctacwwgaaagctgtaatttcatacactgaaggcttaaagaagaaatgtg

SEQ ID NO: 11497 - DNA, 79 bp, Homo sapiens
tgwwtatgtcatatagrgtcaaccagttragcagcatatatcaaaacataatggtttttgagatsatttagcattgtaa

SEQ ID NO: 11498 - DNA, 553 bp, Homo sapiens
atttctgtggtatccgcacttgcgtggtgatctggggtataccgttttagtcttgggggtagagtgactgcttgcgaaccagttcagcagtgcctcaggtaagaggacttagttctcccgctgcagcgaagtaaaagaggaaggaggtctgtaccgcgagccgctcccagctcctggtgcggtgcgctgcgtgccgtagaaatttagtaaacgtggttagatgtagagaaggccgagctgctgccggggccacgggagtctttgtgcggtcagcagagggacttgaaagacaggtgaaaggacattggagacaagcccctcaggtctatgttgcttaggaaccttggaccgcctcatcgcactccgctctatcaaaccgttccaaattaagattgctggtgtctcccgaccagataaaagcagtgatctctcagtctcgacgagtccttaaatgcgtttgcaagaggtgttttacataactggagcccagttaattgtaaaacaaacaaacaaacaaaaaacactagatcaatggctagtgagtatctactaa

SEQ ID NO: 11499 - DNA, 504 bp, Homo sapiens
gctggctctctatacctctcgtgtggaaggtgcttagcatgtttaggccccattgcagtgactatcaatgtgagtccaaattccctccacactttctgtcactccttttggacataccatatactgtctcccatcatttatcactgactggccacatggcaccgcttaggagccagatgctgggctaaacattgaagtgacaaccatctggtttactgcccctcccctgcaagaacctaagggctccatggatggaggatgaaggtacaaaacacagggcatgagcagggaatcatgagtgttttggtgctgttgaaacagaaagctcaggacgtaaagtggtggaagaagaggctggtgagagaggcaaggcattaggacgtggagggccttatctgccacgctcagaagcataagccctatgacataggagaagagaaactatcaaaggattataaacgagggtgtgatgtcatcatgaccatacgaaagataggtttgaga

SEQ ID NO: 11500 - DNA, 577 bp, Homo sapiens
aaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagaaaggtatatatatgttttttctaatgtgtgcctttagctctcccgtttgaaaagatataaggggaggctaggcatggtggctcacacctgtaatcccagcactttgggaggccgaggcgggtggattgactgaggtcgggagttcgaggccagcttggctaacgtggtgaaactctgtctctactaaaaatacaaaaattagccgggcatggtggtgcacgcctgtagttccaggtacttgggaggctgaggcaggagaatcacttgaacctgggaggtggaggttgcagtgagccaagatcatgccaatgcactccagcctgggtggcagagcaagactccatctctcaa

SEQ ID NO: 11501 - DNA, 161 bp, Homo sapiens
agaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggtttttttttttttk

SEQ ID NO: 11502 - DNA, 515 bp, Homo sapiens
cctgtccccccagagaataaattatttttaaaaacaaacagtgggaccaaacaacctagatttgaatgccaaattctacttcatactgactgtataactttggtaatttcctaacctctctgaacttctatctcatcatctctcacagtgggttaaatgaaattgcgtatgataaaatacttagcactatgcagttcaccttctaggtagctgctcactaagccctagttcccttctctgaaagccaggcaggcggagatttagctggcctggcctgggcctgtggcagctgttgtgcttgaggtctttattaataggtcactcattactgttgctgcagcagcactctgaacttgggttctgattgattcctgaattactgagaactgttccaaaaaaaatcactttgccctttggcaatgtaaacttaatgacacttgctggtgcagcctaggcagattatttcaggaataccagacattttttattctgttgtagctcagactcaacagctt

SEQ ID NO: 11503 - DNA, 154 bp, Homo sapiens
rtcacgccgcgtggcggacggacggacttacggacgcgcagccttacccgaaaggccatggcggagcacgcccctcgccgctgctgcctgggctgggacttcagcacgcagcaggtacagtcgcctggccgcakggccacggggccgcctcctm

SEQ ID NO: 11504 - DNA, 176 bp, Homo sapiens
ctctrvgtcgtcgcctcagcgccggctcccggmmgggccgcggccgccgaccgttgagccgccggctgagccgcctgctgaagyccctccctcaggaacccctccgccaccctccacctccgaaccgstctcgcggcggcgacccatgtgggggttcaggctcctgcggtcgcccc

SEQ ID NO: 11505 - DNA, 238 bp, Homo sapiens
aaaaaggcgccacggcgggagacaggygytgcggscccgcagcgcccgcgcgctcctctccccgactcggagcccctcggcggcgcccggcccaggacccgcctaggagcgcaggagccccagcgcagagaccccarcgccgagacccccgccccggccccgccgcgcttcctcccgacgcagagcmmaccgcccasvgtagaagatggattgccggcacgctgcagacgatcctggs

SEQ ID NO: 11506 - DNA, 237 bp, Homo sapiens
ttcccttccagccccttttccaggaaccttgccacacccacacctgcagcctcccctccccggccctcccaccactgctgcggcgcggscggccccggccgtgtgctgcgcttgccttaccagctctctcctcgcttttctctcccgttttctctctgctttctctccaactgccagccgatcgggtcaggcaagtccatcccgtcctgagagccccaggccccccttcgacctcta

SEQ ID NO: 11507 - DNA, 177 bp, Homo sapiens
gacttccaggccgcctttcctgctgagaagcacacaggctgtgaccggggcccttcccggaagggacattcggtttttgtggcagggacttccagcctgaggccgaaggaggagggtccaacttcacctttgcccgcccttcccccgcttttttgggtctcctttaactgggacggg

SEQ ID NO: 11508 - DNA, 178 bp, Homo sapiens
  misc_feature 152: n=a, g, c or t
cattagcgagctgctccctccattttgtccccagtctcctttaggcgaactgcgcggttctatgttaaagccacttagctgtgtgccgagcttggaagaaagtgtgacccgttcgacggaacaaaggacatgacagcccggccccgtgcggncactgcggagcgttaggaacattccc

SEQ ID NO: 11509 - DNA, 212 bp, Homo sapiens
  misc_feature 24: n=a, g, c or t
cacataactaactttcgaggcacnggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttttt

SEQ ID NO: 11510 - DNA, 191 bp, Homo sapiens
aaaaaaaggcgcagccactgcctccggagccggggcgaaccaattcctccgttgcggcccccacctgcagtatggagtcgtctcgggggcggsccgggcccgagacggaccttctggctgtagcggaacatcaggccctagtctttggcggcgggccgggccgaacgtcctctgagccgcccgcaggccty

SEQ ID NO: 11511 - DNA, 318 bp, Homo sapiens
  misc_feature 31: n=a, g, c or t
aaaaagtccctgggaagcggccgggcgcggntggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaaaaaaaaaaaaa

SEQ ID NO: 11512 - DNA, 345 bp, Homo sapiens
tgtcaattttgtttatcttttcaagaaactaacttcttggccaggcacagtggctcacgcctgtagtcccagcactttgggaggctgaggtgggtggatcacttgagggcgggagtttgagaccagcctggccaacacagtggaaccctgtctctactaaaactacaaaaattagccaggtgtggtggcacatgcctatagtcctggctactcctagctactcaggagactgaggcacaagaattgcttgaacctgggaggcggaggttgcagtgagccgggatcgcaccactgcactccagcctgggcgacagagcaagactccagcttaaaaaaaaaaaaaav

SEQ ID NO: 11513 - DNA, 317 bp, Homo sapiens
  misc_feature 30: n=a, g, c or t
aaaaagtccctgggaagcggccgggcgcgntggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaaaaaaaaaaaaa

SEQ ID NO: 11514 - DNA, 355 bp, Homo sapiens
caattgtttttcattttatagcatcacacagtaaaagtagataaaataattttaatgaaaatacttctgtgggccaggtgcggtggcttacgcctgtagtcccagcactttgggaggccgaggcggcggatcacctgaggtcaggagttctggaccagcctgaccaacatggagaaaccccatctctactaaaagtacaaaattagctgggtgtggtggcgcactcctgttatcccagctgctcgggaggctgaggcaggagaattgcttggactcgggaggcggaggttggggtgaaccgagatcacgccattgtactccagcctgggcaacaagagtgaaactgtctcaaaar

SEQ ID NO: 11515 - DNA, 479 bp, Homo sapiens
gaagaaggctcttacagcatggccgccggtactgcagctgccttagcgtttttgagtcaggagagccgaacgcgggccgggggtgtcgggggcctacgggtcccggccccggtcactatggacagttttttcttcggtattagtgaagggagaggctgagggtggtactggggcggtaagaggtagggatgtgaggcgggaatgcccagggtttcaaggcgtgggtgtgggcggaggactgcttcgctgttcccgcagagaggkggcctcgcacgcacagccaaagggggtggcgagatccctgccccagatgtgttgggcggggccacggcagagcgtcccaggtgttctgagagaagagacggaggtggacgtgtaaatgacccgtccgcccaaggttacacgtgacggcgggttggtgacatcccccgstgcccagccccgtacacacgstcaggcatactcactgttatttctac

SEQ ID NO: 11516 - DNA, 316 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaamccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaaaaaaaaaaaaa

SEQ ID NO: 11517 - DNA, 314 bp, Homo sapiens
taaaaaagaaggtgggctgggcgcggtggctcacacytgtaatcccagcactttgggaggccgagacgggcggatcatgaggtcaggagatcgagaccatcctggctaacacagtgaaaccctgtctctactgaaaatacaaaaaaattagccaggcatggtggcggggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaaaaaaaa

SEQ ID NO: 11518 - DNA, 299 bp, Homo sapiens
tatacatatataatattatatrkgghkkgkctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttscttcttcttccctcagatttagctgatccttcctcccaccctggccttcctttcctctttsctcctcactctccccgtcatgctccctctgccccgcccccaaaaa

SEQ ID NO: 11519 - DNA, 224 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaaaaaaaaaaaaa

SEQ ID NO: 11520 - DNA, 221 bp, Homo sapiens
tkatktcttagtgaaatcccgtctgtagtaacttacagtatttkrgagcaggcgtccccaacccctgggctgcagaccagtattatctggggcctgttaggaactgggtggcacagcaggaggtgagcattactgcctgagctctgccttctgtcagaacagcagcagcgttggattcgcataggagcacaaactctgttgtaaactgcgcttgtgaggga

SEQ ID NO: 11521 - DNA, 388 bp, Homo sapiens
attttttcattccttatatagtactagcataggactggacacatggtaggcacatttatccagtctcctaagggttctactgtgtgccaggtattgttttaggggatctcaaatatggattaaaatacttcccctgtttgcaagctgttcgcaatctcatgacagagacagataaagagkatgtaaagatactaatagatagctagatcatactttatattaggattaatgctgtagtagaaataaatacactgtgacatgggagcaagaaggaaagaggaacacacagagtggctgaaatgtgcttctcatgtatcttatttgattctcaggctaatcctgtgaagtgtggggrtccttagtcacattactacagatgaggaaacta

SEQ ID NO: 11522 - DNA, 140 bp, Homo sapiens
gttaaatattgtctaatcaggccgggcgcggtggctcacgtctgtggtcccggcactttgggagcctgaggsaggcggatcatgaggtcaggagatcaagaccatcgtggcttacacggtgaaacccacgtctctactaa

SEQ ID NO: 11523 - DNA, 172 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactcctgcctgggtgatagagtgacactccttctcaaaaaaaaaaaaaaaa

SEQ ID NO: 11524 - DNA, 413 bp, Homo sapiens
cccgggagggtgaacttaggcggcgaggagaccgagttctcaggaagggcgaaccctggcggcggggaagctggatccctcagacgggcgaacttaggctacggggaggccgagccttcaggaagggcgaggccgggckcggtggctcacgcctgtaatcccagcactttgggaggccgacgcgggtggatcacctgaggtcgggagttcgagaccagtctggccaacatggtgaaaccccgtctgtaccaaaaatacaaaattagccggacgaggtggcgcgcacctgtaatcccagctgctgaggaggctgaggcaggagaatcgcttgaacccgggaggcggaggttgcagtgagccgagatcacatcactgcactccagcctgggcaaccagagcgggggaaaaaaaam

SEQ ID NO: 11525 - DNA, 147 bp, Homo sapiens
ctgagttgttctacacccacctcatattccatgggagggctgtacagggcttttttaacgaggcctctaagcacaggcatttgtatcctttccagcctttcactattacaatgttgtagtgaataactttacacactgtcatttatt

SEQ ID NO: 11526 - DNA, 298 bp, Homo sapiens
taaaaggaagttcttggccgggcgcggtggctcatgcctgtaatcccagcactttgggaggccgaggtgggtggatcacgagatcaggagatcgagaccatcttggctaacacggtgaaaccccatctctactaaaaatacaacaaattggctgggcgcggtggcgggtgcctgtagtcccagctgctcgggaggctgaggcaggagaatggcctgaacccaggaggcggasttgcagtgagctgagatagtgccactgcactccggcctggtgaaagagcgagactccgtctcaaar

SEQ ID NO: 11527 - DNA, 597 bp, Homo sapiens
cttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgyaatagtctgtttcaatcttaaaaagaatcaataaaaacaa

SEQ ID NO: 11528 - DNA, 300 bp, Homo sapiens
  misc_feature 300: n=a, g, c or t
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcan

SEQ ID NO: 11529 - DNA, 303 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaagactccatctcaaaaaaaaaaaaaaaa

SEQ ID NO: 11530 - DNA, 317 bp, Homo sapiens
  misc_feature 253: n=a, g, c or t
aaaaagtcmmtgggaagcggccgggcgcggtggctcacccctgtrrkcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttgaacccgggaggcggaggttgcagtgacccganrtctcgccaccgcactccagcctgggcgacagagcgggactccaccccaaaaaaaaaaaaaaaa

SEQ ID NO: 11531 - DNA, 457 bp, Homo sapiens
taaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgrtattgctaaggavctgaaatcggaggagccagaggcccttttcagtccaggccaacattgtacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctg

SEQ ID NO: 11532 - DNA, 402 bp, Homo sapiens
ttggagttttgctcttgttgcccaggctggagtgcagtggtgtgatcttggctctctgcagcctccgcctcctgggttcaggcgattctccwgcctcagcctcccaagtggctgggattacaggtatgcgccaccatgcctggctaatttttgtgttttwagtggragatggggtttctccatgttggtcgggagtttgagaccaccctggccatgatggtgaaccccgtctctactgaaaatacaaaaattggctgggtgtggtggtgcacacctgtaatcccagctacgtgggaggctgaggcatgagaatggcttgaggtcagcagatggaggttgcagtgggccgagattgtgccactgcaatccagcctagatgacagagcaagactgtctcaggam

SEQ ID NO: 11533 - DNA, 387 bp, Homo sapiens
attaatcatcaagaagacgtaacaggccaggcgtggtggttcacacctgtattcccagcattttgggaggctgaggcaggagaatcgcttgaactcaggaggcagaggttgcagtgagccaaagttgcaccattgcactccatcctgggcaakgagraktgaaactccgtctcaaaaaaaagagaagacataacaatcaaatatgtgtcaacataataaaagaaattcagggccgggcgcggtcgttcacgcctgtaatcccagcactttgggaggccgaggcggacagatcacgaggtcaggagttcaagaccagcctgactaacatggtaaaaccccatctctactaaaaatacaaaaattagctgggcgtggtggcacacgcct

SEQ ID NO: 11534 - DNA, 175 bp, Homo sapiens
tattttaktataratcasgacctttcgtggaactgtattgaaattaattatcctgggcctggcgcggtggctcatgcctgtaatcccagcgctttgggargccaaggtgggcggatcatgasgtcaasagatcgaraccatcctggctmscacggtgaaaccccgtctctactaw

SEQ ID NO: 11535 - DNA, 312 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaaaaaaaa

SEQ ID NO: 11536 - DNA, 61 bp, Homo sapiens
aattgwgttcgcagccgccgccgcgccgccgtcgctctccaacgccagcgccgcctctcgc

SEQ ID NO: 11537 - DNA, 371 bp, Homo sapiens
ctcctgtcttgtctcagcggctgccaacagatcatgagccatcagctcctctggggccagctataggacaacagaactctcaccaaaggaccagacacagtgagcaccatgggacagtatcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgat

SEQ ID NO: 11538 - DNA, 306 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaagactccatctcaaaaaaaaaaaaaaaaaas

SEQ ID NO: 11539 - DNA, 313 bp, Homo sapiens
  misc_feature 132: n=a, g, c or t
gattacgcgtcgcarcrcccarrgcccagcgcccagcctccagtgcccgcccctctcggccgcccgacgctctctgctcgcgcttgggctcgcgatggggaagaagtcccgggcggtacccggccgtascantcctgcaactctctccgcmgggtcctcggggcagcacgccgggccgggacccggagccggaacccgacactgagccggactcaaccgcggcggtccccagcmagcmcgcmccgtcggcggcgacgaccaccgcggtgactgcmgcmgcggcctcggacgamtcgccttcagaaggcaaggr

SEQ ID NO: 11540 - DNA, 77 bp, Homo sapiens
argmrcccgggagcgcgaccctcccccggcccggcctggcccggcctggccagtccccgcggtctctgcccgggctg

SEQ ID NO: 11541 - DNA, 463 bp, Homo sapiens
acagacatcgccaggagagcatcgccaggtctgagctgagttctcctctgcacagacttcggagatacagcgaaggcgasagtgttctcctcagcacagacccaggcgggccgggggcaccgcgagggcgtastgcgttctgctcagcacagaccccggggacaccgcgaaggcagagtagcgttctcctcacaacagaccttgggggcagtgctcgctttgggacaactcggggccgcatagacgggatcatggcacaagttgcagtttccaccctgcccattgaagatgaggagtccatgggaagatgaggagtcattgaagatgattctgcggagagcaggatggtggtgacattgctcatatcagctctcgagtccacagatcatggcacaagttgcagtttccaccctgcccattgaagatgaggattctgttgaagatgatgagtccttggagagca

SEQ ID NO: 11542 - DNA, 316 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaaaaaaaaaagc

SEQ ID NO: 11543 - DNA, 297 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctcca

SEQ ID NO: 11544 - DNA, 383 bp, Homo sapiens
tatattgtttcccaagaagttctacttggtttcatttcaaacctgcctggtttttttgtttgtttgtttttatttttgttttgagacgaaktgggggtttcactcttgttgcccgggctggagtgcaatggcgtgatctcagctcactgcaacctccaccacctgggttcaagcaattctcctgcctcagcctcctgaggtcaggagtttaagaccagcctgacgaacatggagaatctccgtctctaataaatatacaaaattagccagacatggtgatgcatgcctgtaatcccagctactcaggaggctgaggcaggagaatcacttgaacccgggagttgaaggatgcagtgagctgagatcatgtcattgcactccag

SEQ ID NO: 11545 - DNA, 456 bp, Homo sapiens
  misc_feature 362,415: n=a, g, c or t
gcgggcagatcatgaggtaaggagatcgagaccatcctggctaagacggtgaamcctgtctctactaaaaacacaaaawattagctgggtgtggtggcagtcgcctgtggtcccagctactsgggaggctgaggcaggagaatggcgggaacctgggaggtggagcttgcagtgagccaaaatcacgccactgcactccagcctgggtgacagagtgagactctgtcccagaaaaaaaaaattgtggaamactttctgctgctcagtatgatgtgaaatctcaacaagcaaaaagattggctaggctgggagcagtggctcaggcctgtaatcccagcactttgggaggccaaggtgggtanattgcttcagctcaggagctctagaacagcctgggcaacatggcaaaacccantctctaaaaaaatacaaaaattagttgggcgtggtggcaca

SEQ ID NO: 11546 - DNA, 296 bp, Homo sapiens
  misc_feature 146: n=a, g, c or t
aaagagcagttcagttcgctcactcctcgccggccgcctctccttcgggctctcctcgcgtcactggagccatggcgttcgcgagacctacccggcggcatcctccctgcccaacggcgattgcggccgccccagggcgcggccgnaggaaaccgggtgacggtggtgctcggtacgcatggggcgacgaaggcaaagggaaggtggtggacctgctggcgcagacgcgacatcgtgtgccgctgccagggaggaaataatgctggccatacagttgttgtggattctgtggaagc

SEQ ID NO: 11547 - DNA, 209 bp, Homo sapiens
  misc_feature 167,174,189,204: n=a, g, c or t
acatgaaaaacagcagttagggccaggcatggtggctcacgcctgtaatctcagcactttgggaggctgaggcaggcagatcatttgaggtcaggagtttgagtccaccctggccaacatggtgagacctcgtctctactaaaaatacaaaaattagctgggcatantggtgcntgcctgtagtcccanctacttgggaggctnaggca

SEQ ID NO: 11548 - DNA, 163 bp, Homo sapiens
gagcaatacttatatagaactcatggtatgctagattctattataagtgctttatacttactgacttatgacattaataactccgcaagtacgactattactgtcattatttcccaggttaaaaaactaaggcacagagaggttaagtatcttgctcattgac

SEQ ID NO: 11549 - DNA, 268 bp, Homo sapiens
ctagaaagtacagttggccaggcatggtggctcaatgcctgtaatccccacacttgaggaggccgggatgggtggattaccttgagctcaggagtttcagaccagcctgggcaacatggtgaaacccatctctacaaaaaaaattacaaaaattagccagacatgatggcccacacctgtgtcccagctgctttggggaagggcttaaaggtgagaggatcacttgagcccaggagattgaggctgcagtgagctgagatcgcgccac

SEQ ID NO: 11550 - DNA, 409 bp, Homo sapiens
gcgggcagatcatgaggtaaggagatcgagaccatcctggctaagacggtgaaacctgtctctactaaaaacacaaaaaattagctgggtgtggtggcagtcgcctgtggtcccagctactcgggaggctgaggcaggagaatggcgggaacctgggaggtggagcttgcagtgagccaaaatcacgccactgcactccagcctgggtgacagagtgagactctgtcccagaaaaaaaaaattgtggaacactttctgctgctcagtatgatgtgaaatctcaacaagcaaaaagattggctaggctgggagcagtggctcaggcctgtaatcccagcactttgggaggccaaggtgggtagattgcttcagctcaggagctctagaacagcctgggcaacatggcaaa

SEQ ID NO: 11551 - DNA, 493 bp, Homo sapiens
  misc_feature 62: n=a, g, c or t
ctagaaagtacagttggccaggcatggtggctcatgctgtaatccccacacttgaggaggtngggatgggtggattacttgagctcaggagtttcagaccagcctgggcaacatggtgaaacccatctctacaaaaaatacagaaattagccagacatgatggcccacacctgtgtcccagctgcttgggaggctaaggtgagaggatcacttgagcccaggagattgaggctgcagtgagctgagatcgcgccactgcaatccagcctgggcgacagagcaagaccctgtctcgacaacaacaacaaaaaaagtacacgctgggcatggtggctcatgctgtatcccagcactttgggaggccgaggtgggtgcatcacgaggtcaggagatcgagaccatcctggctaacatggtgaaacccatctctactaaaaatacaaaaaattagccaggcgtggtggcacgtgcctgtagtcccagctagtcagta

SEQ ID NO: 11552 - DNA, 369 bp, Homo sapiens
tgccacatattatttcaatggactttctcccaacagcagtaatagtctttactgacaggtgttatttacttaggatttgaaagtcccctcaaatatgtttgaagaatatactatctcaaggtctgagatggacagattaagctctttacagagtggccaatggttttttttgctatgtgtgcttgtgatttctcgcacaactgtagcctgtgaaatgttatttgaaatgtacagggagatagaggaggacctgggatacctggatttaagggagaacctggactttctattcgaggaccaaaggtatgctttattcatgttctttttgtttttctgtatctgaaataaatgaaggtagatttaatacaa

SEQ ID NO: 11553 - DNA, 220 bp, Homo sapiens
tcttcagaaggagcagcagccaccgaagaggcacagccctcatgcactccagagaccatgggcagctgcctccatggccgtgtcctgccctgtctcccctcccagccctgggctggctctggcccccgaggagtagacagtaggtccctgtcactgtggctttccttgctttctgtccctgggtcttgccccttgtgccgagctgctggctgcccccctc

SEQ ID NO: 11554 - DNA, 495 bp, Homo sapiens
tccagcccattggtcgccgacctgctaactacaaaaccagcatgcgctgtctgtcctcccccgtggtgcgcascctggagggagggacagggcggtgtggacctcgtcctttcctaagcgatgccacatgctgattctgtgccaccccctcgccaagggagtccgcagaaggacttgaggggcaggtctaggctgggcgatgaggacggtgtgaccctgcgaagtgcacctcccttgctcaaatcggaggggtctggtcctcactgaacagcccgctgaacatctcggtgtcctctcacacacacccggcggggaggtttccagagcatcgsacctcttccagcccagggagccgcctgctctgctaaactctatggggaactgagacatccacctgctgsgtgacccaccgtgsgcaacttcagagctttcagggggtgatgcgggctgtgggctccttsgtgaaaatgtcaccgtctgcagcgcctttcttgt

SEQ ID NO: 11555 - DNA, 376 bp, Homo sapiens
tttctcctaggatgtctgtatctttgaagcaccaccccatgggacatcattttgagtagagttactggtaatctgctactcctcatcagggttccaggggcttggcttagtgctgtactgatagcccttagttagtggtctgggagccttaaacttacagtgtgttacaacgtagacaggtgaagcattagagctcctaggccattaactgaagagttaaaaactgttcatcttcataaggagtttgagtatcttttaaggtgtgagtaaaaacaagaataaaagagttatgaggaagatctgtaggttggatgcaagagaatgaatggggaaatcacagtgaattgttggctttgagggatgtataaaggggatg

SEQ ID NO: 11556 - DNA, 120 bp, Homo sapiens
gctgaggcaggagaatcacttgaacacgggaggcagaggttgcagtgagctgagatcacgcaactgcattccagccttgtgacagggcaagactctgtctcaaaaacaaacaaacaaaca

SEQ ID NO: 11557 - DNA, 320 bp, Homo sapiens
  misc_feature 310: n=a, g, c or t
tmatmaasgggtacaaacgagtcctggccttgtctgtggagacggattacaccttcccacttgctgaaaaggtcaaggccttcttggctgatccatctgcctttgtggctgctgccctgtggctgctgcacacagctgctcctgctgctgctgcascccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaaaaaaaaaaanggaaaaaaaa

SEQ ID NO: 11558 - DNA, 530 bp, Homo sapiens
cacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctggcctaggtccccccttt

SEQ ID NO: 11559 - DNA, 460 bp, Homo sapiens
aatgaagttaggccacaaattctttctagtaggttcaagtatttaagcacctggagaggtgactggttaccctcctagtggcttcaggaagttttctcactgaatgaatatttattgagtgccaactctgctcagcacaattcaggggtgctgggaatgcagcagtgaataacacaagcagtgttccttccctcatggggcttatgatctctggaagcactgctttgcacagggaagtagcaccaggagggggtaaagaaagagggactttggagccccaagattggcaaaaactatagctaatgagagaggtgaactatagtctagataatggggaaggagaggtgccagagcaagaagggattctcacagggccctacgggtcagtcctgaattggctttactagaactcaagcccagcacaatggctcacatctgtaatccaagcgctttgggaggc

SEQ ID NO: 11560 - DNA, 114 bp, Homo sapiens
argccaggaacgcacgctgcctggccgtatcgccgcccccaccgccgccgccgccgggactagaagtgagccgcccgggtcccaaacgccagccagccagtcagtgggtcccgc

SEQ ID NO: 11561 - DNA, 396 bp, Homo sapiens
catggttcatgggtacaatggtgcaggtgatgccccctgcatggttcacgggtacaatggtgcaggtgatgccccctgcatggtttgtgggtgcaatggtgcaggtgatgccctgcatggttcatgggtacaatggtgcaggtgatgccccctgcatggctcatgggtacagtggtgcaggtgatgtcccctgcatggttcatgggtgcaatggtgcaggtgatgccccctgcatggttcacaggtgcaattgtgcaggtgatgccccacaggcctgctattttgattgttcctcccagcttctacttttggagatccacccttcacagactcttcatttgtggtcacttctggctgcaggtggacctgttgggagggaccctttcaagacagctc

SEQ ID NO: 11562 - DNA, 147 bp, Homo sapiens
ctttaggtgtattavgatataaggcsaggctgggcatggtggctcatgcctgtaatcccagcastttgagtggctgaggtgggaggatcacttgagcccaggatttcaaggcgagsctgggacacatggtgaaacctgtmtctgcaa

SEQ ID NO: 11563 - DNA, 324 bp, Homo sapiens
cttgttctatcacccaggctggtgtgcactggtatgttctcgctcactgcaaccactatctstcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctsagccttccaaagtgctgagattacagtcctgagccactgctttcggscttacagaattgttttgttttggggcattcagaagtctgacataaaaattaact

SEQ ID NO: 11564 - DNA, 280 bp, Homo sapiens
gactgacaactcacacggctgggtactcttctgagacaaaacttccagaggagcgatcaggcagcaacatttgctgttcaccaatatccattgttctgcagcctctgctstgatacccaggcaaacagggtctggagtggacctccaaactccaasccacctgcagctgagggtcctgactgttagaaggaaaactaacaaacagaaaggacatccacaccaaaaccccatctgtacatcaccatcatcaaagaccaaaggtagataaaaccacaaacat

SEQ ID NO: 11565 - DNA, 387 bp, Homo sapiens
aaaaatacctctaggtgttccggacactatgtgcctatagctggctacaggatcacagcagccaaaagccctccaggaagaagtatggaagcagctttattgaggttgccagcaaggattacggcttctttgacgcatgaacgttttggaatttatgaggattttaatgaggattttctgaaaaaaataaaaatgtagcctctttggatcttcatttaatcatccgttgggggaaaaaaaaaggaaaagaaggatttgtctagagaaatgcctgtasaccctttaaacagtgcttatcacataatacagtgttatgatctgggcattcatctatcctctcatcagcttttgatctaccacatcttgggatatgaataatgtttctgt

SEQ ID NO: 11566 - DNA, 148 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctctgcaaaa

SEQ ID NO: 11567 - DNA, 318 bp, Homo sapiens
tattttattataaatcaggacctttcgtggaactgtattgaaattaattatcctgggcctggcgcggtggctcatgcctgtaatcccagcgctttgggaggccaaggtgggcggatcatgaggtcaagagatcgagaccatcctggctagcacggtgaaacccgtctctactaaaaaatacaaaaaaaattagctgggcatggtggtggtgcctgtggtcccggctactcgggaggctgaggcaggagaatggcgtgaacgtgagaggtggagcttgcagtgagctgagatcgcgctactgcattccagcctgggcaa

SEQ ID NO: 11568 - DNA, 305 bp, Homo sapiens
aatggtagagacaggstttcaccatgttggccaagctggtctcaaactcctgacctcatgcctgtaatcccagcattttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggt

SEQ ID NO: 11569 - DNA, 200 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaaaa

SEQ ID NO: 11570 - DNA, 200 bp, Homo sapiens; identical to SEQ ID NO: 11569

SEQ ID NO: 11571 - DNA, 111 bp, Homo sapiens
ttaggcccaagaattacctgaacctgggacgtggaggttgcggtgagccaagatcgcaccactgtaccctagcctgggcaacagagtgactcttaaaaaaaaaaaaaaaaa

SEQ ID NO: 11572 - DNA, 93 bp, Homo sapiens
ctttaggtgtattaagatataaggccaggctgggcatggtggctcatgcctgtaatcccagcactttgagtggctgaggtgggaggatcactt

SEQ ID NO: 11573 - DNA, 172 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaaag

SEQ ID NO: 11574 - DNA, 159 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctctgcaaaaaaaaaaaaaaa

SEQ ID NO: 11575 - DNA, 173 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactcctgcctgggtgatagagtgacactccttctcaaaaaaaaaaaaaaaaa

SEQ ID NO: 11576 - DNA, 408 bp, Homo sapiens
gactgacaactcacacggctgggtactcttctgagacaaaacttccagaggagcgatcaggcagcaacatttgctgttcaccaatatccattgttctgcagcctccgctstgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcstctcttcctccgaagaattgcacctcctcaccagcaatggaacaaagctggagggagaatgactttgacgagttgagag

SEQ ID NO: 11577 - DNA, 311 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagatcgcttgggcccaggagatgtaggttgcagtgagttgttatcacaccactgcactcctgcctgggtgacagagcaagagcctgtcgccaaaaaaaaaaaaaaaaa

SEQ ID NO: 11578 - DNA, 125 bp, Homo sapiens
  misc_feature 111: n=a, g, c or t
ctttaggtgtattaagatataaggccaggctgggcatggtggctcatgcctgtaatcccagcactttgagtggctgaggtgggaggatcacttgagcccaggatttcaagncgagcctgggacac

SEQ ID NO: 11579 - DNA, 314 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaaaaa

SEQ ID NO: 11580 - DNA, 162 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaaccctgtctctgcaaaaaaaaaaaaaaaa

SEQ ID NO: 11581 - DNA, 327 bp, Homo sapiens
aatggtagagacagggtttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggcagggtgagaatccatctca

SEQ ID NO: 11582 - DNA, 309 bp, Homo sapiens
tttaaagatgttgccatttttggctgggcacagtggctcacacctgtaatcccagcactttgggaggccgaggtgggcagctcgcttgagtcaggagtttgagaccagcctggccaatatggtgaaaccctgtctctactaaaaaatacaaaaattagctgggcatggtggcatgtgcctgtaatcccagctactcgggaggctgaggcaggagaattgcttgaacccaggaagcagaggctgcagtgagccaagatcataccactgcactccagcctaggtgacagagcgagactccatctggcaaaa

SEQ ID NO: 11583 - DNA, 53 bp, Homo sapiens
  misc_feature 35: n=a, g, c or t
tataaakakaagtatgataatggtaaaattatggnatatataaatgttaaatc

SEQ ID NO: 11584 - DNA, 460 bp, Homo sapiens
tctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaacssaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccat

SEQ ID NO: 11585 - DNA, 281 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaagcggaggttgcagtgacccgagatctcgscaccgcactccagcctgggcga

SEQ ID NO: 11586 - DNA, 160 bp, Homo sapiens
ctttaggtgtattaagatataaggccaggctgggcatggtggctcatgctgtaatcccagcactttgagtggctgaggtgggaggatcacttgagcccaggatttcaaggcgagcctsggacacatggtgaaacctgtctctgcaaaaaaaaaaaaaaaa

SEQ ID NO: 11587 - DNA, 315 bp, Homo sapiens
  misc_feature 6,44,204: n=a, g, c or t
tttaansatgttgccatttttggctgggcacagtggctcacacntgtaatcccagcactttgggaggccgaggtgggcagctcgcttgagtcaggagtttgagakscagcctggccaatatggtgaaaccctgtctctactaaaaaatacaaaaattakctgggcatggtggcatgtgcctgtaatcccagctactcgggaggntgaggcaggagaattgcttgaacccaggaagcagaggctgcagtgagccaagatcataccactgcactccagcctaggtgacagagcgagactccatctggcaaaaaaaaa

SEQ ID NO: 11588 - DNA, 431 bp, Homo sapiens
actagtgaatggcagtgattccagttcattcctagctcagaaagcaacgttttgagccacaactgtcacaactccagacaagtatcttgctatgttggccagggtggtcttgaacatctgacctcaagcaatcctcctgcctcagcctcccagagtgctgggattacaggtgtgagccatcgtgcctggccagaatgtgcatttctaacaagttgccaggtgacactgatgctgcttgtctggggaccacactttgagaaccattaaacatcaggataaaaatacaataggttgaggatggcaaagcagaatgataaagcctgggtgttgatggccttgtccagaagctgaatcaatgtaaaccactcccttgcctctggatttcttgttcagtgataaaataaaccactctttaagctactgttaaaaaa

SEQ ID NO: 11589 - DNA, 320 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtcca

SEQ ID NO: 11590 - DNA, 200 bp, Homo sapiens; identical to SEQ ID NO: 11569

SEQ ID NO: 11591 - DNA, 200 bp, Homo sapiens; identical to SEQ ID NO: 11569

SEQ ID NO: 11592 - DNA, 171 bp, Homo sapiens
cataagaatttataaacttgaaatagaaatattctattgtaaaggttaasaaaagtatacttggttggccaccgaggctcactaccataatcccagtacttcgggaggcagggtggaaggattgctcgagcccagaaggtggaggctgcagtgagccatgatcatgccact

SEQ ID NO: 11593 - DNA, 162 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactcctgcctgggtgatagagtgacactccttctcaaaaaa

SEQ ID NO: 11594 - DNA, 118 bp, Homo sapiens
gttaaatattgtctaatcaggccgggcgcggtggctcacgtctgtggtcccggcactttgggagcctgaggcaggcgatcatgaggtcaggagatcaagaccatcgtggcttacacgg

SEQ ID NO: 11595 - DNA, 245 bp, Homo sapiens
gtataattcctttgttagccacgtttactgggaaaaaaactggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaggagcaggcaaaagaatcctcgaagc

SEQ ID NO: 11596 - DNA, 86 bp, Homo sapiens
ctttaggtgtattaagatataaggccaggctgggcatggtggctcatgcctgtaatcccagcabtttgagtggctgaggtgggagg

SEQ ID NO: 11597 - DNA, 347 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcacgagtgcacgcctgtaatccctgctactcgggaggctgaaacaggagaatcacttgaacccaggagacggaggttgcggtgagttgagattatgccactgtactccagcctgggtgacagagcgaga

SEQ ID NO: 11598 - DNA, 200 bp, Homo sapiens; identical to SEQ ID NO: 11569

SEQ ID NO: 11599 - DNA, 299 bp, Homo sapiens
cttttttggctggacgtggtggctcgcgcctgtaatcccagcgctttgggaggccaaggtgggtggatcacctgagatcgggagttcgagaccagcctagccagcatggtgaaacctgtctctactaaaaatataaatattagctgggtgtggtggtatgcgcctgtggtcccagctgcttgggaggctgaggcgggagagttgcttgaacctgggaggtggaggttgcagtgagccgagatctcaccattgcactccagcctgggcgacaagagcaaaactccatctcaaaaacaaaa

SEQ ID NO: 11600 - DNA, 347 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagac

SEQ ID NO: 11601 - DNA, 114 bp, Homo sapiens
ctttaggtgtattaagatataaggccaggctgggcatggtggctcatgctgtaatcccagcactttgagtggctgaggtgggaggatcacttgagcccaggatttcaaggcgag

SEQ ID NO: 11602 - DNA, 168 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaa

SEQ ID NO: 11603 - DNA, 200 bp, Homo sapiens; identical to SEQ ID NO: 11569

SEQ ID NO: 11604 - DNA, 371 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaaggctgaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaa

SEQ ID NO: 11605 - DNA, 280 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaacaagagtga

SEQ ID NO: 11606 - DNA, 250 bp, Homo sapiens
ttgagaccttccttaagagaggaaagcttatctttagtttatagaaataaaaacaaaactgtatttccaagcaaaactgactttatgtaggtgtctccagagatgcagcttcagckcctcgcagatgccgctgaggagctgctggaccgcctcgstcacacagcatgctgccctcagacgtgtccatcctgtaccacatgaaaacgctgctgctcctgcaagattacttgagagatttgaagcattgctc

SEQ ID NO: 11607 - DNA, 165 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacctgtctctgcaaaaaaaaaaaaaaaaaagy

SEQ ID NO: 11608 - DNA, 353 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagt

SEQ ID NO: 11609 - DNA, 385 bp, Homo sapiens
  misc_feature 384..385: n=a, g, c or t
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgsagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaaaaaaaaaaaann

SEQ ID NO: 11610 - DNA, 383 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagsactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaaaaaaaaaaaag

SEQ ID NO: 11611 - DNA, 174 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcacttcagcctgggtgacagagtgagactctgtcacaaaaaaaaaaaaaaaaa

SEQ ID NO: 11612 - DNA, 295 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagatcgcttgggcccaggagatgtaggttgcagtgagttgttatcacaccactgcactcctgcctgggtgacagagcaagagcctgtcgcca

SEQ ID NO: 11613 - DNA, 68 bp, Homo sapiens
ataaaaaaaaaaaaaaaaaaaaaaaaaaaaaaaaaaaaaaaaaaaaaaaaaaaaaaaaaaaaaaaaaa

SEQ ID NO: 11614 - DNA, 160 bp, Homo sapiens
tacaaaaaattagctgggcgtggtggcaggcgcctgtggtcccagctactcgggaggctgaggcaggagaatagtgtgaacccaggaggcggasttggcagtgagccaagatagtgccactgcacttcagcctgggtgacagagtgagactctgtcacaa

SEQ ID NO: 11615 - DNA, 281 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaacaagagtgaa

SEQ ID NO: 11616 - DNA, 87 bp, Homo sapiens
aaacctaacttgcgcagaaaacaagatgagattggcatggstttatttgttttttttgttttgttttggtttttttttttttttggg

SEQ ID NO: 11617 - DNA, 225 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaaaaaaaaaaaaaa

SEQ ID NO: 11618 - DNA, 87 bp, Homo sapiens
aaacctaacttgcgcagaaaacaagatgagattggcatggctttatttgttttttttgttttgttttggtttttttttttttttggg

SEQ ID NO: 11619 - DNA, 200 bp, Homo sapiens; identical to SEQ ID NO: 11569

SEQ ID NO: 11620 - DNA, 322 bp, Homo sapiens
tttaaagatgttgccatttttggctgggcacagtggctcacacctgtaatcccagcactttgggaggccgaggtgggcagctcgcttgagtcaggagtttgagaccagcctggccaatatggtgaaaccctgtctctactaaaaaatacaaaaattagctgggcatggtggcatgtgcctgtaatcccagctactcgggaggctgaggcaggagaattgcttgaacccaggaagcagaggctgcagtgagccaagatcataccactgcactccagcctaggtgacagagcgagactccatctggcaaaaaaaaaaaaaaaaa

SEQ ID NO: 11621 - DNA, 369 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaa

SEQ ID NO: 11622 - DNA, 166 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactcctgcctgggtgatagagtgacactccttctcaaaaaaaaaa

SEQ ID NO: 11623 - DNA, 170 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcacttcagcctgggtgacagagtgagactctgtcacaaaaaaaaaaaaa

SEQ ID NO: 11624 - DNA, 152 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaatatggtgaaacgtgatctctacgaaaaaaaaaaaa

SEQ ID NO: 11625 - DNA, 144 bp, Homo sapiens
caaaaactagccaggcagggctgggcgcggtggctcacgcctgtaatcccagcactttgggaggccgaggcgggcggatctcgaggtcaggagattgagaccatcccggctaacacggtgaaacccgtctctactaaaaataca

SEQ ID NO: 11626 - DNA, 225 bp, Homo sapiens
cataagaatttataaacttgaaatagaaatattctattgtaaaggttaagaaaagtatacttggttggccaccgaggctcactaccataatcccagtacttcgggaggcagggtggaakgattgctcgagcccagaaggtggaggctgcagtgagccatgatcatgccactgcactccaacctgggtaacagagggagaccttgtctgaaaaaaaaaaaaaaaaa

SEQ ID NO: 11627 - DNA, 226 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagcggagaccttgtctgaaaaaaaaaaaaaaaaa

SEQ ID NO: 11628 - DNA, 341 bp, Homo sapiens
  misc_feature 7,135,270..271,296: n=a, g, c or t
cttgttntatcacscaggstggtgtgcactggtatgttstcgctcastgcaascactatctctcaggttcaagcgattctcsttcctcagcctcctgagtagmtgggattasaggcacatgtcacsasgcctggntaatttttgtatttttaatagagavtgggtttcacsatgttggscatgmtggtcttgaasttctggsctsaagtgatstgcccacctcagccttccaaagtgctgagattacagtcctgagscactgmtttcggnnttasagaattgttttgttttggggnattcagaagtctgasataaaaattaacttgaaaawraaaaaaaag

SEQ ID NO: 11629 - DNA, 173 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaargy

SEQ ID NO: 11630 - DNA, 316 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactg

SEQ ID NO: 11631 - DNA, 78 bp, Homo sapiens
gaacacttccatggattgtccttggacttagggcgccctgccgccttttgcagaggagaaaaaacttttttttttttt

SEQ ID NO: 11632 - DNA, 195 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaa

SEQ ID NO: 11633 - DNA, 78 bp, Homo sapiens; identical to SEQ ID NO: 11631

SEQ ID NO: 11634 - DNA, 221 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaaaaaaaaaa

SEQ ID NO: 11635 - DNA, 242 bp, Homo sapiens
ccgaggtgggtgtatcacctgaggtcaggagtttgagaccagcctggacaacatggtaaaaccccgtctctgctaaaaatacaagagttagctgggcgtggtggcaggcacctgtggtcccagctactcgggaggctgaggcaggagaattgcttgagcccaggaggcagaggttgcagtgagccaagatcatgcccctgcactccagcctaggcgacagagctagactctgtctcaaaaaa

SEQ ID NO: 11636 - DNA, 134 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaac

SEQ ID NO: 11637 - DNA, 87 bp, Homo sapiens; identical to SEQ ID NO: 11618

SEQ ID NO: 11638 - DNA, 173 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaaagc

SEQ ID NO: 11639 - DNA, 127 bp, Homo sapiens
  misc_feature 122: n=a, g, c or t
ctttaggtgtattaagatataaggccaggctgggcatggtggctcatgcctgtaatcccagcactttgagtggctgaggtgggaggatcacttgagcccaggatttcaaggcgagcctgggnacaca

SEQ ID NO: 11640 - DNA, 216 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaaaaa

SEQ ID NO: 11641 - DNA, 303 bp, Homo sapiens
aaaaagtccctgggaagcggccgggcgcggttggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggtgacagagcgggactccacccca

SEQ ID NO: 11642 - DNA, 336 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtccaaaaaaaaaaaaaaaaa

SEQ ID NO: 11643 - DNA, 112 bp, Homo sapiens
ctttaggtgtattaagatataaggccaggctgggcatggtggctcatgcctgtaatcccagcactttgagtggctgaggtgggaggatcacttgagcccaggatttcaaggc

SEQ ID NO: 11644 - DNA, 170 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaa

SEQ ID NO: 11645 - DNA, 109 bp, Homo sapiens
gtgtgttaagaaatgagctgtaggtcagtgcagtggctcatgcctgtaatcccagcactttgggaggctgaggtgggcggatcatgaggtaaggmgttcgagagcagcc

SEQ ID NO: 11646 - DNA, 122 bp, Homo sapiens
ctttaggtgtattaagatataaggccaggctgggcatggtggctcatgctgtaatcccagcactttgagtggctgaggtgggaggatcacttgagcccaggatttcaagggcgagcctggga

SEQ ID NO: 11647 - DNA, 294 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttc

SEQ ID NO: 11648 - DNA, 189 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaa

SEQ ID NO: 11649 - DNA, 301 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaagastccatctcaaaaaaaaaaaaaa

SEQ ID NO: 11650 - DNA, 152 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtc

SEQ ID NO: 11651 - DNA, 55 bp, Homo sapiens
gtcagacaataaagtctttgtaaaaagagaaaaaaaaaaaaaaaaaaaaaaaaaa

SEQ ID NO: 11652 - DNA, 109 bp, Homo sapiens
ctttaggtgtattaagatataaggccaggctgggcatggtggctcatgcctgtaatcccagcastttgagtggctgaggtgggaggatcacttgagcccaggatttcaa

SEQ ID NO: 11653 - DNA, 201 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctcgggcaacagagcaagaccctgtctctacaaaaaaaaaaaaaaaaa

SEQ ID NO: 11654 - DNA, 110 bp, Homo sapiens
ttaggcccaagaattacctgaacctgggacgtggaggttgcggtgagccaagatcgcaccactgtaccctagcctgggcaacagagtgactcttaaaaaaaaaaaaaaaa

SEQ ID NO: 11655 - DNA, 333 bp, Homo sapiens
gtgagccgagatcttgccactgcactccagccagggtgatggagtgagactctcagaaaaaaattagtgccaggcacaggggctcacacctataatccccgcactttkgcaggscaggtgggcaaattgcttgagcccaggagttcgagaccagcctgggcaacatggcgaraccctgtctaacaaaaaaaatacaraagttagccaggagtggtggcacaagcctgtagtccctgctgstagggaractgtagtgggaggatsacttcagcstgggagaccaaggctgcagtgagtcatgmgtgtgcsattgsaccccagtgtgggccacag

SEQ ID NO: 11656 - DNA, 127 bp, Homo sapiens
ctttaggtgtattaagatataaggccaggctgggcatggtggctcatgcctgtaatcccagcactttgagtggctgaggtgggaggatcacttgagcccaggatttcaaggcgagcctcgggacaca

SEQ ID NO: 11657 - DNA, 62 bp, Homo sapiens
wggactatactttcagggatcatttctatagtgtgttactagagaagtttctctgaacgtgt

SEQ ID NO: 11658 - DNA, 63 bp, Homo sapiens
  misc_feature 30: n=a, g, c or t
gactgtcagtgscggscttcctcgtgtgangggatctgccggasscctgcaaattcaatttct

SEQ ID NO: 11659 - DNA, 361 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcmsagtgcacgcctgtaatccctgctactcgggaggctgaaacaggagaatcacttgaacccaggagacggaggttgcggtgagttgagattatgccactgtactccagcctgggtgacagagcgagactcagtctcaaaaaa

SEQ ID NO: 11660 - DNA, 149 bp, Homo sapiens
gttaaatattgtctaatcaggccgggcgcggtggctcacgtctgtggtcccggcactttgggagcctgaggcaggcgatcatgaggtcaggagatcaagaccatcgtggcttacacggtgaaaccacgtctctactaaaaaaaaaaaaa

SEQ ID NO: 11661 - DNA, 162 bp, Homo sapiens
gttaaatattgtctaatcaggccgggcgcggtggctcacgtctgtggtcccggcactttgggagcctgaggcaggcgatcatgaggtcaggagatcaagaccatcgtggcttacacggtgaamccacgtctctactaaaaaaaaaaaaattacaaaaawtca

SEQ ID NO: 11662 - DNA, 225 bp, Homo sapiens; identical to SEQ ID NO: 11617

SEQ ID NO: 11663 - DNA, 99 bp, Homo sapiens
ctttaggtgtattaagatataaggccaggctgggcatggtggctcatgctgtaatcccagcactttgagtggctgaggtgggaggatcacttgagccca

SEQ ID NO: 11664 - DNA, 81 bp, Homo sapiens
cttttccaccaatgagcgagtcatcaatgttaccttctgtcctactgaccatcttcccctccccaaaaaaaaaaaaaaaaa

SEQ ID NO: 11665 - DNA, 347 bp, Homo sapiens
  misc_feature 260,266: n=a, g, c or t
tttaaaaaataaataagtaaataaaattgagcctcattttttaacctaattgaaaatgggtgataaaaatgtatacattgcgaccaggtgcggtggctcacacttgtaatcccagcactttgggaggccaaggcaggtggatcacctgaggtcaggagttcaagaccagcctggccaacatggtgaaacttcgtctctattaaaaatacaagaatcagccaagtgtggtggcacatgcctgtagtcccagctacccgggnggctgnggcaggagaatcgcttgaacttgggatgctgcagttgcagtgagctgcgttcgcaccattgcactcctgcctgggtgacag

SEQ ID NO: 11666 - DNA, 173 bp, Homo sapiens; identical to SEQ ID NO: 11575

SEQ ID NO: 11667 - DNA, 200 bp, Homo sapiens; identical to SEQ ID NO: 11569

SEQ ID NO: 11668 - DNA, 163 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaaccctgtctctgcaaaaaaaaaaaaaaaaa

SEQ ID NO: 11669 - DNA, 132 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggcacacatggtg

SEQ ID NO: 11670 - DNA, 329 bp, Homo sapiens
aatggtagagacagggtttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtacctgtagtcccagctacttgggaggctgaggcaggagaatagcttggacccaggaggtggaggttgcagtgagcccagatcacgcaaatgtcactgtactccagcctgggtggcagggtgagaatccatctcaa

SEQ ID NO: 11671 - DNA, 174 bp, Homo sapiens
tatatacattagctgggcatggtggtgcatgcctgtagtcgcagctgctcgggaggctgaggcaggagaatcgcttgaatctgggaggcggaggttgcagtgagccgagatcacatgacagcactccagcctgggtgacagacagagaccccatctcaaaaaaaaaaaaaaaaa

SEQ ID NO: 11672 - DNA, 305 bp, Homo sapiens
atttttggattttctttaaaaatgcacattccaggctgggcgcagtggctcacgtgtgtaatcccagtactttgggaggctgagggcggatcacaaagccaggagttcaagaccaayctgggcaatatggtgaaacccatctctactaaaaatataaaaagttagccaggtatggtggcacaagcctgtagtcccagccacttgggaggctgaggcagaagaatcacttgaacccgggaggcggaggttgcagtgagccgagatcgtgscactgcactcaagcctaggcaacagagtaagactct

SEQ ID NO: 11673 - DNA, 337 bp, Homo sapiens
aatggtagagacaggstttcaccatgttggccaagctggtctcaaactcctgacctcatgcctgtaatcccagcattttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggcagggtgagaatccatctcaaaaaacaaaa

SEQ ID NO: 11674 - DNA, 473 bp, Homo sapiens
ttagsaaatgttgcytttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttawactgtctggggatgtgtggttawagttctgtgggagaaataattttgycagkgttcaccagcttgtaaaaacttagtgcgagagctgaaacatctaaata

SEQ ID NO: 11675 - DNA, 261 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcactgtgaatctcagctactcgggaggctgaggcagggagaatcactttgaacccaggaggcagaggttgcagtgagccaagatcacaccactgcactccag

SEQ ID NO: 11676 - DNA, 107 bp, Homo sapiens
ctttaggtgtattaagatataaggccaggctgggcatggtggctcatgctgtaatcccagcactttgagtggctgaggtgggaggatcacttgagcccaggatttca

SEQ ID NO: 11677 - DNA, 114 bp, Homo sapiens
  misc_feature 110: n=a, g, c or t
ctttaggtgtattaagatataaggccaggctgggcatggtggctcatgcctgtaatcccagcactttgagtggctgaggtgggaggatcacttgagcccaggatttcaanggcg

SEQ ID NO: 11678 - DNA, 144 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctctgc

SEQ ID NO: 11679 - DNA, 189 bp, Homo sapiens
  misc_feature 45: n=a, g, c or t
tgaatataattagtctcatttgaaatttagtagctgaacatatantgtattaattaacaatactggtcaggcacgttggctcatgcctgtcatcccagcactttgggaggccggggcaggaggatcagtcaagaccgggagtttgagabtaacctgggyaacagagcaagaccctgtctctacaaaaaa

SEQ ID NO: 11680 - DNA, 174 bp, Homo sapiens; identical to SEQ ID NO: 11671

SEQ ID NO: 11681 - DNA, 200 bp, Homo sapiens; identical to SEQ ID NO: 11569

SEQ ID NO: 11682 - DNA, 104 bp, Homo sapiens
  misc_feature 84: n=a, g, c or t
tgaatataattagtctcatttgaaatttagtagctgawcatatactgtattaattaacaatactggtcaggcacgttggctcangcctgtcatcccagcacttt

SEQ ID NO: 11683 - DNA, 179 bp, Homo sapiens
tgaatataattagtctcatttgaaatttagtagctgaacatatactgtattaattaacaatactggtcaggcacgttggctcatgcctgtcatcccagcactttgggaggccggggcavgaggatcagtcaagaccgggagtttgagactaacctgggcaacagagcaagaccctgtct

SEQ ID NO: 11684 - DNA, 194 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaa

SEQ ID NO: 11685 - DNA, 167 bp, Homo sapiens
ttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtytaccaacttatt

SEQ ID NO: 11686 - DNA, 129 bp, Homo sapiens
ttaggcccadgaattacctgaacctgggacgtggaggttgcggtgagccaagatcgcaccactgtaccctagcctgggcaacagagtgactcttaaaaaaaaaaaaaaaaasaaaaaaaaaaaaaaaaa

SEQ ID NO: 11687 - DNA, 174 bp, Homo sapiens
tacaaaaaattagctgggcgtggtggcaggcgctgtggtcccagctactcgggaggctgaggcaggagaatagtgtgaacccaggaggcggasttgcagtgagccaagatagtgccactgcacttcagcctgggtgacagagtgagactctgtcacaaaaaaaaaaaaaaaaag

SEQ ID NO: 11688 - DNA, 158 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaa

SEQ ID NO: 11689 - DNA, 82 bp, Homo sapiens
gtcagacaataaagtctttgtaaaaagagaaaaaaaaaaaaaaaaaaaaaaaaaaaaaaaaaaaaaaaaaaaaaaaaaaaaa

SEQ ID NO: 11690 - DNA, 378 bp, Homo sapiens
  misc_feature 328: n=a, g, c or t
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggncacagagcgagaccttgtctccaaaaaaaaaaaaacccaaaarrraaraa

SEQ ID NO: 11691 - DNA, 317 bp, Homo sapiens
caaaaactagccaggcagggctgggcgcggtggctcacgcctgtaatcccagcactttgggaggccgaggcgggcggatctcgaggtcaggagattgagaccatcccggctaacacggtgaaacccgtctctactaaaaatacaaaaaaaattagctgggcgtggtggcaggtgcctgtggtcccagctactcgggaggctgaggcagaagaatggcgtgaacttgggaggtggagcttacagtgagccgagatcacaccactgcactccagcctgggggacagagcgagactccgtctcaaaaaaaaaaaaaaaaa

SEQ ID NO: 11692 - DNA, 118 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaac

SEQ ID NO: 11693 - DNA, 347 bp, Homo sapiens
tttaaatataaataaatgaaaataatacttctccctgatcataaagaaaatcacattcttagaggccgggcatggtggctcatgcctgtggtcccagcactttggaaggtcgaagtgggtggatcatgaggtcaggagttcgagaccaggctgtccattatagtgaaaccccgtctctgctaaagatacgaaaattagccgggcatggtggtgcatgcctgtggtcctagctactcgggaggctgaggcgggagaattgcttgagtccaggaggtggaggttgcggtgagctgagatcgcgccactgcaccccagcctgggtgacagaccgagactctgtctcaaaa

SEQ ID NO: 11694 - DNA, 278 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgctgtaatcccagctgctcgggaggctgaggcaagagaattgcttgaacggcagaggttgtggtgagccaagatcatgacactgcaccccagcgtgggcaacaagagtg

SEQ ID NO: 11695 - DNA, 361 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagactcagtctcaaaaaa

SEQ ID NO: 11696 - DNA, 430 bp, Homo sapiens
gtggtggccaggggccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagctcaggatgaggcagaaggaagggtaagggaaaggatggggaccacaaggaagagccaggtgctgctcagcagaggatatgggttggagcgaaagttgtaacaagtgggggtggggggtgcgggccgccaccactgctccttgactctgccgtttcctaataagacctggttccacatctcaaaaaaaaaaaaaaaaa

SEQ ID NO: 11697 - DNA, 187 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaa

SEQ ID NO: 11698 - DNA, 140 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtggaaaccctg

SEQ ID NO: 11699 - DNA, 130 bp, Homo sapiens
  misc_feature 118: n=a, g, c or t
atcgaaaaattagctgggcgtggtgtgtgcctgtggttccagccacatgggaggctggcgcatccccatgcttgagcccaggaggtttaggctgcagtgagctgtgttcatgccactngcactccagcct

SEQ ID NO: 11700 - DNA, 373 bp, Homo sapiens
acagagcaaaaatctgtctaaaaaaaaaaaagaagagastggcacatccatacaatggatgagccamctgttaaaaaaaaaagattgaggggstgggcgtggtggstcasacstktaatcccaggactttgggaggccgaggcgggcggatcatgaggtcaggagatcgagaccttcctggctaacacggtgaaacctgtctctactaaaaatacacacacacacaaaawttagctgggtgtggtggcaagcacctgtattcccagctactcgggaggctgaggcaggagaatggtgtraaccaggaggtggagcttgmagtgagctgagatcgcgcsastgcactccagcctgggtgacagagcgagactcc

SEQ ID NO: 11701 - DNA, 212 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaa

SEQ ID NO: 11702 - DNA, 155 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcacttcagcctgggtgacagagtgagactctgtc

SEQ ID NO: 11703 - DNA, 285 bp, Homo sapiens
cgatgagagctcattgcagctttgaactcctgggcttaagcaatcctctcacctcagccttctgagtagctggactacaggcacctgccaccatgttcggctaattaaaaaaataacaaactctgttcgtaaagatggggtcttgctgtgttgctcaggctgctcttgaactccttgcctcaagtgagcctcccacctggacctgccaaattgctgggattataagcatgagccactgcgcccagccttactcaccttttttgtatgacactatcagtctttcta

SEQ ID NO: 11704 - DNA, 365 bp, Homo sapiens
  misc_feature 170,250: n=a, g, c or t
ctatgatatatagtatgttaaagatatataatgaatataaagaacacttaataaaataaaatcatagctgagtgtagtgctgtgcmctgtagtcctagctactggagaggctgaggcgggagattagcttgagccccagagtttgaggctgcagtgagctatcatcacancactgcactccagcctgtgtgacagagcgagaccctcagtcagtcgattgatagatagatagatagaattttattaaatnaatacttaacaattgaaaagttgtcagatctggtgcccagagaagaaaaattgagtttgtagttattattgctgcttggtgttaggtgaagatgaataggagcgacctaatgaaa

SEQ ID NO: 11705 - DNA, 137 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaaccc

SEQ ID NO: 11706 - DNA, 377 bp, Homo sapiens
acagagcaaaaatctgtctaaaaaaaaaaaagaagagastggcacatccatacaatggatgagccaastkttaaaaaaaaaagattgrggggstgggcgtggtggctcacacctgtaatcccaggactttgggaggccgaggcgggcggatcatgaggtcaggagatcgagaccttcctggctaacacggtgaaacctgtctctactaaaaatacacacacacacaaaaattagctgggtgtggtggcaagcacctgtattcccagctactcgggaggctaaggcaggaraatggtgtgaaccaggaggtggagcttgcagtgagctgagatcgcgcaactgcactccagcctgggtgacagagcgagactccatct

SEQ ID NO: 11707 - DNA, 397 bp, Homo sapiens
cagaaacttctagctcccaggtgtttggactccctccccatccccagctccctcggccacctccgttactttggggttttttgggttttgtttggttggttggtggtggttttttttttcttttttgttttgttttgttttgagacggactcttgctctgtcacccaggctggagtgcagtggcgcaatctcggctcactgcaagctccgcctcccaggttcacgccatctcctgcctcagcctcccaagtagctgggactacaggcgcccaccaccacacctggctaattttttgwatttttagtagagacggggtttcactgtgttaaccaggatggtctcgatctcctgacctcgkgatccgcctgccttggccgcccaaaatgctgggatggg

SEQ ID NO: 11708 - DNA, 128 bp, Homo sapiens
  misc_feature 10,110: n=a, g, c or t
ttaggcccanaattacctgaacctgggacgtggaggttgcggtgagccaagatcgcaccactgtaccctagcctgggcaacagagtgactcttaaaaaaaaaaaaaaaancgaaaaaaaaaaaaaaaa

SEQ ID NO: 11709 - DNA, 114 bp, Homo sapiens
ctttaggtgtattaagatataaggccaggctgggcatggtggctcatgcctgtaatcccagcactttgagtggctgaggtgggaggatcacttgagcccaggatttcaaggcga

SEQ ID NO: 11710 - DNA, 84 bp, Homo sapiens
gtcagacaataaagtctttgtaaaaagagaaaaaaaaaaaaaaaaaaaaaaaaaaaaaaaaaaaaaamasaaaaaaaaaaaaaa

SEQ ID NO: 11711 - DNA, 237 bp, Homo sapiens
attaagatcagcctgggtaatacagtgagaccccatctctagaaaaaataaaaaattagtcaaatgtggtgttagtcccagctacgtgggggactagtagtcccagctacttgggagggggagatgggaggattgcttgagcctgggaagcgaaggttgcagtaagatgagatcgtgccgctgcactccagcctgggtgacagagtgagactctgtctcttaggaaaaaaaaaaaaa

SEQ ID NO: 11712 - DNA, 490 bp, Homo sapiens
gactgacaactcacacggctgggtactcttctgagacaaaacttccagaggagcgatcaggcagcaacatttgctgttcaccaatatccattgttctgcagcctctgctgctgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaaagaagttaaaaaccttgaaaa

SEQ ID NO: 11713 - DNA, 173 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaaagy

SEQ ID NO: 11714 - DNA, 191 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaa

SEQ ID NO: 11715 - DNA, 123 bp, Homo sapiens
tatatacattagctgggcatggtggtgcatgcctgtagtcgcagctgctcgggaggctgaggcaggagaatcgcttgaatctgggaggcggaggttgcagtgagccgagatcacatgacagca

SEQ ID NO: 11716 - DNA, 200 bp, Homo sapiens; identical to SEQ ID NO: 11569

SEQ ID NO: 11717 - DNA, 439 bp, Homo sapiens
gacaaagagaagagaggagatatcctccatgttgaatgtacctggcttctgacatagctgccggcatttacctatgcaaacttctagcttgcttatctatgtttgcagcttgatttctcagggtgctttttgttagaaatgttttaggggctgctttttattaaagaaaaattccactgagaactcctttaacctcactaactgcctaaataatttcttactaactcctatatcactattactgtactgctcttaacctgaacagtggaactcagtctaggttaaagcaagtggagtacgagaagtgagttttgcatttaaattttatttttacttatttttggactttttacctttgtcttcaatgactgccccctttcctctatctgtaatgaatggaatgaaaaaagttgtagtttggatgtactgacctagtcaa

SEQ ID NO: 11718 - DNA, 199 bp, Homo sapiens
tgaatataattagtctcatttgaaatttagtagctgaacatatactgtattaattaacaatactggtcaggcacgttggctcatgcctgtcatcccagcacttgggaggccggggcaggaggatcagtcaagaccgggagtttgagactaacctgggcaacagagcaagaccctgtctctacaaaaaaaaaaaaaaaaa

SEQ ID NO: 11719 - DNA, 163 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctctgcaaaaaaaaaaaaaaaaaag

SEQ ID NO: 11720 - DNA, 195 bp, Homo sapiens
tgaatataattagtctcatttgaaatttagtagctgaacatatactttattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaa

SEQ ID NO: 11721 - DNA, 231 bp, Homo sapiens
  misc_feature 28: n=a, g, c or t
atgcagcgcgcggcgatggagttcaagnscagcctggccaacatggtgaaacctgtctctactaaaaatacaaaaattagctgggcgtggtggcgcacgctgtagtcccagctactcgggaggctgaagcagaagaattgcttgaacctgggaggcagaggttgcagtgagctgagatcatgccactgcactctagcctgggtgacagagtgagactgcgtctaagaaaaa

SEQ ID NO: 11722 - DNA, 172 bp, Homo sapiens
tcaagaaaaaaaatttttttttttttggaagaatttgaaagctgctgatcsagagtcattcctttaagaaaatgggccgggcatggtggstcacacctgtaatcctggmacttcgggaagccagggcagatggatsagttgagctcaggaatgtgagaccagcstgggcaat

SEQ ID NO: 11723 - DNA, 339 bp, Homo sapiens
tattttattataaatcaggacctttcgtggaactgtattgaaattaattatcctgggcctggcgcggtggctcatgcctgtaatcccagcgctttgggaggccaaggtgggcggatcatgaggtcaagagatcgagaccatcctggctagcacggtgaaaccccgtctctactaaaaaatacaaaaaaaattagctgggcatggtggtggtgcctgtggtcccggctactcgggaggctgaggcaggagaatggcgtgaacgtgagaggtggagcttgcagtgagctgagatcgcgctactgcattccagcctgggcaaacagcaagactctgtctcca

SEQ ID NO: 11724 - DNA, 171 bp, Homo sapiens
atcgaaaaattagctgggcgtggtgtgtgsstgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaaa

SEQ ID NO: 11725 - DNA, 343 bp, Homo sapiens
cttgttctatcacccaggctggtgtgcactggtatgttctcgctcactgcaaccactatctctcaggttcaagcgattctccttcctcagcctcctgagtagctgggattacaggsacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaraaaaaaaaaaa

SEQ ID NO: 11726 - DNA, 394 bp, Homo sapiens
gagacagagtcttgctctgtcgcccaggctgcagtgcggtggtgcaatctcggttcactgcaacctccgactcccaggctcaagcgattcttatgcctcagcctcccgagtggctgggattatgggcctgtgccaccattcatgggtagtttttctatttttagcagggacaggatttcgccatgtttgccaggctggtcttgaactcctgaccttaagtgatctgcctgcctgggcctcccaaagtgctgggattacaggcatgagccactgtgccaggcctattttattttatttatttatttttgagacaagatctcactctgttgctcaggctggagtgtagtggtgcgatcacagctcactgcagcctcaaatgcctgggcaacaagag

SEQ ID NO: 11727 - DNA, 358 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgstactcgggaggctgaaacaggagaatcacttgaacccaggagacggaggttgcggtgagttgagattatgccactgtactccagcctgggtgacagagcgagactcagtctcaaa

SEQ ID NO: 11728 - DNA, 200 bp, Homo sapiens; identical to SEQ ID NO: 11569

SEQ ID NO: 11729 - DNA, 278 bp, Homo sapiens
tgtctaggctgagcgtggtggctcacgcctgtactcctaccactttgggaggccaaggcaggcggatcatttgaggtcagaagttcgataccagcctgakscaacatgatgaaaccccgtstkvtactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaa

SEQ ID NO: 11730 - DNA, 303 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttatttgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaa

SEQ ID NO: 11731 - DNA, 126 bp, Homo sapiens
gatagattaaaaattttctgggctgggcgcggtggctcatgccggtaatcccagcactttgggaggccgaggcaggcggatcacaaggtcaggagatcgasaccatcctggctaacacggtgaaac

SEQ ID NO: 11732 - DNA, 142 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaaccctgtctc

SEQ ID NO: 11733 - DNA, 181 bp, Homo sapiens
gagacagagtcttgctctgtcgcccaggctgcagtgcggtggtgcaatctcggttcactgcaacctccgactcccaggctcaagcgattcttatgcctcagcctcccgagtggctgggattatgggcctgtgccaccattcatgggtagtttttctatttttagcaggggacaggatttcg

SEQ ID NO: 11734 - DNA, 311 bp, Homo sapiens
cgatgagagctcattgcagctttgaactcctgggcttaagcaatcctctcacctcagccttctgagtagctggactacaggsacctgccaccatgttcggctaattaaaaaaataacaaactctgttcgtaaagatggggtcttgctgtgttgctcaggctgctcttgaactccttgcctcaagtgagcctcccacctggacctgccaaattgctgggattataagcatgagccactgcgcccagccttactcacctttttgtatgasactatcagtctttctaaagtgcaaagmsaaagggttctgttat

SEQ ID NO: 11735 - DNA, 225 bp, Homo sapiens; identical to SEQ ID NO: 11617

SEQ ID NO: 11736 - DNA, 213 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaa

SEQ ID NO: 11737 - DNA, 525 bp, Homo sapiens
  misc_feature 355,357: n=a, g, c or t
actgctggatccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcgnmngctgctgctgctgctgtctccccagagtcccacccatgggctgcgaagctggccacccacactctgcatgccctcaccccacttctttgactacctagcagtgggtgatggacacagacatggggctgttagcgtctctctgtttattcgctcacaataatacacagc

SEQ ID NO: 11738 - DNA, 126 bp, Homo sapiens
ctttaggtgtattaagatataaggccargctgggsatrgtggctcatgcctgtaatcccagcactttgagtggctgaggtgggaggatcacttgagcccaggatttcaaggcgagcctgggacaca

SEQ ID NO: 11739 - DNA, 162 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaamcctgtctctgcaaaaaaaaaaaaaaaaa

SEQ ID NO: 11740 - DNA, 80 bp, Homo sapiens
atcgawaaattagctgggcgtggtgtgtgcctgtggttccagccacatkggaggctggcgcatccccatgcttgagccca

SEQ ID NO: 11741 - DNA, 109 bp, Homo sapiens
ctttaggtgtattaagatataaggccaggctgggcatggtggctcatgcctgtaatcccagcactttgagtggctgaggtgggaggatcacttgagcccaggatttcaa

SEQ ID NO: 11742 - DNA, 364 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaa

SEQ ID NO: 11743 - DNA, 110 bp, Homo sapiens
ttaggcccadaattacctgaacctgggacgtggaggttgcggtgagccaagatcgcaccactgtaccctagcctgggcaacagagtgactcttaaaaaaaaaaaaaaaaa

SEQ ID NO: 11744 - DNA, 98 bp, Homo sapiens
gtcagacaataaagtctttgtaaaaagagaaaaaaaaaaaaaaaaaaaaaaaaaaaaaaaaaaaaaaaaaaaaaaaaaaaaaaaaaaaaaaaaaaaaa

SEQ ID NO: 11745 - DNA, 171 bp, Homo sapiens
ctgtttcccaggctggagtgtagtgatacagtcacarctcactgtarcctcgaccttccaggctcaaaagatgstcccaccacagcctcccaggtagtgagtagctggtactacaggtgtgtgctgccacacccgactaatttttttgtagdbacggggtttcgctgttcc

SEQ ID NO: 11746 - DNA, 305 bp, Homo sapiens
gatagattaaaaattttctgggctgggcgcggtggctcatgccggtaatcccagcactttgggaggccgaggcaggskgatcacaaggtcaggagatcgagdbcatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaakatcgcaccactgcactccagcctgggcgacagagcgaggttccgtctcagaa

SEQ ID NO: 11747 - DNA, 565 bp, Homo sapiens
tctttttttttgattggggagggggagcaagaatactttgcaggtggtatgtggtatatactatcgtatggaggcacatgttagattgtgtcttcatgatgtgagcagtcattgatgatcattgcctagatccattaattcatttagagttgcaaataatgatattccaattctattcgtcccttcatttattagctgaggtacttctatgaaaggaaacttctcctattagttattagtaactttgaagtacagttcatctagtaaagccggataaatgtttgattcttggccaagcacagtggctcacacctgtaatcccagcactttgggaggccgaggcgggcggattgcctgaggtcaggagttcgagaccagcctggccaacatagtgaatccccgtctctattaaaaatacaaatttagtcgggtgtgatgatacacgcctgtagtcccatctacttgggaggctgaggcaggagaatcgcttgaacccgggaggtggaggttgcagtgagccaagatcgtaccactgcactccgcctgggtgagactacatctccaa

SEQ ID NO: 11748 - DNA, 187 bp, Homo sapiens; identical to SEQ ID NO: 11697

SEQ ID NO: 11749 - DNA, 253 bp, Homo sapiens
ccgaggtgggtgtatcacctgaggtcaggagtttgagaccagcctggacaacatggtaaaaccccgtctctgctaaaaatacaagagttagctgggcgtggtggcaggcacctgtggtcccagctactcgggaggctgaggcaggagaattgcttgagcccaggaggcagaggttgcagtgagccaagatcatgcccctgcactccagcctaggcgacagagctagactctgtctcaaaaaaaaaaaaaaaaa

SEQ ID NO: 11750 - DNA, 311 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcga

SEQ ID NO: 11751 - DNA, 293 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctg

SEQ ID NO: 11752 - DNA, 302 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaagactccatctcaaaaaaaaaaaaaaa

SEQ ID NO: 11753 - DNA, 84 bp, Homo sapiens
aaacctaacttgcgcagaaaacaagatgagattggcatggctttatttgttttttttgttttgttttggttttttttttttttt

SEQ ID NO: 11754 - DNA, 200 bp, Homo sapiens
tgaatataattagtctcatttgaaatttagtagctgaacatatactgtattaattaacaatactggtcaggcacgttggckcatgcctgtcatcccagcactttgggaggccggggcaggaggatcagtcaagaccgggagtttgagactaacctgggcaacagagcaagaccctgtctctacaaaaaaaaaaaaaaaaa

SEQ ID NO: 11755 - DNA, 302 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagctwgcagtgagcagagatagctgcactgcattccagcctgggtgacagagcgagactctgtctccaaaaaa

SEQ ID NO: 11756 - DNA, 129 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggt

SEQ ID NO: 11757 - DNA, 462 bp, Homo sapiens
gtgtgcgcggcacgagccccgaagttgcttaggagctggcgagccagtccctcaaaacgacttcgttcgaggttggcgcccgcctttttcagagagcacttcttagtgggtattccgtccggggccacttttctgaggccgaagacccctagtcagtgtgtgagacatagcctggccgagcctgggaaccacctggggctgagaggagaagagatagaaaataaggaagtcatcacccaggagctggaggattctgtccgcgtggtcttgggaaacttggacaatcttcagccctttgctacagaacacttcattggaaaccaataagtgacagtcctcttgggttggtcccagttgagaagaaagcagtaggagctgtgatgaggaaacgaaaacacatggacgagcccagctcccccagcaggccagggctggacagggccaagatagggacttccagcc

SEQ ID NO: 11758 - DNA, 130 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggt

SEQ ID NO: 11759 - DNA, 136 bp, Homo sapiens
ctaaaaattagccaggcctggtggcaggtgactgtaatgccagctactcgggagghtgaggtaagagaattgcttgaacctgggtggaagaagttgcagtgagccaagattgtgccactgcactcctgcctgggtg

SEQ ID NO: 11760 - DNA, 271 bp, Homo sapiens
ctagaaagtacagttggccaggcatggtggctcatgctgtaatccccacacttgaggaggccgggatgggtggattacttgagctcaggagtttcagaccagcctgggcaacatggtgaaacccatctctacaaaaratacagaaattagccagacatgatggcccacacctgtggtcccagctgcttgggaggctaaggtgagagggatcaacttgagcccaggagattgaggctgcagtgagctgagatcgcgcactgcaatccagcct

SEQ ID NO: 11761 - DNA, 136 bp, Homo sapiens
  misc_feature 81..83,91,114: n=a, g, c or t
gaacacttccatggattgtccttggacttagggcgccctgccgccttttgcagaggagaaaaaacttttttttttttttdnnnmccccganaattttccccccttctcctcccngcctctaaactccgatccccct

SEQ ID NO: 11762 - DNA, 200 bp, Homo sapiens; identical to SEQ ID NO: 11569

SEQ ID NO: 11763 - DNA, 309 bp, Homo sapiens
atatacaaatgtcggctgggcacggtggatcacacctgtaatcccagcactttgggaggccgaagcaggtggatcacgaggtcaggagattgagaccatcctggctaacacagtgaaaccccgtctctactaaaaacagaaaaaattagctgggcatggtggcacgtgcctgtaatcccagctacttgggaggctgaggcaggagaatcgtttgaacctgggaggtggaggttgcagtgagccgcgatgctgagatcacgccactgcactccagcctgggtgacagagcgagactccgtctccgaaaaa

SEQ ID NO: 11764 - DNA, 152 bp, Homo sapiens
  misc_feature 78,120: n=a, g, c or t
gttaaatattgtctaatcaggccgggcgcggtggctcacgtctgtggtcccggcactttgggagcctgaggcaggcgnatcatgaggtcaggagatcaagaccatcgtggcttacacggntgaaacccacgtctctactaaaaaaaaaaaaa

SEQ ID NO: 11765 - DNA, 196 bp, Homo sapiens
  misc_feature 10: n=a, g, c or t
tgaatataantctagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaa

SEQ ID NO: 11766 - DNA, 118 bp, Homo sapiens; identical to SEQ ID NO: 11594

SEQ ID NO: 11767 - DNA, 111 bp, Homo sapiens
ctttaggtgtattaagatataaggccaggctgggcatggtggctcatgcctgtaatcccagcactttgagtggctgaggtgggaggatcacttgagcccaggatttcaagg

SEQ ID NO: 11768 - DNA, 448 bp, Homo sapiens
tttgttcctagcaaccagcctgaggtctggaggtggtgcggagggagccgcctagggaccagggactcctgccaaatccgccggggtccctagaggccctggacccgaacgtggacgagcacttgtccacccagattctcgcgccctcggtccactccgacaactctcaggagcgcatccaggcccggcgcctccgcatcgctgcgcgcttagaagcccggagcggaagcacttggagaatatttagatgggaagaaggagagtgaggaggatcaaagcaagagctacaaacagaaagaagaaagccgattgaaattggctaaacttctgctctgtggcaccgagttggtgacaaatatccaggtggctatagatatcagagagattcacaggagagtcgaagaagaggagataaagcgtcaaaggagttararcaaaggatgaccag

SEQ ID NO: 11769 - DNA, 283 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgagacggcagaggttgtggtgagccaagatcatgacactgcaccccagcgtgggcaacaagagtgaaa

SEQ ID NO: 11770 - DNA, 340 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaaaaaaaaaa

SEQ ID NO: 11771 - DNA, 173 bp, Homo sapiens; identical to SEQ ID NO: 11575

SEQ ID NO: 11772 - DNA, 200 bp, Homo sapiens; identical to SEQ ID NO: 11569

SEQ ID NO: 11773 - DNA, 200 bp, Homo sapiens; identical to SEQ ID NO: 11569

SEQ ID NO: 11774 - DNA, 257 bp, Homo sapiens
gatagattaaaaattttctgggctgggcgcggtggctcatgccggtaatcccagcactttgggaggccgaggcaggcggatcacaaggtcaggagatcgagascatcctggctaacacggtgaaactcatctctactaaagatacaaaatattagtggtgtgtsgwrgsgggcgcctgtagtcccagctactcaggagcctgaggccaggagagtggcgtgaacccaggaggcagagctttcastgagccaagatcg

SEQ ID NO: 11775 - DNA, 174 bp, Homo sapiens; identical to SEQ ID NO: 11611

SEQ ID NO: 11776 - DNA, 296 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgctgtagtcccagctactcaggagcctgaggcaggagagtggcgtgaacccaggaggcagagctttcagtgagccaagatcgcaccactgcactccagcctgggcgacagagcgaggttccgt

SEQ ID NO: 11777 - DNA, 170 bp, Homo sapiens; identical to SEQ ID NO: 11644

SEQ ID NO: 11778 - DNA, 200 bp, Homo sapiens
tgaatataattagtctcatttgaaatttagtagctgaacatatactgtattaattaacaatactggtcaggcacgttggctcatgcctgtcatcccagcactttgggaggccgkggcaggaggatcagtcaagaccgggagtttgagactaacctgggcaacagagcaagaccctgtctctacaaaaaaaaaaaaaaaaa

SEQ ID NO: 11779 - DNA, 207 bp, Homo sapiens
atttccaatgctttctctgttcaggctgctgggtgacatttctatgtctccccttcaacggtgaaatatttcagtggttgtccatcacctatgggagtctgacatggcataatcaggccactggggcattgctagttgtgctgtccctgatattcaccgtggtaggcagtttctgaaatggctcccagtgatctccaactcctgaaa

SEQ ID NO: 11780 - DNA, 246 bp, Homo sapiens
atacaattagccaggtgtggcgcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaact

SEQ ID NO: 11781 - DNA, 110 bp, Homo sapiens
ctttaggtgtattaagatataaggccaggctgggcatggtggctcatgctgtaatcccagcactttgagtggctgaggtgggaggatcacttgagcccaggatttcaagg

SEQ ID NO: 11782 - DNA, 226 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaaaaaaaaaaaaaaa

SEQ ID NO: 11783 - DNA, 126 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactcc

SEQ ID NO: 11784 - DNA, 222 bp, Homo sapiens
gttaaatattgtctaatcaggccgggcgcggtggctcacgtctgtggtcccggcactttgggagcctgaggcaggcgatcatgaggtcaggagatcaagaccatcgtggcttacacggtgaaaccacgtctctactaaaaaaaaaaaaawtacaaaaaattcagccgggcatgatggcgggsacctgtagtccmagctatttcgggaggctgaggcgggaga

SEQ ID NO: 11785 - DNA, 200 bp, Homo sapiens; identical to SEQ ID NO: 11569

SEQ ID NO: 11786 - DNA, 162 bp, Homo sapiens
  misc_feature 105: n=a, g, c or t
tasaaaaaattagctgggcgtggtggcaggcgcctgtggtcccagctactcgggaggytgaggcaggagaatagtgtgaacccaggaggcggasttscagtgasncaagatagtgscactgcacttcagbctgggtgacagagtgagactctgtcacaaaaa

SEQ ID NO: 11787 - DNA, 254 bp, Homo sapiens
ccgaggtgggtgtatcacctgaggtcaggagtttgagayccagcctggacaacatggtaaaaccccgtctctgctaaaaatacaagagttagctgggcgtggtggcaggcacctgtggtcccagctactcgggaggctgaggcaggagaattgcttgagcccaggaggcagaggttgcagtgagccaagatcatgcccctgcactccagcctaggcgacagagctagactctgtctcaaaaaaaaaaaaaaaaa

SEQ ID NO: 11788 - DNA, 172 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctcaaaaaaaaaaaaaaaaaa

SEQ ID NO: 11789 - DNA, 186 bp, Homo sapiens
tgaatataattagtctcatttgaaatttagtagctgaacatatactgtattaattaacaatactggtcaggcacgttggsdcatgcctgtcatcccagcactttgggaggccggggcaggaggatcagtcaagaccgggagtttgagactaacctgggcaacagagcaagaccctgtctctacaaa

SEQ ID NO: 11790 - DNA, 479 bp, Homo sapiens
ttttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaatt

SEQ ID NO: 11791 - DNA, 316 bp, Homo sapiens; identical to SEQ ID NO: 11630

SEQ ID NO: 11792 - DNA, 133 bp, Homo sapiens
  misc_feature 78: n=a, g, c or t
gttaaatattgtctaatcaggcmgggcgcggtggctcacgtctgtggtcccggcactttgggagcctgaggcaggcgnatcatgaggtcaggagatcaagaccatcgtggcttacacggtgaaacccacgtct

SEQ ID NO: 11793 - DNA, 358 bp, Homo sapiens
  misc_feature 315: n=a, g, c or t
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaanccatgatctcactactgcactccagcctgggcaagagtaagac

SEQ ID NO: 11794 - DNA, 226 bp, Homo sapiens
atgcagcgcgcggcgatggagttcaagaccagcctggccaacatggtgaaacctgtctctactaaaaatacaaaaattagctgggcgtggtggcgcacgctgtagtcccagctactcgggaggctgaagcagaagaattgcttgaacctgggaggcagaggttgcagtgagctgagatcatgccactgcactctagcctgggtgacagagtgagactgcgtctaag

SEQ ID NO: 11795 - DNA, 192 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaa

SEQ ID NO: 11796 - DNA, 186 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaa

SEQ ID NO: 11797 - DNA, 90 bp, Homo sapiens
  misc_feature 19,35: n=a, g, c or t
ccttctccccggcggttantgctgagagtgcggantgtgtgctcsgggctcggaacacacatttattattaaaaratcsaaaaaaaaaaa

SEQ ID NO: 11798 - DNA, 298 bp, Homo sapiens
cagataaaagtctatgtcctggcgcatggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgasagagcgagactctrtctcaa

SEQ ID NO: 11799 - DNA, 106 bp, Homo sapiens
cgatgagagctcattgcagctttgaactcctgggcttaagcaatcctctcacctcagccttctgagtagctggactacaggcacctgccaccatgtttsggctaat

SEQ ID NO: 11800 - DNA, 118 bp, Homo sapiens; identical to SEQ ID NO: 11692

SEQ ID NO: 11801 - DNA, 224 bp, Homo sapiens
cataagaatttataaacttgaaatagaaatattctattgtaaaggttaagaaaagtatacttggttggccaccgaggctcactaccattcccagtacttcgggaggcagggtggaaggattgctcgagcccagaaggtggaggctgcagtgagccatgatcatgccactgcactccaacctgggtaacagagggagaccttgtctgaaaaaaaaaaaaaaaaaa

SEQ ID NO: 11802 - DNA, 197 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaa

SEQ ID NO: 11803 - DNA, 213 bp, Homo sapiens; identical to SEQ ID NO: 11736

SEQ ID NO: 11804 - DNA, 226 bp, Homo sapiens; identical to SEQ ID NO: 11782

SEQ ID NO: 11805 - DNA, 340 bp, Homo sapiens
ataatacataagatatggtattgtgtgcctgggctcttagacctagcatagtattttcaaggttaatgtgtagcatgagtcactacttcattcctttctgtgtctgagtaacattccattgtatggatatgccacattattcattcatcatttatggacattgggttatcagaattactttagagtaaaactgatgcttgaagaagtgtcagcaatggtcaggcgccaggggcccatgcctgtaatccaagcattttggaggccaacatgggaggatcacttgagcccaggagtcaagaccagcttgggcaacagtgcaagaccctgtatctacccaaaa

SEQ ID NO: 11806 - DNA, 345 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaaaaaaaaaaaaagg

SEQ ID NO: 11807 - DNA, 243 bp, Homo sapiens
atgcagcgcgcggcgatggagttcaagaccagcctggccaacatggtgaaacctgtctctactaaaaatacaaaaattagctgggcgtggtggcgcacgctgtagccccagctactcgggaggctgaagcagaagaattgcttgaacctgggaggcagaggttgcagtgagctgagatcatgccactgcactctagcctgggtgacagagtgagactgcgtctaagaaaaaaaaaaaaaaaaa

SEQ ID NO: 11808 - DNA, 171 bp, Homo sapiens
  misc_feature 154: n=a, g, c or t
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctnaaaaaaaaaaaaaaaaa

SEQ ID NO: 11809 - DNA, 207 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagat

SEQ ID NO: 11810 - DNA, 126 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacaca

SEQ ID NO: 11811 - DNA, 235 bp, Homo sapiens
aaggggatttgggggaggcttaaggtagaaacaaaagatctcagttttgccatccaaatcaacccatggccagatcagatttagggtaaattgatttaatggtcaggaatgcatttggtggccagtcttccagggggcccatgaaagttcagggtgagttgtatgatgattgttttatagtagaaataaatgattgataatacctgctttcaactccaaaaaaaaaaaaaaaaag

SEQ ID NO: 11812 - DNA, 121 bp, Homo sapiens
ctttaggtgtattaagatataaggccaggctgggcatggtggctcatgcctgtaatcccagcactttgagtggctgaggtgggaggatcacttgagcccaggrtttcaaggcgagcctggg

SEQ ID NO: 11813 - DNA, 172 bp, Homo sapiens; identical to SEQ ID NO: 11523

SEQ ID NO: 11814 - DNA, 331 bp, Homo sapiens
taaatgatatcgtttggatgtttgtaccctccaaatctcatgttgaaatgtgatcttcaatcttggaggtggagcctaatgggaaatgtttggattatgggggcagatcctttataaatggattggtgccttcccagcagtaaatgtgagtgagttctagctctcctacttcatgcaacagctggttgtttaaagagcttggcaccccctcttctctctcttgatcactctcttcaccttgtgacacccctgctctccttttgccttctaccaccattgtaagcttcctgaggccctcatcagaagcagatgctggtgccatgcctttttt

SEQ ID NO: 11815 - DNA, 117 bp, Homo sapiens
ctttaggtgtattaagatataaggccaggctgggcatggtggctcatgctgtaatcccagcactttgagtggctgaggtgggaggatcacttgagcccaggatttcaaggcgagcct

SEQ ID NO: 11816 - DNA, 213 bp, Homo sapiens; identical to SEQ ID NO: 11736

SEQ ID NO: 11817 - DNA, 79 bp, Homo sapiens
gamcacttccatggattgtcsttggacttagggcgcsctgsscgcsttttgcagacgagaaaaaacttttttttttttt

SEQ ID NO: 11818 - DNA, 187 bp, Homo sapiens; identical to SEQ ID NO: 11697

SEQ ID NO: 11819 - DNA, 53 bp, Homo sapiens
gtcagacaataaagtctttgtaaaaagagaaaaaaaaaaaaaaaaaaaaaaaa

SEQ ID NO: 11820 - DNA, 241 bp, Homo sapiens
ccgaggtgggtgtatcacctgaggtcaggagtttgagaccagcctggacaacatggtaaaaccccgtctctgctaaaaatacaagagttagctgggcgtggtggcaggcacctgtggtcccagctactcgggaggctgaggcaggagaattgcttgagcccaggaggcagaggttgcagtgagccaagatcatgcccctgcactccagcctaggcgacagagctagactctgtctcaaaaa

SEQ ID NO: 11821 - DNA, 122 bp, Homo sapiens
  misc_feature 2: n=a, g, c or t
anagaagaaaagatatataggkggctcacgcctgtaatcccaaagtgctgggattacaggtgtgagcactgcgsctggcccccatcacataattttaactcttaagtaggctgggaagttaa

SEQ ID NO: 11822 - DNA, 460 bp, Homo sapiens
ggatgtcacaatgacttggctggaggtgtcctgaagtctcttgtttgtccagggcctttgctgcagcttatatgttcactagtaatctggcctgtgcctaccttttaatcccagctggaaaatctcagtaagaatgatgataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatgg

SEQ ID NO: 11823 - DNA, 173 bp, Homo sapiens
ctaaaaattagccaggcctggtggcaggtgactgtaatgccagctactcgggaggctgaggtaagagaattgcttgaacctgggtggaagaagttgcagtgagccaagattgtkccactgcactcctgcctgggtgatagagtgacactccttctcaaaaaaaaaaaaaaaaa

SEQ ID NO: 11824 - DNA, 201 bp, Homo sapiens
tgaatataattagtctcatttgaaatttagtagctgaacatatactgtattaattaacaatactggtcaggcacgttggskcatgcctgtcatcccagcactttgggaggccggggcaggaggatcagtcaagaccgggagtttgagactaacctgggcaacagagcaagaccctgtctctacaaaaaaaaaaaaaaaaaa

SEQ ID NO: 11825 - DNA, 200 bp, Homo sapiens; identical to SEQ ID NO: 11569

SEQ ID NO: 11826 - DNA, 490 bp, Homo sapiens
gactgacaactcacacggctgggtactcttctgagacaaaacttccagaggagcgatcaggcagcaacatttgctgttcaccaatatccattgttctgcagcctctgctgctgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaagaagttaaaaaccttgaaaaa

SEQ ID NO: 11827 - DNA, 305 bp, Homo sapiens
gatagattaaaaattttctgggctgggcgcggtggctcatgccggtaatcccagcactttgggaggccgaggcaggckgatcacaaggtcaggagatcgagdbcatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctsggcgacagagcgaggttccgtctcaaaa

SEQ ID NO: 11828 - DNA, 371 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcttgtaatccctgctactcgggaggctgaaacaggagaatcacttgaacccaggagacggaggttgcggtgagttgagattatgccactgtactccagcctgggtgacagagcgagactcagtctcaaaaaaaaaaaaaaaa

SEQ ID NO: 11829 - DNA, 336 bp, Homo sapiens; identical to SEQ ID NO: 11642

SEQ ID NO: 11830 - DNA, 225 bp, Homo sapiens; identical to SEQ ID NO: 11617

SEQ ID NO: 11831 - DNA, 306 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgcctgtagtcccagctactcaggagcctgaggcaggagagtggcgtgaacccaggaggcagagctttcamtgagccaagatcgsaccactgcactccagcctgggcgacagagcgaggttccgtctcaaaaaa

SEQ ID NO: 11832 - DNA, 142 bp, Homo sapiens
  misc_feature 62: n=a, g, c or t
ctttaggtgtattaagatataaggccaggctgggcatggtggctcatgcctgtaatcccagnactttgagtggctgaggtgggaggatcacttgagcccaggatttcaaggcgagcctgggacacatggtgaaacctgtctc

SEQ ID NO: 11833 - DNA, 492 bp, Homo sapiens
ttctcatcagggctgcccataggaggtctcatcatttccagcagaggaaagaaacttgaagaaagaatggatttaagtaattgcctccaggcagtcttctctctctcctccctctctttaaaaaaaatcatgggatcatgtaatttttcagcataaataatggcaataatggttggaggacaagctgtttctagaatgaaggtcaagttagctgaggcctagaaagactacattccagctgtatgggacagtgaaaggactttgctggtgcagaaactttatcaactagtgggaatctcttctgaaagcacctactcagtctgagtaccactatgagtacacggcgtgtgacagcacgggttccaggtggagggtcgccgtgccgcataccccgggcctgtgcaccagcctgcctgaccccgtcaaggcaccgagtgctccttctcctgcaacgccggggagtttctggatatgaaggaccagtcatgtaag

SEQ ID NO: 11834 - DNA, 225 bp, Homo sapiens; identical to SEQ ID NO: 11617

SEQ ID NO: 11835 - DNA, 200 bp, Homo sapiens; identical to SEQ ID NO: 11569

SEQ ID NO: 11836 - DNA, 377 bp, Homo sapiens
  misc_feature 184: n=a, g, c or t
ttagatagctgtattatagtgagtcctctgggactgtttggttcttttggtatgatggtatttttgttatgtcaaatactgtctgaaaaaattataagaaaatatgtgttctttttggccgggtgcggtggcttaccgctgtaatctcagcactttggaaggccgtggcgggtgagtcacctgnggtcagaagttcaagccagcctggccaacatggtgaaacccatctctagtaaaaataaaaaaaattagtctggcatggtagtgcgtgcctgtagtcccagctactttgtaggctgaggcaggagaattgcttgaacctgggaggcggagggtgcaatgaattgagattgcgccactgcactccagcctaggcg

SEQ ID NO: 11837 - DNA, 303 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaacaagagtgaaacttcgtctccaaaaaaaaaaa

SEQ ID NO: 11838 - DNA, 156 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcactttcagcctgggtgacagagtgagactctgtc

SEQ ID NO: 11839 - DNA, 181 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctct

SEQ ID NO: 11840 - DNA, 213 bp, Homo sapiens; identical to SEQ ID NO: 11736

SEQ ID NO: 11841 - DNA, 82 bp, Homo sapiens; identical to SEQ ID NO: 11689

SEQ ID NO: 11842 - DNA, 120 bp, Homo sapiens
ctttaggtgtattaagatataaggccaggctgggcatggtggctcatgctgtaatcccagcactttgagtggctgaggtgggaggatcacttgagcccaggatttcaaggcgagcctggg

SEQ ID NO: 11843 - DNA, 507 bp, Homo sapiens
  misc_feature 367,436,478,484,489,503,505: n=a, g, c or t
ttctcatcagggctgcccataggaggtctcatcatttccagcagaggaaagaracttkaagaaagaatggatttragtaattgcctccaggcagtcttctctctctcctccctctctttaaaaaaaatcatgggatcatgtaatttttcagcataaataattggcaataatggttggaggacaagctgtttctagaatgaaggtcaagttagctgaggcctagaaagactacattccagctgtatgggacagtkaaaggactttgctggtgcagaaactttatcaactagtgggaatctcttctgaaagcacctactcagtctgagtaccactatgagtacacggcgtgtgacagcacgggttccangtggagggtcgccgtgccgcataccccgggcctgtgcaccagcctgcctgaccccgtcaaggcaccgantgctccttctcctgcaacgccggggagtttctggatatkaangaccantcatntaagccatgcgctnangg

SEQ ID NO: 11844 - DNA, 200 bp, Homo sapiens; identical to SEQ ID NO: 11569

SEQ ID NO: 11845 - DNA, 158 bp, Homo sapiens
ctttaggtgtattaagatataaggccaggstgggcatggtggctcatgctgtaatcccagcactttgagtggctgaggtgggaggatcacttgagcccaggatttcaaggcgagcctgggacacatggtgaaacctgtctctgcaaaaaaaaaaaaaa

SEQ ID NO: 11846 - DNA, 200 bp, Homo sapiens; identical to SEQ ID NO: 11569

SEQ ID NO: 11847 - DNA, 190 bp, Homo sapiens
tgaatataattagtctcatttgaaatttagtagctgaacatatactgtattaattaacaatactggtcaggcacgttggstcatgcctgtcatcccagcactttgggaggccggggcaggaggatcagtcaagaccgggagtttgagactaacctgggcaacagagcaagaccctgtctctacaaaaaaa

SEQ ID NO: 11848 - DNA, 166 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaa

SEQ ID NO: 11849 - DNA, 364 bp, Homo sapiens
  misc_feature 16,284,315..316: n=a, g, c or t
aaggatgtcaaaatgndaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcscagctacttgggaggctgaggtgggaraattncttgagcccaggagtctgaaactgcggtaanncatgatctcactactgcactccagcctgggcaagagtaagaccctgta

SEQ ID NO: 11850 - DNA, 213 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcycagaaggtggaggctgcagtgagccatgatcatgccactgcactccaacctgggtaacagagggagaccttgtctgaaaaa

SEQ ID NO: 11851 - DNA, 246 bp, Homo sapiens
  misc_feature 111: n=a, g, c or t
ccgaggtgggtgtatcacctgaggtcaggagtttgagaccagcctggacaacatggtaaaaccccgtctctgctaaaaatacaagagttagctgggcgtggtggcaggcanctgtggtcccagctactcgggaggctgaggcaggagaattgcttgagcccaggaggcagaggttgcagtgagccaagatcatgcccctgcactccagcctaggcgacagagctagactctgtctcaaaaaaaaaa

SEQ ID NO: 11852 - DNA, 314 bp, Homo sapiens; identical to SEQ ID NO: 11579

SEQ ID NO: 11853 - DNA, 200 bp, Homo sapiens; identical to SEQ ID NO: 11569

SEQ ID NO: 11854 - DNA, 373 bp, Homo sapiens
agttcaactatgcaagtcagtcacaacagtggactaaatcaatgcacgagagcccaaatctcaccaacagactgtgttttgataggggaagcacagcccccaggtgttctaaatcctggacttggtgttatcatctcatctgtcgattggattgatgcatgagagtcacaattccaacttgattgcctcttggtaggagagtcatttttgttcctgtgatctggttacagaaattggtcaacatccctcctgtggctcaatccacatgtgaccgacatgatccaactgtggactgtatctgtcagtgagattcaggaactattttgctctctccctatataaaggtgacaattttaacagtcaaaaaaaaaaa

SEQ ID NO: 11855 - DNA, 345 bp, Homo sapiens
  misc_feature 335: n=a, g, c or t
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacttcagccttccaaagtgctgagattacagtcctgagccactgctttcggccttacagaattgttttgttttggggcattcagaagtctgacataaaaattaacttgaaaaaraanaaaaaaaagg

SEQ ID NO: 11856 - DNA, 187 bp, Homo sapiens; identical to SEQ ID NO: 11697

SEQ ID NO: 11857 - DNA, 148 bp, Homo sapiens; identical to SEQ ID NO: 11566

SEQ ID NO: 11858 - DNA, 200 bp, Homo sapiens; identical to SEQ ID NO: 11569

SEQ ID NO: 11859 - DNA, 128 bp, Homo sapiens
ttaggcccaagaattacctgaacctgggacgtggaggttgcggtgagccaagatcgcaccactgtaccctagcctgggcaacagagtgactcttaaaaaaaaaaaaaaaaamaaaaaaaaaaaaaaaa

SEQ ID NO: 11860 - DNA, 174 bp, Homo sapiens; identical to SEQ ID NO: 11671

SEQ ID NO: 11861 - DNA, 99 bp, Homo sapiens
  misc_feature 28: n=a, g, c or t
atgcagcgcgcggcgatggagttcaagnbcagcctggccaacatggtgaaacctgtctvtadbtaaaaatasaaaaattagctgggcgtggtggcgcac

SEQ ID NO: 11862 - DNA, 344 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaaaaaaaaaaaaaa

SEQ ID NO: 11863 - DNA, 164 bp, Homo sapiens
taaaaggaagttcttggccgggcgcggtggctcatgcctgtaatcccagcactttgggaggccgaggtgggtggatcacgagatcaggagatcgagaccatcttggctaacacggtgaaacccatctctactaaaaatacaacaaatyggctgggcgcggtagc

SEQ ID NO: 11864 - DNA, 82 bp, Homo sapiens; identical to SEQ ID NO: 11689

SEQ ID NO: 11865 - DNA, 200 bp, Homo sapiens; identical to SEQ ID NO: 11569

SEQ ID NO: 11866 - DNA, 141 bp, Homo sapiens
ctttaggtgtattaagatataaggccaggctgggcatggtggctcatgctgtaatcccagcactttgagtggctkaggtgggaggatcacttgagcccaggatttcaaggcgagcctgggacacatggtgaaacctgtctc

SEQ ID NO: 11867 - DNA, 304 bp, Homo sapiens
  misc_feature 252,270,284: n=a, g, c or t
aaggatgtcaaaatgahwatggtaccataaatagccaacgttgattaaaattaaacatgattactttaacaaaaagaaacttaaggccaggtatggtgggtcatgcctgtaatcctagcactttgkgaggctgaagtggaaggatcacttgagcccaggagttcaagaccagcctggagaacacagagagacccccaccatctcttccaaaaataaaaactagccaggcatggtggctcaggcctgtagtcnmagctacttgggaggctnaggtgggagaattnttgagcccaggagtctgaaa

SEQ ID NO: 11868 - DNA, 96 bp, Homo sapiens
  misc_feature 75: n=a, g, c or t
ctttaggtgtattaagatataaggccaggctgggcatggtggctcatgctgtaatcccagcactttgagtggctnaggtgggaggatcacttgags

SEQ ID NO: 11869 - DNA, 170 bp, Homo sapiens; identical to SEQ ID NO: 11644

SEQ ID NO: 11870 - DNA, 158 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaatatggtgaaacgtgtctctacgaaaaaaaaaaaaaaaaaag

SEQ ID NO: 11871 - DNA, 336 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaaaaaa

SEQ ID NO: 11872 - DNA, 57 bp, Homo sapiens
tgtkwtattttcttaaaatcaskcttttatgctttakgaactggttggtctccastt

SEQ ID NO: 11873 - DNA, 366 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatc

SEQ ID NO: 11874 - DNA, 79 bp, Homo sapiens
ctttttcgcaacgggtttgccgccagaacacaggtgtcgtgaaaactcacccctcaaaagccaaaaaaaaaaaaaaaaa

SEQ ID NO: 11875 - DNA, 381 bp, Homo sapiens
  misc_feature 318: n=a, g, c or t
acagagcaaaaatctgtctaaaaaaaaaaaagaagagactggcacatccatacaatggatgagccaactgttaaaaaaaaaagawtgaggggctgggcgtggtggctcacacctgtaatcccaggastttgggaggccgaggcgggcggatcatgaggtcaggagatcgagaccttcctggctaasacggtgaamcctgtctctactaaaaatacacacacacacaaaawttagctgggtgtggtggcaagcacctgtattcccagctactcgggaggctgaggcaggagaatggtgtgaaccaggaggtggagcttnsagtgasctgagatcgcgcmactgcactccagcctgggtgacagagcgagactccatctcaaa

SEQ ID NO: 11876 - DNA, 59 bp, Homo sapiens
gtcagacaataaagtctttgtaaaaagagaaaaaaaaaaaaaaaaaaaaaaaaaaaaaa

SEQ ID NO: 11877 - DNA, 279 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccagtaggcagagctttcagtgagccaagatcgcaccactgcactccagcctggg

SEQ ID NO: 11878 - DNA, 174 bp, Homo sapiens; identical to SEQ ID NO: 11611

SEQ ID NO: 11879 - DNA, 318 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaa

SEQ ID NO: 11880 - DNA, 360 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgaagcccaggagttcgagaccagcctgggcaacatggcgaaaaccctgtctaacaaaaaaaatacaaaagttagccaggagtggtggcacaagctgtagtccctgctgctagggagactgtagtgggaggatcacttcagcctgggagaccaaggctgcagtgagtcatgagtgtgcccattgcaccccagtgtggggccacagagcgagaccttgtctccaaaaaaa

SEQ ID NO: 11881 - DNA, 306 bp, Homo sapiens
cacgagactccatctttaaaaaaaaacaagacgggccggcacgtggctcacgcctgtaatcccagcactgagaggccgatcacttgaggtcaggagttcgggaccagcctggccggcatggtggaacccatctctactgaaaaatacaaaaattagccgggcatggtggcacacacctgtaatcgtagctggggcaggagaatcgcctgaacccgggaggcggascttgcagcgagccgagatcgtgccgctgcactccagcctgggcgacagagtgagactccatctcaaaaaaaaaaaaaaaaa

SEQ ID NO: 11882 - DNA, 188 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaa

SEQ ID NO: 11883 - DNA, 121 bp, Homo sapiens
ttaatataattagtctcatttgaaatttagtagctgaacatatactgtattaattaacaatactggtcaggcacgttggctcatgcctgtcatcccagcactttgggaggccggggcagga

SEQ ID NO: 11884 - DNA, 547 bp, Homo sapiens
tatgctattttattttaatgggtcatattccactaatgtcatttattttgatgttcatactgtctcaggtttgcctggtgggacctctttaagctggcttctgtgtcttttgacctatcatttcagagaagcatttctctacttctgacacaacagtataatctaggctcatcttgttttattcctgctgtagttctgaaatcaccatttctctgagtaaccttgatttctttttggtgagaataatatttagaagccaaagtgggtgctaggtgtgggttattgctactctcagtcagcatggctaggaaatgtgtgtttgtgtgtgtgtgtattcctacggagatacatatttctataaattcacatctattgtttctatatctatgtagaaaactgtgggccaggcgcgatggcttatgcctgtaatcctagcattttgggaggccgaagccagcgggatgacttgaggtccagagttcgaaaccagcctagctaatgaaaccctgtctctactaaaaatacaaaaaaaaaaaaaaaaaagctt

SEQ ID NO: 11885 - DNA, 117 bp, Homo sapiens
  misc_feature 33: n=a, g, c or t
tgtctaggctgagcgtggtggctcacgcctgtnctcctaccactttgggaggccaaggcaggcggatcatttgaggtcagargtkcgataccagcctgascaacatgatgaracccc

SEQ ID NO: 11886 - DNA, 209 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctga

SEQ ID NO: 11887 - DNA, 69 bp, Homo sapiens
gtcagacaataaagtctttgtaaaaagagaaaaaaaaaaaaaaaaaaaaaaaaaaaaaaaaaaaaaaaa

SEQ ID NO: 11888 - DNA, 82 bp, Homo sapiens; identical to SEQ ID NO: 11689

SEQ ID NO: 11889 - DNA, 290 bp, Homo sapiens
aaaaagtccctgggaagcggccgggcgcgtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcggga

SEQ ID NO: 11890 - DNA, 281 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgsactccagcctgggcga

SEQ ID NO: 11891 - DNA, 111 bp, Homo sapiens
ctttaggtgtattaagatataaggccaggctgggcatggtggctcatgctgtaatcccagcactttgagtggctgaggtgggaggatcacttgagcccaggatttcaaggc

SEQ ID NO: 11892 - DNA, 98 bp, Homo sapiens
  misc_feature 18..19: n=a, g, c or t
ccccttctccccggcggnnagtgctgagagtgcggagtgtgtgctccgggctcggaacacacatttattattaaaaaatccaaaaaaaaaaaaaaaaa

SEQ ID NO: 11893 - DNA, 97 bp, Homo sapiens
cccttctccccggcggttvgtgctgagagtgcggagtgtgtgctccgggctcggaacacacatttattattaaaaaatccaaaaaaaaaaaaaaaaa

SEQ ID NO: 11894 - DNA, 99 bp, Homo sapiens
cccttctccscggcggtkvgtgctgagagtgcggagtgtgtgctccgggctcggaacacacatttattattaaaaaatccaaaaaaaaaaaaaaaaarg

SEQ ID NO: 11895 - DNA, 483 bp, Homo sapiens
cagagagcaagagcgtcgctccccctcgccttctcggccgccctcccggtttaccgccccctgtgtccagagatcacagatggagagacattttgccacacgatgaatcacacaccacatctcatccccgagcttcagctgcaggacaatgctgccagaggcctggtcctcagagctcacgatcttatcaaatttaatgggcacatctgaagaaggaaacttgctcagcaccgtgagccccacagtgaaagcactttttggcaagactagagtctcaccgattttccctttctctcctcgatctcctttccagcctcttattccccggactcctggctcaccctggggccccgtgggtccagcttctcccttgggaccaggctttccaatagggcccatggggcgkttaamcmrktkggsccmaargscaatgttgccccttggcccctcaggaccagtgggacccacgtcacccttattccc

SEQ ID NO: 11896 - DNA, 314 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaawawaaaaa

SEQ ID NO: 11897 - DNA, 163 bp, Homo sapiens
ctttaggtgtattaagatataaggctaggctgggcatggtggctcatgcctgtaatcccagcactttgagtggctgaggtgggaggatcacttgagcccaggatttcaaggcgagcctgggacacatggtgaaaccctgtctctgcaaaaaaaaaaaaaaaaa

SEQ ID NO: 11898 - DNA, 143 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaaccctgtctc

SEQ ID NO: 11899 - DNA, 471 bp, Homo sapiens
gactgacaactcatacggctgggtactcttctgagacaaaacttccagaggagcgatcaggcagcaacatttgctgttcaccaatatccattgttctgcagcctctgctgctgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaaag

SEQ ID NO: 11900 - DNA, 118 bp, Homo sapiens
  misc_feature 13,78: n=a, g, c or t
gttaaatattgtntaatcaggccgggcgcggtggctcacgtctgtggtcccggcactttgggagcctgaggcaggcgnatcatgaggtcaggagatcaagaccatcgtggcttacacg

SEQ ID NO: 11901 - DNA, 314 bp, Homo sapiens
atttttggattttctttaaaaatgcacattccaggctgggcgcagtggctcacgtgtgtaatcccagtactttgggaggctgagggcggatcacaaagccaggagttcaagaccaacctgggcaatatggtgaaacccatctctactaaaaatataaaaagttagccaggtatggtggcacaagcctgtagtcccagccacttgggaggctgaggcagaagaatcacttgaacccgggaggcggaggttgcagtgagccgagatcgtgccactgcactcaagcctaggcaacagagtaagactctgtctcgaaa

SEQ ID NO: 11902 - DNA, 200 bp, Homo sapiens; identical to SEQ ID NO: 11569

SEQ ID NO: 11903 - DNA, 101 bp, Homo sapiens
  misc_feature 19: n=a, g, c or t
ccccttctccccggcggtnagtgctgagagtgcggagtgtgtgctccgggctcggaacacacatttattattaaaaaatccacaaaaaaaaaaaaaaaagc

SEQ ID NO: 11904 - DNA, 207 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtct

SEQ ID NO: 11905 - DNA, 200 bp, Homo sapiens; identical to SEQ ID NO: 11569

SEQ ID NO: 11906 - DNA, 322 bp, Homo sapiens
acaatggtacaggcatcatcacgctgcacaatggtttccagkcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctcaagcccctaggaattgaggggtgaggacaaaaaaaaaaaaaaaa

SEQ ID NO: 11907 - DNA, 317 bp, Homo sapiens
  misc_feature 316: n=a, g, c or t
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaagaaaaaaaaaang

SEQ ID NO: 11908 - DNA, 296 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtct

SEQ ID NO: 11909 - DNA, 67 bp, Homo sapiens
aaaaaaaaaaaaaaaaaaaaaaaaaaaaaaaaaaaaaaaaaaaaaaaaaaaaaaaaaaaaaaaaaaa

SEQ ID NO: 11910 - DNA, 174 bp, Homo sapiens; identical to SEQ ID NO: 11611

SEQ ID NO: 11911 - DNA, 253 bp, Homo sapiens; identical to SEQ ID NO: 11749

SEQ ID NO: 11912 - DNA, 68 bp, Homo sapiens; identical to SEQ ID NO: 11613

SEQ ID NO: 11913 - DNA, 80 bp, Homo sapiens
ctttttcgcaacgggtttgccgccagaacacaggtgtcgtgaaaactacccctaaaagccaaaaaaaaaaaaaaaaargy

SEQ ID NO: 11914 - DNA, 306 bp, Homo sapiens
aaaaagtccctgggaagcggccgggcgcggttggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaa

SEQ ID NO: 11915 - DNA, 173 bp, Homo sapiens; identical to SEQ ID NO: 11575

SEQ ID NO: 11916 - DNA, 487 bp, Homo sapiens
actcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatgagcaactctaggctaaatctgagccggggagaggaacacagaacaggggtcaggttagagataagaggaaacattggcactgcagtcaaataggctagtgtgagaaacaccaacagcaggcccatctcagatcttcactatggcaacttatgcaagaaac

SEQ ID NO: 11917 - DNA, 298 bp, Homo sapiens
  misc_feature 18..19: n=a, g, c or t
cacgagactccatctttnnaaaaaaacaagacgggccggcacgtggctcacgcctgtaatcccagcactgagaggccgatcacttgaggtcaggagttcgggaccagcctggccggcatggtggaacccatctctactgaaaaatacaaaaattagccgggcatggtggcacacacctgtaatcgtagctggggcaggagaatcgcctgaacccgggaggcggacttgcagcgagccgagatcgtgccgctgcactccagcctgggcgacagagtgagactccatctcaaaaaaaaaa

SEQ ID NO: 11918 - DNA, 353 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaa

SEQ ID NO: 11919 - DNA, 200 bp, Homo sapiens; identical to SEQ ID NO: 11569

SEQ ID NO: 11920 - DNA, 162 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaaccctgtctctgcaaaaaaaaaaaaaaaaa

SEQ ID NO: 11921 - DNA, 123 bp, Homo sapiens
ctttaggtgtattaagatataaggccaggctgggcatggtggctcatgctgtaatcccagcactttgagtggctgaggtgggaggatcacttgagcccaggatttsaaggcgagcctgggaca

SEQ ID NO: 11922 - DNA, 209 bp, Homo sapiens
ataatvcataasatatggtattgtgtgcctgggctcttagacctagcatagtattttcaaggttaatgtgtagcatgagtcactacttcattcctttctgtgtctgagtaacattccattgtatggatatgccacattattcattcatcatttatggacattrggttatcagaattactttagagtaaaactgatgswtgaagaagtgt

SEQ ID NO: 11923 - DNA, 155 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactcctgcctgggtgatagagtgacactccttct

SEQ ID NO: 11924 - DNA, 172 bp, Homo sapiens
  misc_feature 154: n=a, g, c or t
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctnaaaaaaaaaaaaaaaaaa

SEQ ID NO: 11925 - DNA, 172 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaaccctgtctctgcaaaaaaaaaaaaaaaaaagytatatc

SEQ ID NO: 11926 - DNA, 171 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaaa

SEQ ID NO: 11927 - DNA, 509 bp, Homo sapiens
taacgcgccagaacctcggcccgggcgccctcgtcggccgcggaggagctgcagcctccaacaggaaggtgtggtccctgccatgctatctgctctgctcagcgactgaaggtgcccgcatcccagctctgccaggaagcaaaggtaagggcactgctcagcactaaagccctggatagtgttcagggcatcccctcatccctggagccctgatgaagggggcacgtcttcccctctgtkattgccaagaacagtcctaagatggagtgagatggatcagttgggcagtgtgatggaatgttgtttaccttgcatgttcagagccgtttacaacagagaagcttcctgaaacttggacttagctaagacctggctggtctcatagcacaggggagacttcacaggtgatgttctggggacattacagagtgtcccgaagatagaggcctttcagagaggaccagggccatagtcagcactgaagagctggatagcagtcttggctcagt

SEQ ID NO: 11928 - DNA, 100 bp, Homo sapiens
  misc_feature 18..19,35..36: n=a, g, c or t
cccttctccccggcggtnngtgctgagagtgcggnnhvtgtgctccgggctcggaacacacatttattattaaaaaatccaaaaaaaaaaaaaaaaaagc

SEQ ID NO: 11929 - DNA, 307 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaa

SEQ ID NO: 11930 - DNA, 298 bp, Homo sapiens
  misc_feature 18..19,123: n=a, g, c or t
caaaaactagccaggcanngctgggcgcggtggctcacgcctgtaatcccagcactttgggaggccgakgcgggcggatctcgaggtcaggagattgagaccatcccggctaacacggtgaancccgtctctactaaaaatacaaaaaaaattakctgggcgtggtggcaggtgcctgtggtcccagctactcgggaggctgaggcagaagaatggcgtgaacttgggaggtggagcttacagtgagccgagatcacaccactgcactccagcctgggggacagagcgagactccgtc

SEQ ID NO: 11931 - DNA, 201 bp, Homo sapiens
  misc_feature 81: n=a, g, c or t
tgaatataattagtctcatttgaaatttagtagctgaacatatactgtattaattaacaatactggtcaggcacgttggcncatgcctgtcatcccagcactttgggaggccggggcaggaggatcagtcaagaccgggagtttgagactaacctgggcaacagagcaagaccctgtctctacaaaaaaaaaaaaaaaaaa

SEQ ID NO: 11932 - DNA, 316 bp, Homo sapiens
cagataaaagtctatgtsvtggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaaaaagg

SEQ ID NO: 11933 - DNA, 225 bp, Homo sapiens
  misc_feature 132: n=a, g, c or t
cataagaatttataaacttgaaatagaaatattctattgtaaaggttaagaaaagtatacttggttggccaccgaggctcactaccataatcccagtacttcgggaggcagggtggaaggattgctcgagcncagaaggtggaggctgcagtgagccatgatcatgccactgcactccaacctgggtaacagagggagaccttgtctgaaaaaaaaaaaaaaaaa

SEQ ID NO: 11934 - DNA, 125 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacac

SEQ ID NO: 11935 - DNA, 314 bp, Homo sapiens
taaaaggaagttcttggccgggcgcggtggctcatgcctgtaatcccagcactttgggaggccgaggtgggtggatcacgagatcaggagatcgagaccatcttggctaacacggtgaaaccccatctctactaaaaatacaacaaattggctgggcgcggtggcgggtgcctgtagtcccagctgctcgggaggctgaggcaggagaatggcctgaacccaggaggcggascttgcagtgagctgagatagtgccactgcactccggcctggtgaaagagcgagactccgtctcaaaaaaaaaaaaaaaaagg

SEQ ID NO: 11936 - DNA, 225 bp, Homo sapiens; identical to SEQ ID NO: 11617

SEQ ID NO: 11937 - DNA, 226 bp, Homo sapiens; identical to SEQ ID NO: 11782

SEQ ID NO: 11938 - DNA, 201 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaaaaa

SEQ ID NO: 11939 - DNA, 303 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcactgtgatctcagctactcgggaggctgaggcaggagaatcacttgaacccaggaggcagaggttgcagtgagccaagatcacaccactgcactccagcctgggcgacaaagcaagactccatctcaaaaaaaaaaaaaaaaa

SEQ ID NO: 11940 - DNA, 198 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaa

SEQ ID NO: 11941 - DNA, 343 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaaaaaaaaaaaaa

SEQ ID NO: 11942 - DNA, 143 bp, Homo sapiens; identical to SEQ ID NO: 11898

SEQ ID NO: 11943 - DNA, 292 bp, Homo sapiens
  misc_feature 152,291: n=a, g, c or t
tcattaaaatggagagtgaagcaaggggattgctaacattggaaacagataagactttttgggtcataaatttaaaaaccatgaaaatcatcttagcttaatttataacactgtagttaaaacatatgtattccctctctcttgaataaganagcaggggtgctacactcaaacctgctttctgcccccatcacaaataatttattcctcacttaccatattgtatctgaactatttttcttgcctgactctgccagcaggatatatgtaccaaaataaaattaataaaanc

SEQ ID NO: 11944 - DNA, 82 bp, Homo sapiens; identical to SEQ ID NO: 11689

SEQ ID NO: 11945 - DNA, 173 bp, Homo sapiens; identical to SEQ ID NO: 11575

SEQ ID NO: 11946 - DNA, 200 bp, Homo sapiens
tgaatataattagtctcatttgaaatttagtagctgaacatatactgtattaattaacaatactggtcaggcacgttggctcatgcctgtcatcccagcactttgggaggccggggcakgaggatcagtcaagaccgggagtttgagactaacctgggcaacagagcaagaccctgtctctacaaaaaaaaaaaaaaaaa

SEQ ID NO: 11947 - DNA, 343 bp, Homo sapiens; identical to SEQ ID NO: 11941

SEQ ID NO: 11948 - DNA, 113 bp, Homo sapiens
ctttaggtgtattaagatataaggccaggctgggcatggtggctcatgcctgtaatcccagcactttgagtggctgaggtgggaggatcacttgagcccaggatttcaaggcg

SEQ ID NO: 11949 - DNA, 82 bp, Homo sapiens; identical to SEQ ID NO: 11689

SEQ ID NO: 11950 - DNA, 137 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaacatggtgaamcgtgtctcta

SEQ ID NO: 11951 - DNA, 301 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcargagaatggtgtgaacctgggaggtggagcttkcagtgarcagagatarctgcactgcattccagccttggtkacagagcgagamtctgtctccaaaaa

SEQ ID NO: 11952 - DNA, 136 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacc

SEQ ID NO: 11953 - DNA, 108 bp, Homo sapiens
ctttaggtgtattaagatataaggccaggctgggcatggtggctcatgcctgtaatcccagcactttgagtggctgaggtgggaggatcacttgagcccaggatttca

SEQ ID NO: 11954 - DNA, 165 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacctgtctctgcaaaaaaaaaaaaaaaaaagc

SEQ ID NO: 11955 - DNA, 119 bp, Homo sapiens
  misc_feature 31: n=a, g, c or t
gtgtgttaagaaatgagctgtaggctcatknhgcagtggctcatgcctgtaatcccagcactttgggaggctgaggtgggcggatcatgaggtaaggagttcgagagcagcctggccaa

SEQ ID NO: 11956 - DNA, 479 bp, Homo sapiens
gactgacaactcacacggctgggtactcttctgagacaaaacttccagaggagcgatcaggcagcaacatttgctgttcaccaatatccattgttctgcagcctctgctgctgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaaagaagttaaa

SEQ ID NO: 11957 - DNA, 152 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaacatggtgaaaccgtgtctctacgaaaaaaaaaaaa

SEQ ID NO: 11958 - DNA, 78 bp, Homo sapiens
  misc_feature 33: n=a, g, c or t
tsaattagtttttgacragttaataaaacaganaaatgaaaagacatasaaagtcsaagtcaaaactttttatcgtta

SEQ ID NO: 11959 - DNA, 273 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaaca

SEQ ID NO: 11960 - DNA, 200 bp, Homo sapiens; identical to SEQ ID NO: 11569

SEQ ID NO: 11961 - DNA, 235 bp, Homo sapiens
attaagatcagcctgggtaatacagtgagaccccatctctagaaaaaataaaaaattagtcaaatgtggtgttagtcccagctacgtgggggactagtagtccagctacttgggagggggagatgggaggattgcttgagcctgggaagcgaaggttgcagtaagatgagatcgtgccgctgcactccagcctgggtgacagagtgagactctgtctcttaggaaaaaaaaaaaa

SEQ ID NO: 11962 - DNA, 118 bp, Homo sapiens; identical to SEQ ID NO: 11692

SEQ ID NO: 11963 - DNA, 173 bp, Homo sapiens; identical to SEQ ID NO: 11575

SEQ ID NO: 11964 - DNA, 108 bp, Homo sapiens
ctttaggtgtattaagatataaggccaggctgggcatggtggctcatgctgtaatcccagcactttgagtggctgaggtgggaggatcacttgagcccaggatttcaa

SEQ ID NO: 11965 - DNA, 200 bp, Homo sapiens; identical to SEQ ID NO: 11569

SEQ ID NO: 11966 - DNA, 174 bp, Homo sapiens
tttaaaaaataaataagtaaataaaattgagcctcattttttaamctaattgaaaatgggtgataaaaatgtatacattgsgaccaggtgcggtggctmacacttgtaatcscagcamtttgggaggmmaaggcaggtggatmammtgaggtcaggagttmaagaccagcmtgg

SEQ ID NO: 11967 - DNA, 61 bp, Homo sapiens
aaaaaaaaaaaaaaaaaaaaaaaaaaaaaaaaaaaaaaaaaaaaaaaaaaaaaattttttt

SEQ ID NO: 11968 - DNA, 312 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagatcgcttgggcccaggagatgtaggttgcagtgagttgttatcacaccactgcactcctgcctgggtgacagagcaagagcctgtcgccaaaaaaaaaaaaaaaaag

SEQ ID NO: 11969 - DNA, 314 bp, Homo sapiens
taaaaggaagttcttggccgggcgcggtggctcatgcctgtaatcccagcactttgggaggccgaggtgggtggatcacgagatcaggagatcgagaccatcttggctaacacggtgaaaccccatctctactaaaaatacaacaaattggctgggcgcggtggcgggtgcctgtagtcccagctgctcgggaggctgaggcaggagaatggcctgaacccaggaggcggasttgcagtgagctgagatagtgccactgcactccggcctggtgaaagagcgagactccgtctcaaaaaaaaaaaaaaraasgs

SEQ ID NO: 11970 - DNA, 57 bp, Homo sapiens
aaaaaaaaaaaaaaaaaaaaaaaaaaaaaaaaaaaaaaaaaaaaaaaaaaaaaaaaa

SEQ ID NO: 11971 - DNA, 312 bp, Homo sapiens; identical to SEQ ID NO: 11535

SEQ ID NO: 11972 - DNA, 110 bp, Homo sapiens
tgaatataattagtctcatttgaaatttagtagctgaacatatactgtattaattaacaatactggtcaggcacgttggctcatgcctgtcatcccagcactttgggagg

SEQ ID NO: 11973 - DNA, 316 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaaaaagg

SEQ ID NO: 11974 - DNA, 78 bp, Homo sapiens; identical to SEQ ID NO: 11631

SEQ ID NO: 11975 - DNA, 89 bp, Homo sapiens
tatattgtttcccaagaagttctacttggtttcatttcaaacctgcctggtttttttgtttgtttgtttttatttttgttttgagacga

SEQ ID NO: 11976 - DNA, 314 bp, Homo sapiens; identical to SEQ ID NO: 11579

SEQ ID NO: 11977 - DNA, 437 bp, Homo sapiens
taagacgctcgggcggcgggacccagggaaggcagcggccggagcgcgcaaggcgagtgggacccggggctgggtaggggttcaagtctggttcggggatcgagtgtgcaccccctccacacacacctactaccctaccccccgcctccaaccctgggacacgacctcgctggtctcaacgagccgctgcctccaactccaccttctgtgcccaaactttccagacttggagtgtctgtccccgcgtccctgccccctcctcgtctttgaccccatacccccatcgattcctcccagtaccccccatcgattcctcgtgccctgcccgtttctcctgtcttggctcccctctgcccgctctcccctgtctctgtcccactttctgcctctgktcctccccggctctgccctctycccgcactgkcccccctcgccct

SEQ ID NO: 11978 - DNA, 106 bp, Homo sapiens
ctttaggtgtattaagatataaggccaggctgggcatggtggctcatgcctgtaatcccagcactttgagtggctgaggtgggaggatcacttgagcccaggattt

SEQ ID NO: 11979 - DNA, 201 bp, Homo sapiens; identical to SEQ ID NO: 11938

SEQ ID NO: 11980 - DNA, 132 bp, Homo sapiens
ctttaggtgtattaagatataaggcctggctgggcatggtggctcatgctgtaatcccagcactttgagtggctgaggtgggaggatcacttgagcccaggatttcaaggcgagcctgggacacatggtgaa

SEQ ID NO: 11981 - DNA, 350 bp, Homo sapiens
ttgtttaagggtggagggcagatcctggtacaccccccacagaggacgactttggatagcagccacagctaaaaaaccctcccctcaagaagtctcagaactccaggctacatatcgtcttcttcgtgggaaaggtaactgccgcatattctcctttcaattttactttatggagagaagtcattgacgttcatcttctttcacttccttctttctttggctttttctttgttaaaagagacttttaatctttgtatatgtttgtttgtttagtggtaaatcattgacagcgttcaaagcattaatctgtcaaaacagtgcaaataaaaatatcaatttccaacacaaaa

SEQ ID NO: 11982 - DNA, 311 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgcctgtagtcccagctactcaggagcctgaggcaggagagtggcgtgaacccagtaggcagagctttcagtgagccaagatcgcaccactgcactccagcctgggcgacagagcgaggttccgtctcaaaaaacaaaa

SEQ ID NO: 11983 - DNA, 371 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaaaaa

SEQ ID NO: 11984 - DNA, 331 bp, Homo sapiens
taaatgatatcgtttggatgtttgtaccctccaaatctcatgttgaaatgtgatcttcaatcttggaggtggagcctaatgggaaatgtttggatcatgggggcagatcctttataaatggattggtgccttcccagcagtaaatgtgagtgagttctagctctcctacttcatgcaacagctggttgtttaaagagcttggcaccccctcttststctcttgatcastctcttcaccttgtgacacccctggctvtccttttgccttctaccacsattgtaagcttcctgaggccctcatcagaagcagatgctggtgccatgccttttt

SEQ ID NO: 11985 - DNA, 200 bp, Homo sapiens; identical to SEQ ID NO: 11569

SEQ ID NO: 11986 - DNA, 173 bp, Homo sapiens; identical to SEQ ID NO: 11575

SEQ ID NO: 11987 - DNA, 110 bp, Homo sapiens; identical to SEQ ID NO: 11654

SEQ ID NO: 11988 - DNA, 112 bp, Homo sapiens; identical to SEQ ID NO: 11643

SEQ ID NO: 11989 - DNA, 311 bp, Homo sapiens
  misc_feature 274: n=a, g, c or t
tatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcantgctccctctgccccgcccccaaaaaaaaaaaaaaaa

SEQ ID NO: 11990 - DNA, 108 bp, Homo sapiens
gttaaatattgtctaatcaggccgggcgcggtggctcacgtctgtggtcccggcactttgggagcctgaggcaggcgatcatgaggtcaggagatcaagaccatcgtg

SEQ ID NO: 11991 - DNA, 79 bp, Homo sapiens
gaacacttccatggattgtccttggacttagggcgccctgccgccttttgcagaggagaaaaaactttttttttttttt

SEQ ID NO: 11992 - DNA, 358 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagac

SEQ ID NO: 11993 - DNA, 118 bp, Homo sapiens
ctttaggtgtattaagatataaggccaggctgggcatggtggctcatgctgtaatcccagcactttgagtggctgaggtgggaggatcacttgagcccaggatttcaaggcgagcctg

SEQ ID NO: 11994 - DNA, 265 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctaggggagactgtagtgggaggatc

SEQ ID NO: 11995 - DNA, 102 bp, Homo sapiens
  misc_feature 100: n=a, g, c or t
ccccttstccccggcggttagtgkytgagagtgcggagtgtgtgctccgggctcggaacacacatttattattaaaaaatccaaaaaaaaaaaaaaaaangc

SEQ ID NO: 11996 - DNA, 163 bp, Homo sapiens; identical to SEQ ID NO: 11668

SEQ ID NO: 11997 - DNA, 121 bp, Homo sapiens
gaattgtgaggctsagggtgggcacggtggctcacacctgtaatcccagcactttgggaggccgaggcgggtggatcacctgaggtcgggagtttgagaccagcctgactaacatggagaa

SEQ ID NO: 11998 - DNA, 330 bp, Homo sapiens
atggtttattttctgagcaaggagtcatcatgggagaccttttttccttattttgggaggtagatcctcccccaatacctgtaaattgagccattccaaatcaggattatgaatgctggaaggatgactcttgtggaaccatagggagcttcctgctttggtattttgttatcgtatttgtcctgatgttcttctctagggcttctgtctgggtaggatatctttttttcattttaaataatatgtttactgtacactaggaaaatttccataaaatacatttactatactttgatgaaaaaaaaaaaaaaaaaaaaaaaaaaaaaaarr

SEQ ID NO: 11999 - DNA, 291 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggctgtagtcccagctacttgggaggctgaaggtgggaagaaattgccttg

SEQ ID NO: 12000 - DNA, 226 bp, Homo sapiens
  misc_feature 35,60,86,120: n=a, g, c or t
cataagdatttataaacttgaaatagaaatattcnattgtaaaggttaagaaaagtatanttggttggccaccgaggctcastacnataatcccagtwhttcgggaggcagggtggaagnattgctcgagcccagaaggtggaggctgcagtgagccatgatcatgccactgcactccaacctgggtaacagagggagavcttgtctgaaaaaaaaaaaaaaaaaa

SEQ ID NO: 12001 - DNA, 99 bp, Homo sapiens
ctttaggtgtattaagatataaggccaggctgggcatggtggctcatgcctgtaatcccagcactttgagtggctgaggtgggaggatcacttgagccc

SEQ ID NO: 12002 - DNA, 200 bp, Homo sapiens
tgaatataattagtctcatttgaaatttagtagctgaacatatactgtattaattaacaatactggtcaggcacgttggctcatgcctgtcatcccagcactttgggaggcctrgggcaggaggatcagtcaagaccgggagtttgagactaacctgggcaacagagcaagaccctgtctctacaaaaaaaaaaaaaaaa

SEQ ID NO: 12003 - DNA, 250 bp, Homo sapiens
aaaaggagaagactgatgttttaggtagggagttcgagaccagcctgaccaacatggagcaaccccatctctactaaaaatataattagccgggcgtggtggggcatgcttgtagtcccagctactcaggaggctgaggcaggagaatcacctgaacccaggagacagaggttgcagtgagccgagatcgccattgtactccagcctgggcaacaagaatgaaactccgtctcaaaaaaaaaaaaaaaaa

SEQ ID NO: 12004 - DNA, 314 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttatttgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaaaaa

SEQ ID NO: 12005 - DNA, 68 bp, Homo sapiens; identical to SEQ ID NO: 11613

SEQ ID NO: 12006 - DNA, 69 bp, Homo sapiens
ataaaaaaaaaaaaaaaaaaaaaaaaaaaaaaaaaaaaaaaaaaaaaaaaaaaaaaaaaaaaaaaaaaa

SEQ ID NO: 12007 - DNA, 103 bp, Homo sapiens
gtgtgttaagaaatgagctgtaggctcagtgcagtggctcatgcctgtaatcccagcactttgggaggctgaggtgggcggatcatgaggtaaggagttcgag

SEQ ID NO: 12008 - DNA, 303 bp, Homo sapiens
atggtttattttctgagcaaggagtcatcatgggagaccttttttccttattttgggaggtagatcctcccccaatacctgtaaattgagccattccaaatcaggattatgaatgctggaaggatgactcttgtggaaccatagggagcttcctgctttggtattttgttatcgtatttgtcctgatgttcttctctagggcttctgtctgggtaggatatctttktktcattttaaataatatgtttactgtacactaggaaaatttccataaaatacatttactatactttgatgaaaaaa

SEQ ID NO: 12009 - DNA, 321 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaaaaaaaaaaaaaargtc

SEQ ID NO: 12010 - DNA, 173 bp, Homo sapiens; identical to SEQ ID NO: 11638

SEQ ID NO: 12011 - DNA, 170 bp, Homo sapiens; identical to SEQ ID NO: 11644

SEQ ID NO: 12012 - DNA, 200 bp, Homo sapiens; identical to SEQ ID NO: 11569

SEQ ID NO: 12013 - DNA, 181 bp, Homo sapiens; identical to SEQ ID NO: 11839

SEQ ID NO: 12014 - DNA, 200 bp, Homo sapiens; identical to SEQ ID NO: 11569

SEQ ID NO: 12015 - DNA, 82 bp, Homo sapiens; identical to SEQ ID NO: 11689

SEQ ID NO: 12016 - DNA, 433 bp, Homo sapiens
ttaaaataatacttagaggctgggtgaggtgctcacgcctgtaaccccagcactttgggaggccagggcgggtggatcacctgaggtcaggagttcaagaccagcctgaccagcatggtgaaaccccgtctttactaaaagtaccgagattaggccaggcgtggtgggtcacgcctgtaatctcagcactttcggaggccgaggtgggcggatcatctgaggtcaggagttcgagaccatcctgaccggcatggcggaaccctgcctctactaaaaatacaaaaaaaattagtccgttgtggtggcagatgcctgtagtcccggctactcgggaagctaaggcaggagaatcgcttgaaccgaggaggcggaggttgcagtgagccgaaatcacgccactacactccagcctgggcgacaagagcaaaactcc

SEQ ID NO: 12017 - DNA, 306 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaa

SEQ ID NO: 12018 - DNA, 326 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaaaaaaaaaaaaag

SEQ ID NO: 12019 - DNA, 180 bp, Homo sapiens
catcaacagaacagttaccttgccatccagagccctggctttcacataattatgtgcctttgctatttccctgtgacagtggtaattgaaacccactgctgtgtcagccctggttgtgagcttcatttcacgttccaatctgcaccaaccaggtaaacattgcaggctgggcgcggtggc

SEQ ID NO: 12020 - DNA, 516 bp, Homo sapiens
cctgattagaagctctgattgatagacagttccttatgtctttgatgaataaaaaaatgggaaatctaaatatatatggcctgttgcacagttaaaagctcatcaaagcctgaactcagccatgcatggtagctcacgcctgtaactccagcactttgcagggccaaggtgggaggatagcttgagcccaggagttcaagaccagcctggacaacatggtgaaaccccatttccacaaaaaatacaaaacctagccagccatggtggcatgcacctgtagtgtcagctactcagaaggctgaggtgggagaatcacttgagtccgggaagtcaaggctgcagtgagccatgattgtaccactgcactccagtctgggcaacagagggagagcttgtctcaaaacaaaaacaaacccccaaatcacaaaatacccctgagctccatgggataaaataattttacaagtgcactcggtgatgaactatccatggtcactgagctaaaaggtcacagca

SEQ ID NO: 12021 - DNA, 293 bp, Homo sapiens
tttaaagatgttgccatttttrgctgggcacagtggctcacacctgtaatcccagcactttgggaggccgaggtgggcagctcgcttgagtcaggagtttgagaccagcctggccaatatggtgaaaccctgtctctactaaaaaatacaaaaattagctgggcatggtggcatgtgcctgtaatcccagctactcgggaggctgaggcaggagaattgcttgaacccaggaagcagaggctgcagtgagccaagatcataccactgcactccagcctaggtgacagagcgag

SEQ ID NO: 12022 - DNA, 161 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacctgtctctgcaaaaaaaaaaaaaaaa

SEQ ID NO: 12023 - DNA, 200 bp, Homo sapiens; identical to SEQ ID NO: 11569

SEQ ID NO: 12024 - DNA, 316 bp, Homo sapiens
catataacctttaaaaaataccatacatatttatgaatgcwatrtaaawccagctataggagtacggctggcgtggtggctcatgcctgcaatctcagcactttgggaggcagaggcgggcggatcactcgaggtcaggagttcaggaccagcctggccaacatggtgaaacctgtctctactggggatacaaaaagtagctgggcatggtggccgcacgcctgtaatcccagctacttgggaggctgaggcaggagaatcgcttgaaccccggagcggaggttgcggtgagcggagattgcgccactgcactccg

SEQ ID NO: 12025 - DNA, 110 bp, Homo sapiens
tgtttaaaaagagaatatccaaattttctaatttttatttttgtgctacagtgaataaaataaaaaaaaaaaaaaaaaaaaaaaaaaaaaaaaaaaaaaaaaaaaaaaaa

SEQ ID NO: 12026 - DNA, 326 bp, Homo sapiens
  misc_feature 16: n=a, g, c or t
aatggtagagacaggntttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggcagggtgagaatccatctc

SEQ ID NO: 12027 - DNA, 142 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaamcctgtctc

SEQ ID NO: 12028 - DNA, 126 bp, Homo sapiens
  misc_feature 64: n=a, g, c or t
ctttaggtgtattaagatataaggccaggctgggcatggtggctcatgcctgtaatcccagcantttgagtggctgaggtgggaggatcacttgagcccaggatttcaaggcgagcctgggacaca

SEQ ID NO: 12029 - DNA, 219 bp, Homo sapiens
cataagaatttataaacttgaaatagaaatattctattgtaaaggttaagaaaagtatacttggttggccaccgaggctcattaccataatcccagtacttcgggaggcagggtggaaggattgctcgagcccagaaggtggaggctgcagtgagccatgatcatgccactgcactccaacctgggttagagggagaccttgtctgaaaaaaaaaaaaa

SEQ ID NO: 12030 - DNA, 294 bp, Homo sapiens
  misc_feature 16: n=a, g, c or t
aatggtagagacaggntttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtgggcggttgcagtgagcccagatcacgcaaatgtcactgtac

SEQ ID NO: 12031 - DNA, 355 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccagaaa

SEQ ID NO: 12032 - DNA, 335 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtccaaaaaaaaaaaaaaaa

SEQ ID NO: 12033 - DNA, 315 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaaaaag

SEQ ID NO: 12034 - DNA, 484 bp, Homo sapiens
tgaaggttatcagtttttgtgtatgtagagggcctagggtggccagtagtttggaggagtgacttaattaaataactacttacagtataccctttatataattaacaatctttcagcgtgtttaaagtaaatatttgcagtgagggaaccaaggaagactgcatgtagagtcctaagccaagacttgaagaaatataggatttaagttggtagaaaggaatgggggctgggcacggtggcttatgcctgtaatcccagcactttggggggcctaggggggcagatcacttgaggtcagaagttcaagaccagcctggccaatatggtgaamcctgtctctactaaaaatacaaaaaaatcagccggggatggtggtgcatgtctgtaattccagctactcaggaggctaaggcacgagatttgcttgaaccctggcaagaatcgcttgaacccgggaggcaaaggttgcagtgagcaagatcac

SEQ ID NO: 12035 - DNA, 187 bp, Homo sapiens
tgaatataattagtctcatttgawatttagtagctgaacatatactgtattaattaacaatactggtcaggcacgttggctcatgcctgtsatcccagcactttgggaggccggggcaggaggatcagtcaagaccgggagtttgagactaacctgggcaacagagcaagaccctgtctctacaaaa

SEQ ID NO: 12036 - DNA, 189 bp, Homo sapiens
  misc_feature 150: n=a, g, c or t
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagacnaacctgggcaacagagcaagaccctgtctctacaaaaaa

SEQ ID NO: 12037 - DNA, 77 bp, Homo sapiens
gaacacttccatggattgtccttggacttagggcgccctgccgccttttgcagaggagaaaaaactttttttttttt

SEQ ID NO: 12038 - DNA, 144 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctg

SEQ ID NO: 12039 - DNA, 292 bp, Homo sapiens
gcctaggtgttgtcgtccctgctagtactccgggctgtgggggtcggtgcggatattcagtcatgaaatcagggtagggacttctcccgcagcgacgcgctggcaagactgtttgtgttgcgggggccggacttcaaggtgattttacaacgaggtgctgctcccatctgccgccccccttctctcctgcaattggtttgtactcactgggctgtgctctcccctgtttacccgatgtatggaaataaaggcccttttcctcctgaaaaaaaaaaaaaaaaaaaaaaaaaaa

SEQ ID NO: 12040 - DNA, 220 bp, Homo sapiens
gttaaatattgtctaatcaggccgggcgcggtggctcacgtctgtggtcccggcactttgggagcctgaggcaggcgatcatgaggtcaggagatcaagaccatcgtggcttacacggtgaamccacgtctctactaaaaaaaaaaaaawtacaaaaawtcagccgggcatgatggsgggcacctgtagtcccagctattcgggaggstgaggcgggaga

SEQ ID NO: 12041 - DNA, 294 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggsgtggtggctcatgcctgtaatctcagctactcgggaggctgagacaggagaattgcttgaacccgggaggcggaggttgcagtgacccgagatctcgccaccgcactccagcctgggcgacagagcgggactc

SEQ ID NO: 12042 - DNA, 125 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactc

SEQ ID NO: 12043 - DNA, 129 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatgg

SEQ ID NO: 12044 - DNA, 200 bp, Homo sapiens; identical to SEQ ID NO: 11569

SEQ ID NO: 12045 - DNA, 120 bp, Homo sapiens
ctttaggtgtattaagatataaggccaggctgggcatggtggctcatgcctgtaatcccagcactttgagtggctgaggtgggaggatcacttgagcccaggatttcaaggcgagcctgg

SEQ ID NO: 12046 - DNA, 344 bp, Homo sapiens
  misc_feature 309: n=a, g, c or t
tagattataaaatgactatgtttaataaaattttaaaaataaaagagggagagaatgggctcaaaaaaagaaataaaaggctgggcatggtggctcgcacctgtggtcccagcactttggaaggccgagacgggcggatcatgaggtcaggagatcgagaccatcctggccaaaatggtgaaacccgtcattgctaaaggtacagaaattagttgggtgtggtggcatgcacctgtagtccaggctgctcgggaggctgaggcgggagagtcgcatgaacccgggaggcagggttgcagtgagccgggntcgcgtcactgcactccagcctggatgacagagcg

SEQ ID NO: 12047 - DNA, 173 bp, Homo sapiens; identical to SEQ ID NO: 11575

SEQ ID NO: 12048 - DNA, 78 bp, Homo sapiens; identical to SEQ ID NO: 11631

SEQ ID NO: 12049 - DNA, 154 bp, Homo sapiens
tkaatataattagtctcakttgaratytagtagctgaacatatactgtattaatkaasaatactggtcaggcacgttggctcatgcctgtcatcccagcactttgggaggccggggcakgmggatcagtcaagaccgggagtttgagactaacc

SEQ ID NO: 12050 - DNA, 292 bp, Homo sapiens; identical to SEQ ID NO: 12039

SEQ ID NO: 12051 - DNA, 163 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacccgtgtctctgcaaaaaaaaaaaaaaaa

SEQ ID NO: 12052 - DNA, 166 bp, Homo sapiens; identical to SEQ ID NO: 11622

SEQ ID NO: 12053 - DNA, 145 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaacatggtgaaaccgtgtctctacgaaaaa

SEQ ID NO: 12054 - DNA, 263 bp, Homo sapiens
atttttggattttctttaaaaatgcacattccaggctgggcgcagtggctcacgtgtgtaatcccagtactttgggaggctgagggcggatcacaaagccaggagttcaagaccaacctgggcaatatggtgaaaccccatctctactaaaaatataaaaagttagccaggtatggtggcacaagcctgtagtcccagccacttgggaggctgaggcagaagaatcacttgaacccgggaggcggaggttgcagtgagccgag

SEQ ID NO: 12055 - DNA, 313 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaaaaaaaaa

SEQ ID NO: 12056 - DNA, 221 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttg

SEQ ID NO: 12057 - DNA, 194 bp, Homo sapiens; identical to SEQ ID NO: 11684

SEQ ID NO: 12058 - DNA, 175 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcacttcagcctgggtgacagagtgagactctgtcacaaaaaaaaaaaaaaaaag

SEQ ID NO: 12059 - DNA, 333 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcstggstaatttttgtatttttaatagagactgggtttcacsatgttggccatgctggtcttgaacttctggcctcaagtgatctgcccacctcagccttccaaagtgctgagattacagtcctgagccactgstttcggccttacagaattgttttgttttggggcattcagaagtctgacataaaaattaacttgaaaaaaa

SEQ ID NO: 12060 - DNA, 199 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaaa

SEQ ID NO: 12061 - DNA, 287 bp, Homo sapiens
gcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgaggtgctgctcccatctgccgccccccttctctcctgcaattggtttgtactcactgggctgtgctctcccctgtttacccgatgtatggaaataaaggcccttttcctcctgaaaaaaaaaaaaaaaaaaaaa

SEQ ID NO: 12062 - DNA, 419 bp, Homo sapiens
ttaaaataatacttagaggctgggtgaggtgctcacgcctgtaaccccagcactttgggaggccagggcgggtggatcacctgaggtcaggagttcaagaccagcctgaccagcatggtgaaaccccgtctttactaaaagtaccgagattaggccaggcgtggtgggtcacgcctgtaatctcagcactttcggaggccgaggtgggcggatcatctgaggtcaggagttcgagaccatcctgaccggcatggcggaaccctgcctctactaaaaatacaaaaaaaattagtccgttgtggtggcagatgcctgtagtcccggctactcgggaagctaaggcaggagaatcgctkgaaccgaggaggcggaggttgcagtgagccgaaatcacgccactacactccagcctgggcgac

SEQ ID NO: 12063 - DNA, 447 bp, Homo sapiens
aaattgtaattaatatgcattgtatgccagtaatacctgcccccaaaccctataaatcattaatagaatttttattactctattttaatctactaattagcccatgttttccataatatttttgttcaaccctggggagaaaggataaatagtaaaattcttggcaaattttcaaatatgtaattgtgacatacaatagatagcattgattttccgctccaaaaaatgagttctgctgctttataattttgaatgcatctagaaacaagaaatttcttttgagggcttaaagtgaactctagatgaatacagaaaaaattttttctattggaatcaagtatcttaaacgtggcgatcatacaaccttcttctaaggtaacacttaagagcgttttgggagattttggtgctagctctatgactaggtttagaaargtcaaataagct

SEQ ID NO: 12064 - DNA, 306 bp, Homo sapiens
cacgagactccatctttaaaaaaaaacaagacgggccggcacgtggctcacgcctgtaatcccagcactgagaggccgatcacttgaggtcaggagttcgggaccagcctggccggcatggtggaaccccatctctactgaaaaatacaaaaattagccgggcatggtggcacacacctgtaatcgtagctggggcaggagaatcgcctgaacccgggaggcggasttgcagcgagccgagatcgtgccgctgcactccagcctgggcgacagagtgagactccatctcaaaaaaaaaaaaaaaaa

SEQ ID NO: 12065 - DNA, 200 bp, Homo sapiens; identical to SEQ ID NO: 11569

SEQ ID NO: 12066 - DNA, 117 bp, Homo sapiens
ctttaggtgtattaagatataaggccaggctgggcatggtggctcatgcctgtaatcccagcactttgagtggctgaggtgggaggatcacttgagcccaggatttcaaggcgagcc

SEQ ID NO: 12067 - DNA, 383 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaacccaaaaaaaaaaaaaaaaa

SEQ ID NO: 12068 - DNA, 173 bp, Homo sapiens; identical to SEQ ID NO: 11575

SEQ ID NO: 12069 - DNA, 114 bp, Homo sapiens
ctttaggtgtattaagatataaggccaggctgggcatggtggctcatgctgtaatcccagcactttgagtggctgaggtgggaggatcacttgagcccaggatttcaacggcga

SEQ ID NO: 12070 - DNA, 161 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctctgcaaaaaaaaaaaaaaaaa

SEQ ID NO: 12071 - DNA, 452 bp, Homo sapiens
acggctcttctcccggtccctgaaactcggctgccaggggagctggagccacctgcgaaggtgtcctcccatactggacccctacaggaagctccgtgtgcccagctggggcacagccccagtgatgccccagaggggcacccatcgcaagaggggctttgggctctgcctccctccccatggcgcatgggccaaagcctgagactgaaggactgttggacctcagcttcctaacagaggaggagcaggaggccattgctggcgtcctccaacgagatgcccgcctgcgccactggaggaggggcgggtcagcaagctccgggcctcagtggcagaccctgggcagctgaagatcctgacaggggactggttccaggaagcacgctcccagcggcaccacaatgcccacttcggctctgaccttgtycgagcgtctatgcgcaggaagaaga

SEQ ID NO: 12072 - DNA, 412 bp, Homo sapiens
agcccggcgttcccggccgggagcgacccggagtccccagccccgcgtcccagctgccgccagcgccagttttggattcggcggattaggaaagaggagggaggggggagagagcgcgaagagggaggggaccgaagctggagggtcccgagtccagcgccgtgttggcgtagagaaactttccctctcggcctcggagacggcgccccggccgtgccgaagtggagatcgccaggctcggaggaaccggcagctctccacgcccctgcccgaagcctgacccgactgcctctctcagtgagttatttatgattccatctgatatacataggagagaaactgatagaagaattctgatggcactgtatgatagaagctataaagtcaagtgtccattttctttcaactatat

SEQ ID NO: 12073 - DNA, 174 bp, Homo sapiens; identical to SEQ ID NO: 11671

SEQ ID NO: 12074 - DNA, 164 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaaccctgtctctgcaaaaaaaaaaaaaaaaaa

SEQ ID NO: 12075 - DNA, 163 bp, Homo sapiens; identical to SEQ ID NO: 11668

SEQ ID NO: 12076 - DNA, 170 bp, Homo sapiens; identical to SEQ ID NO: 11644

SEQ ID NO: 12077 - DNA, 240 bp, Homo sapiens
  misc_feature 224: n=a, g, c or t
gactgacaactmacacggctgggtactcttctgagacaaaacttccagaggagcgatcaggcagcaacatttgctgttcaccaatatcsattgttctgcagcctctgctgctgatacccaggcaaacagggtctggagtggacctccaaactccaacccacctgcagctgagggtcctgactgttagaaggaaaactacaaaacagaaaggacatccacaccanaaccccatctgtacat

SEQ ID NO: 12078 - DNA, 225 bp, Homo sapiens; identical to SEQ ID NO: 11617

SEQ ID NO: 12079 - DNA, 106 bp, Homo sapiens
gtcagacaataaagtctttgtaaaaagagaaaaaaaaaaaaaaaaaaaaaaaaaaaaaaaaaaaaaaaaaaaaaaaaaaaaasscytycccccccccccccccccc

SEQ ID NO: 12080 - DNA, 111 bp, Homo sapiens; identical to SEQ ID NO: 11571

SEQ ID NO: 12081 - DNA, 317 bp, Homo sapiens
  misc_feature 19: n=a, g, c or t
cagataaaagtctatgtvntggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaaaaaggc

SEQ ID NO: 12082 - DNA, 490 bp, Homo sapiens
actacttacgcgccaggcgcctctttggacgccactccacagcctcgtgtgttaagaggcacacaagagctgcctgattggccaccaagctgagaaccgggagccggagaaatcatagcgaaatctcaacctgatgtagccccatcagcatcacacacaaactcakagcaaaatggcctgctcttcaatgtagcttagtttagttcaattgtcctgcccaccccctcctgaccctcctgccgctgaggggtggtatttgaaagaacaggtgagtgcttcataggtgccgggttcgtgatctaattctgggttcctcaatctattaacagcttgggaagaacagatcagaggactgatgctcacctgggtttggattcstcctttagcctttgacaagttacttaactgagtaaatcctcaattttcaccatgataaaggaaagatggtgtgtgactattatgtttttattcsggattgaaattacwtcag

SEQ ID NO: 12083 - DNA, 115 bp, Homo sapiens
ctttaggtgtattaagatataaggccaggctgggsatggtggctcatgctgtaatcccagcactttgagtggctgaggtgggaggatsacttgagssmaggatttcaaggcgagc

SEQ ID NO: 12084 - DNA, 327 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgtttttgttttggggcattcagaagtctgacataaaaattaacttg

SEQ ID NO: 12085 - DNA, 221 bp, Homo sapiens; identical to SEQ ID NO: 11634

SEQ ID NO: 12086 - DNA, 242 bp, Homo sapiens
  misc_feature 236: n=a, g, c or t
acagagcaaaaatctgtctaaaaaaaaaaaagaagagactggcacatccatacaatggatgagccaactgttaaaaaaaaaagawtgaggggstgggcgtggtggctcacacctgtaatcccaggastttgggaggccgaggcgggcggatcatgaggtcaggagatcgaracsttcctggstaacacggtgaaaccctgtctctactaaaaatacacacacacacaaaaatttanctgggt

SEQ ID NO: 12087 - DNA, 83 bp, Homo sapiens
gtcagacaataaagtctttgtaaaaagagaaaaaaaaaaaaaaaaaaaaaaaaaaaaaaaaaaaaaaaaaaaaaaaaaaaaaa

SEQ ID NO: 12088 - DNA, 82 bp, Homo sapiens; identical to SEQ ID NO: 11689

SEQ ID NO: 12089 - DNA, 372 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaataaaaaag

SEQ ID NO: 12090 - DNA, 243 bp, Homo sapiens
atgcagcgcgcggcgatvgagttcaagaccagcctggccaacatggtgaaacctgtctctactaaaaatacaaaaattagctgggcgtggtggcgcacgctrtagatcccagctactcgggaggctgaagcagaagaattgcttgaacctgggaggcagaggttgcagtgagctgagatcaatgccactgcactctagcctgggtgacagagtgagactgcgtctaagaaaaaaaaaaaaaaa

SEQ ID NO: 12091 - DNA, 488 bp, Homo sapiens
attgggtttggggaagagaaaatcacttggcggcttccggatgaaatattcatctgttccccgaccccagccacttcctggagaagaacagtgagggggctccggcatcaggtctctctcgggtttgggcctttttagacgcaggtacagcggaagtttgtgaatgaagatctgcagagtagaagaggcgtattggtgggggctttcatgctttcagaccagaagggaaacagccaaccaccccactccacatgcccattcccgcgcgtgagtatgtgcgtgcatattcttccacaaacgagctacacaaggaaatgcagccacacagacctaagagctctttagtgggttgggcctgtcgcggtggctcacgcctgtaatcgcagcactttgggaggccaaggcaggtggatcacctgaggtcaggagttcaagaccagcctggcccaacatggtgaaacctctctctactaaaaatacaaaaattt

SEQ ID NO: 12092 - DNA, 124 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacac

SEQ ID NO: 12093 - DNA, 195 bp, Homo sapiens; identical to SEQ ID NO: 11632

SEQ ID NO: 12094 - DNA, 143 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtt

SEQ ID NO: 12095 - DNA, 200 bp, Homo sapiens; identical to SEQ ID NO: 11569

SEQ ID NO: 12096 - DNA, 368 bp, Homo sapiens
tagcttttaaacaaatttctttctaaacacaataaaaggagaaatttaattgttttgcttaagataaaaacctaagtaggctgggcgcggtggctcacgcctgtaatcccagcactttgggaggctgaggtgggtggataaggaggtcaggaggtcgagatcatcctggccaacatggtgaaaccccatggctactaaaaatacaaaaattagccagtgtagtggcgcgcacccgtagtcccagttactcaggagggtgaggcaggagaatcgcttgaacccaggaggtggaggttacagtgagctgacacagcaccgttgcagcttgggcgacagagcaagactcggtcttcaaaaaaaaaaaaaaa

SEQ ID NO: 12097 - DNA, 325 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaaaaaaaaaaaaa

SEQ ID NO: 12098 - DNA, 170 bp, Homo sapiens; identical to SEQ ID NO: 11644

SEQ ID NO: 12099 - DNA, 84 bp, Homo sapiens
aaaaaaaaaaaactacgaytacgggagctactccgggaacacacagggtggcacaaktacacaktagcsaktgtgacccagagg

SEQ ID NO: 12100 - DNA, 472 bp, Homo sapiens
attaacattttggtcaaagccattcaacaakwstcgaggaagttccaaactttcccacattttcctatcctcttctgagccttccaaactgttccagcctctccctgttacccatttccaaagttgcttccacattttcgggtatctttacagcagcaccccactctactggtatcaacttattgtattagtctgttctcacactgcaaataaagacatacctgagactgggtaatttataaaggaaagaggttgaattgactcacagttctgcatggctggggaggcctcacaatcatggtggaaggcaaggaggtgcaaaagcatgtctcacatagtggcaggcatgagagagcatgtgcaggggagctcccatttataaaaccatcagatctcatgagacttagtcactaccgcgagaacagtatggggggaacatcccmatgattcagttatctgcacccgggcccac

SEQ ID NO: 12101 - DNA, 379 bp, Homo sapiens
ccattagcctttccattttttttttcagttaataagaaacaatactgatagcaaaacttgsattgtgtgtgtgtgtgtgtgtgtgtgtgtattttttttgagacagagtcttgctctgtcactcatgckggagtssggtggcatgatcttggcttgctgsaacctccgcctcctgggttcaagctattcttatgcctcagcctccctagctgggactacaggtgcatgcctataatctcagctgcttgggaggctgaggcaggagaactgcttgaacctgggaagtgaaggatacggtgagccaagatcacaccgctgcactccagcctgggcaacaagagcaaaactctgtctcaaaaaataaataaataaaaattaa

SEQ ID NO: 12102 - DNA, 66 bp, Homo sapiens
gtcagacaataaagtctttgtaaaaagagaaaaataaaaaaaaaaaaaaaaaaaaaaaaaaaaaaa

SEQ ID NO: 12103 - DNA, 82 bp, Homo sapiens; identical to SEQ ID NO: 11689

SEQ ID NO: 12104 - DNA, 200 bp, Homo sapiens; identical to SEQ ID NO: 11569

SEQ ID NO: 12105 - DNA, 331 bp, Homo sapiens
aatggtagagacaggktttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggcagggtgagaatccatctcaaaaa

SEQ ID NO: 12106 - DNA, 74 bp, Homo sapiens
ctaaaaattagccaggcctggtggcaggtgactgtaatgccagctactcgggaggctgaggtaagagaattgct

SEQ ID NO: 12107 - DNA, 173 bp, Homo sapiens; identical to SEQ ID NO: 11575

SEQ ID NO: 12108 - DNA, 53 bp, Homo sapiens
ctaaaaattagccaggcctggtggcaggtgactgtaatgccagctactcggga

SEQ ID NO: 12109 - DNA, 201 bp, Homo sapiens
tgaatataattagtctcatttgakatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaaaaa

SEQ ID NO: 12110 - DNA, 251 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcmtgtaatctcagctactcgggaggctgagacaggagaattgcttgaacccgggagccggaggttgcagtgacccg

SEQ ID NO: 12111 - DNA, 115 bp, Homo sapiens
ctttaggtgtattaagatataaggccaggctgggcatggtggctcatgcctgtaatcccagcactttgagtggctgaggtgggaggatcacttgagcccaggatttcaatggcga

SEQ ID NO: 12112 - DNA, 478 bp, Homo sapiens
aagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgacatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatstaaagtaata

SEQ ID NO: 12113 - DNA, 304 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaacaagagtgaaacttcgtctccaaaaaaaaaaaa

SEQ ID NO: 12114 - DNA, 244 bp, Homo sapiens
ccgaggtgggtgtatcacctgaggtcaggagtttgagaccagcctggacaacatggtaaaaccccgtctctgctaaaaatacaagagttagctgggcgtggtggcaggcacctgtggtcccagctactcgggaggctgaggcaggagaattgcttgagcccaggaggcagaggttgcagtgagccaagatcatgcccctgcactccagcctaggcgacagagctagactctgtctcaaaaaaaa

SEQ ID NO: 12115 - DNA, 301 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcscagatacttgggaagctgaggtaggaagatcgcttgggcccaggagatgtaggttgcagtgagttgttatcacaccactgcactcctgcctgggtgacagagcaagagcctgtcgccaaaaaaa

SEQ ID NO: 12116 - DNA, 112 bp, Homo sapiens; identical to SEQ ID NO: 11643

SEQ ID NO: 12117 - DNA, 200 bp, Homo sapiens; identical to SEQ ID NO: 11569

SEQ ID NO: 12118 - DNA, 109 bp, Homo sapiens
ctttaggtgtattaagatataaggccaggctgggcatggtggctcatgctgtaatcccagcactttgagtggctgaggtgggaggatcacttgagcccaggatttcaag

SEQ ID NO: 12119 - DNA, 108 bp, Homo sapiens; identical to SEQ ID NO: 11990

SEQ ID NO: 12120 - DNA, 424 bp, Homo sapiens
  misc_feature 265: n=a, g, c or t
ttactttatagggtcttgtgaaaataaagcattagcatggtgcctagcatacaataaatataattattbtattatcaataatataaacatggagggcgattattagctcatttgctcctcaaaggtatgtaactcaataaagatgcattctcttctaatattaagtttccattgttaatacagaaatcgtccaggtgtggtggttcatgccagtaatctcagcacttgggaggctgaagtaggtagagagagcagttcaattttnttttctccctgcaggtgctgctgtcaagcttgaatgaaaggtatctcatgggtgggcgcgtggctcatgcctgcaatcccagcacttcgggaggccaagacaggcagatcgcttgagctcaggagtttgagaccagcctggacaaaaccccatccctgt

SEQ ID NO: 12121 - DNA, 159 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcacttcagcctgggtgacagagtgagactctgtcacaa

SEQ ID NO: 12122 - DNA, 324 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaaaaaaaaaaaaa

SEQ ID NO: 12123 - DNA, 376 bp, Homo sapiens
taactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgamstcattcccttacccccggcsagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgaa

SEQ ID NO: 12124 - DNA, 324 bp, Homo sapiens; identical to SEQ ID NO: 12122

SEQ ID NO: 12125 - DNA, 153 bp, Homo sapiens
taaatatattaaatatgtgtattatattaaatacagtattaaaaaaaaaagattgaggtggccaggcgcagtggttcatgtgtgtaatctaagcactttgggaggccgaggcagatggatcatttgaggtcaggaatttcagaccagcctgkc

SEQ ID NO: 12126 - DNA, 337 bp, Homo sapiens
ataatacataagatatggtattgtgtgcctgggctcttagacctagcatagtattttcaaggttaatgtgtagcatgagtcactacttcattcctttctgtgtctgagtaasattccattgtatggatatgccacattattcattcatcatttatggacattgggttatcagaattactttagagtaaaactgatgcttgaagaagtgtcagcaatggtcaggcgccaggggcccatgcctgtaatccaagcattttggaggccaacatgggaggatcacttgagcccaggagtcamgaccagcttgggcaacagtgcaagaccctgtatctaccca

SEQ ID NO: 12127 - DNA, 82 bp, Homo sapiens; identical to SEQ ID NO: 11689

SEQ ID NO: 12128 - DNA, 200 bp, Homo sapiens; identical to SEQ ID NO: 11569

SEQ ID NO: 12129 - DNA, 164 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacctgtctctgcaaaaaaaaaaaaaaaaaag

SEQ ID NO: 12130 - DNA, 77 bp, Homo sapiens; identical to SEQ ID NO: 12037

SEQ ID NO: 12131 - DNA, 82 bp, Homo sapiens; identical to SEQ ID NO: 11689

SEQ ID NO: 12132 - DNA, 200 bp, Homo sapiens; identical to SEQ ID NO: 11569

SEQ ID NO: 12133 - DNA, 113 bp, Homo sapiens
ctttaggtgtattaagatataaggccaggctgggcatggtggctcatgctgtaatcccagcactttgagtggctgaggtgggaggatcacttgagcccaggatttcaaggcga

SEQ ID NO: 12134 - DNA, 205 bp, Homo sapiens
gaagagcggcggcggcggcggcggcggtggcggaggcggacacattggcgtgagacctgggagtacgttgtgccaaatcattgccacttgccacatgagtgtaaatgatggcggatgcaagtatgtcctctgccgatgggaaaagcgattatggcctgcgaaggttttggcccgaaccgcgacttcaacaaaaaaaaaaaaaaaa

SEQ ID NO: 12135 - DNA, 52 bp, Homo sapiens
ctttakgtgtattaagatataatgmcacgctsggcatggtggctcatgccts

SEQ ID NO: 12136 - DNA, 200 bp, Homo sapiens; identical to SEQ ID NO: 11569

SEQ ID NO: 12137 - DNA, 82 bp, Homo sapiens; identical to SEQ ID NO: 11689

SEQ ID NO: 12138 - DNA, 321 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtccaa

SEQ ID NO: 12139 - DNA, 56 bp, Homo sapiens
aaaaaaaaaaaaaaaaaaaaaaaaaaaaaaaaaaaaaaaaaaaaaaaaaaaaaaaa

SEQ ID NO: 12140 - DNA, 104 bp, Homo sapiens
ctttaggtgtattaagatataaggccaggctgggcatggtggctcatgctgtaatcccagcactttgagtggctgaggtgggaggatcacttgagcccaggatt

SEQ ID NO: 12141 - DNA, 200 bp, Homo sapiens; identical to SEQ ID NO: 11569

SEQ ID NO: 12142 - DNA, 420 bp, Homo sapiens
gagacagagtcttgctctgtcgcccaggctgcagtgcggtggtgcaatctcggttcactgcaacctccgactcccaggctcaagcgattcttatgcctcagcctcccgagtggctgggattatgggcctgtgccaccattcatgggtagtttttctatttttagcagggacaggatttcgccatgtttgccaggctggtcttgaactcctgaccttaagtgatctgcctgcctgggcctcccaaagtgctgggattacaggcatgagccactgtgccaggcctattttattttatttatttatttttgagacaagatctcactctgttgctcaggctggagtgtagtggtgcgatcacagctcactgcagcctcaaatgcctgggctacaagagcaaaactccgtctcaaaaaaataaaa

SEQ ID NO: 12143 - DNA, 136 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagacc

SEQ ID NO: 12144 - DNA, 108 bp, Homo sapiens
ttaggcccaagaattacctgaacctgggacgtggaggttgcggtgagccaagatcgcaccactgtaccctagcctgggcaacagagtgactcttaaaaaaaaaaaaaa

SEQ ID NO: 12145 - DNA, 458 bp, Homo sapiens
  misc_feature 372: n=a, g, c or t
tcgcggccagaggcttacaggtccaggtggagaggccgggctggcagggcttcggcctccggcgtcgggaaatggcggcggggggcaggatggaggacttgagaaaatggaaaattaactgtaagacctggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattnaaagttcakacggttataatccttgggaaakttatttkgtggattctccatttactccttgaatgctacatccagtatcaccacag

SEQ ID NO: 12146 - DNA, 459 bp, Homo sapiens
  misc_feature 368..369,396,408,411,415,420,423: n=a, g, c or t
actgtggctcatgccctaatcccagcacttttgggaggtcaaggtgagcagaacacctgaggacaggagtttgagaccagcctgcccaacgtggtgaaacccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactctatagnnccccccactgagctgtggatgggcaanccccggtggatnccnsccnccccnacnccccactgagccctgggccccctcctcccttcctca

SEQ ID NO: 12147 - DNA, 373 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcmsagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaaaaagg

SEQ ID NO: 12148 - DNA, 171 bp, Homo sapiens
ctaaaaattagcsaggsctggtggcakgtgactgtaatgccagctactcgggaggctgaggtaagagaattgcttkaacctgggtggaagaagttgcagtgagccaagattgtgccactgcactcctgcctgggtgatakagtgacactccttctcaaaaaaaaaaaaaaa

SEQ ID NO: 12149 - DNA, 289 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagac

SEQ ID NO: 12150 - DNA, 57 bp, Homo sapiens
aaaaataaaaaaaaaaaaaaaaaaaaaaaaaaaaaaaaaaaaaaaaaaaaaaaaaaa

SEQ ID NO: 12151 - DNA, 173 bp, Homo sapiens; identical to SEQ ID NO: 11713

SEQ ID NO: 12152 - DNA, 207 bp, Homo sapiens; identical to SEQ ID NO: 11904

SEQ ID NO: 12153 - DNA, 284 bp, Homo sapiens
cacgagactccatctttaaaaaaaaacaagacgggccggcacgtggctcacgcctgtaatcccagcactgagaggccgatcacttgaggtcaggagttcgggaccagcctggccggcatggtggaaccccatctctactgaaaaatacaaaaattagccgggcatggtggcacacacctgtaatcgtagctggggcaggagaatcgcctgaacccgggaggcggasttgcagcgagccgagatcgtgccgctgcactccagcctgggcgacagagtgagactcc

SEQ ID NO: 12154 - DNA, 225 bp, Homo sapiens; identical to SEQ ID NO: 11617

SEQ ID NO: 12155 - DNA, 162 bp, Homo sapiens
  misc_feature 137: n=a, g, c or t
ctttaggtgtattaagatataaggccaggctgggcatggtggctcatgctgtaatcccagcactttgagtggctgaggtgggaggatcacttgagcccaggatttcaaggcgagcctgggacacatggtgaaacctngtctctgcaaaaaaaaaaaaaaaaa

SEQ ID NO: 12156 - DNA, 200 bp, Homo sapiens; identical to SEQ ID NO: 11569

SEQ ID NO: 12157 - DNA, 156 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaatatggtgaaacgtgtctctacgaaaaaaaaaaaaaaaaa

SEQ ID NO: 12158 - DNA, 200 bp, Homo sapiens; identical to SEQ ID NO: 11569

SEQ ID NO: 12159 - DNA, 307 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatttctactaaaaacacagaagttacctgggtgtggckacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaa

SEQ ID NO: 12160 - DNA, 98 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12161 - DNA, 91 bp, Homo sapiens
gtcagacaataaagtctttgtaaaaagagaaaaaaaaaaaaaaaaaaaaaaaaaaaaaaaaaaaaaaaaaaaaaaaaaaaaaawttttttt

SEQ ID NO: 12162 - DNA, 120 bp, Homo sapiens; identical to SEQ ID NO: 11842

SEQ ID NO: 12163 - DNA, 257 bp, Homo sapiens
tatattgtttcccaagaagttctacttggtttcatttcaaacctgcctggtttttttgtttgtttgtttttatttttgttttgagacgaagttggggtttcactcttgttgcccgggctggagtgcaatggcgtgatctcagctcactgcaacctccaccacctgggttcaagcaattctcctgcctcagcctcctgaggtcaggagtttaagaccagcctgacgaacatggagaatctccgtctctaataaatatr

SEQ ID NO: 12164 - DNA, 66 bp, Homo sapiens
aattgtgttcgcagccgccgccgcgccgccgtcgctctccaacgccagcgccgcctctcgctcgcc

SEQ ID NO: 12165 - DNA, 50 bp, Homo sapiens
ttggagttttgctctagagaactagtctcgagtttttttttttttttttt

SEQ ID NO: 12166 - DNA, 477 bp, Homo sapiens
ggagtaggattttaccgctggttctacctaggcgtagagctgtatctgcaaacaaccaggcaagaccgaaaaaagttaatgttcttaaaatatgcaagtggagcccgaaaatagttaaattcttggactaggaaggcatccttaaatgctcaagtctctggggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattgaaagttcagacggttataatccttgggaaagttattttgtggattctccatttactccttgaatgctacatcc

SEQ ID NO: 12167 - DNA, 118 bp, Homo sapiens
ctaaaaattagccaggcctggtggcaggtgactgtaatgccagctactcgggaggctgaggtaagagaattgcttgaacctgggtggaagaagttgcagtgagccaagattgtgccac

SEQ ID NO: 12168 - DNA, 383 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcctccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaaaaaaaaaaaag

SEQ ID NO: 12169 - DNA, 312 bp, Homo sapiens
taaaaggaagttcttggccgggcgcggtggctcatgcctgtaatcccagcactttgggaggccgaggtgggtggatcacgagatcaggagatcgagaccatcttggctaacacggtgaaaccccatctctactaaaaatacaacaaattggctgggcgcggtggcgggtgcctgtagtcccagctgctcgggaggctgaggcaggagaatggcctgaacccaggaggcggasttgcagtgagctgagatagtgccactgcactccggcctggtgaaagagcgagactccgtctcaaaaaaaaaaaaaaaaag

SEQ ID NO: 12170 - DNA, 371 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcmsagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaaaaa

SEQ ID NO: 12171 - DNA, 172 bp, Homo sapiens; identical to SEQ ID NO: 11573

SEQ ID NO: 12172 - DNA, 175 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcacttcagcctgggtgacagagtgagactctgtcacaaaaaaaaaaaaaaaaaa

SEQ ID NO: 12173 - DNA, 125 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacaca

SEQ ID NO: 12174 - DNA, 127 bp, Homo sapiens
  misc_feature 78: n=a, g, c or t
gttaaatattgtctaatcaggccgggcgcggtggctcacgtctgtggtcccggcactttgggagcctgaggcaggcgnatcatgaggtcaggagatcaagaccatcgtggcttacacggtgaaacca

SEQ ID NO: 12175 - DNA, 83 bp, Homo sapiens; identical to SEQ ID NO: 12087

SEQ ID NO: 12176 - DNA, 371 bp, Homo sapiens; identical to SEQ ID NO: 12170

SEQ ID NO: 12177 - DNA, 520 bp, Homo sapiens
tgattgctattaactctgacggttctgagtttactacagtggaattcattagtatgtgttatgtaagaatgaagagggaaagaacacgaagacatctttgtcttttctctttccctgaactcagttaattctgcctatttggtctgaaaagctctaataacaatgaaggcctggcagtaacttacaggatttcttttatacaaaaaagagaaaagaaaattaccaagtatttaaagacatggaaacttggaggactttcttgttcctaagtggtgactctaactggatgttcaggatggagtggttgctgaccctttgaacacagctattgtgctgggttaatattgtatttccgtctatagtttatcattcagggtgctgatctaaaacaaagcatccggtttatccagctagtccagaacatatccacttagcaacaaaaatacggataacgatttccttgcgcttgaattgctatggtttttttgttgttgtctagtggaatttcgttgtctcgtgg

SEQ ID NO: 12178 - DNA, 323 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaaaaaaaaaaaa

SEQ ID NO: 12179 - DNA, 163 bp, Homo sapiens
  misc_feature 137: n=a, g, c or t
ctttaggtgtattaagatataaggccaggctgggcatggtggctcatgctgtaatcccagcactttgagtggctgaggtgggaggatcacttgagcccaggatttcaaggcgagcctgggaacacatggtgaaaccntgtctctgcaaaaaaaaaaaaaaaaa

SEQ ID NO: 12180 - DNA, 58 bp, Homo sapiens
aaagaagaaaagatatataggkkgctcacgcctgtaatcccaaagtgctgggattaca

SEQ ID NO: 12181 - DNA, 159 bp, Homo sapiens
tacaaaaaattagctgggcgtggtggctggcgcctgtggtcccagctactcgggaggctgaggcaggagaatagtgtgaacccaggaggcggasttgcagtgagccaagatagtgccactgcacttcagcctgggtgacagagtgagactctgtcacaa

SEQ ID NO: 12182 - DNA, 160 bp, Homo sapiens
tattttcagtagggacggggttacaccatgttggccaggctggtctcgaactcctgacctcaagtgatccacccgcctcagtctcccaaagtgctgagattacaggcatgagtcactacgcccggccccatgtctggtttgtcttggatgtgtgagcagc

SEQ ID NO: 12183 - DNA, 317 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaaaaaaaaaaaaaa

SEQ ID NO: 12184 - DNA, 336 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagc

SEQ ID NO: 12185 - DNA, 111 bp, Homo sapiens
gtagtgactcatctcgggcagagcgctagggctccgagcgaaccagcgagcgagcgaacgagcgastcagccggggacccacggcccaatcaaaaaaaaaaaaaaaaaakt

SEQ ID NO: 12186 - DNA, 304 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaagactccatctcaaaaaaaaaaaaaaaaa

SEQ ID NO: 12187 - DNA, 157 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaacatggtgaaaccgtgtctctacgaaaaaaaaaaaaaaaaa

SEQ ID NO: 12188 - DNA, 304 bp, Homo sapiens; identical to SEQ ID NO: 12186

SEQ ID NO: 12189 - DNA, 161 bp, Homo sapiens
ctttaggtgtattaagatataaggctaggctgggcatggtggctcatgctgtaatcccagcactttgagtggctgaggtgggaggatcacttgagcccaggatttcaaggcgagcctgggacacatggtgaaacctgtctctgcaaaaaaaaaaaaaaaaa

SEQ ID NO: 12190 - DNA, 301 bp, Homo sapiens
gatagattaaaaattttctgggctgggcgcggtggctcatgcggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctca

SEQ ID NO: 12191 - DNA, 383 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaaaaaaaaaaaag

SEQ ID NO: 12192 - DNA, 372 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcmsagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaaaaag

SEQ ID NO: 12193 - DNA, 211 bp, Homo sapiens
  misc_feature 154: n=a, g, c or t
acattttcagattagggatgctcaacctgtataataataggatgacgaaaatgagaagtactacacaaatgatagttttttattacatatattgataccaaatgcccctacatgggaacagtgtacctctttcagttttttatttctcacaggngccaacatagttctgaacacatagtcagcccttgacatattaataaatatatggctc

SEQ ID NO: 12194 - DNA, 114 bp, Homo sapiens
ctaaaaattagccaggcctggtggcaggtgactgtaatgccagctactcgggaggctgaggtaagagaattgcttgaacctgggtggaagaagttgcagtgagccaagattgtg

SEQ ID NO: 12195 - DNA, 83 bp, Homo sapiens
gtcagacaataaagtctttgtaaaaagagaaaaaaaaaaaaaaaaaaaaaaaaaaaaaaaaaaaaaaaaaaaaaaaaaaaaar

SEQ ID NO: 12196 - DNA, 129 bp, Homo sapiens
ctttaggtgtattaagatataaggccaggctgggcatggtggctcatgctgtaatcccagcactttgagtggctgaggtgggaggatcacttgagcccaggatttcaaggcgagcctggtacacatggt

SEQ ID NO: 12197 - DNA, 443 bp, Homo sapiens
ctctgaggtgagggcgaggggcgcgggccggtgtgggccgcagagacgttggagccggcgggggctggggactggcctcggggcgacttgaggtgtccctggccagtgtccttccacctgtccacaagcatggggaacatcttcgccaacctcttcaagggcctttttggcaaaaaaagaaatgcgcatcctcatggtgggcctggatgctgcagggaagaccacgatcctctacaagcttaagctgggtgagatcgtgaccaccattcccaccatagkttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtga

SEQ ID NO: 12198 - DNA, 81 bp, Homo sapiens
gtcagacaataaagtctttgtaaaaagagaaaaaaaaaaaaaaaaaaaaaaaaaaaaaaaaaaaaaaaaaaaaaaaaaaaa

SEQ ID NO: 12199 - DNA, 173 bp, Homo sapiens; identical to SEQ ID NO: 11575

SEQ ID NO: 12200 - DNA, 363 bp, Homo sapiens
  misc_feature 321,361: n=a, g, c or t
caaaaactagccaggcagggctgggcgcggtggctcacgcctgtaatcccagcactttgggaggccgaggcgggcggatctcgaggtcaggagattgagaccatcccggctaacacggtgaaacccgtctctactaaaaatacaaaaaaaattagctgggcgtggtggcaggtgcctgtggtcccagctactcgggaggctgaggcagaagaatggcgtgaacttgggaggtggagcttacagtgagccgagatcacaccactgcactccagcctgggggacagagcgagactccgtctcaaaaaaaaaaaaaaaaayytncccaggcggscwtggtggtggcgcccwtctgwagtcccanct

SEQ ID NO: 12201 - DNA, 200 bp, Homo sapiens; identical to SEQ ID NO: 11569

SEQ ID NO: 12202 - DNA, 294 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgt

SEQ ID NO: 12203 - DNA, 360 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaa

SEQ ID NO: 12204 - DNA, 118 bp, Homo sapiens; identical to SEQ ID NO: 11692

SEQ ID NO: 12205 - DNA, 172 bp, Homo sapiens; identical to SEQ ID NO: 11573

SEQ ID NO: 12206 - DNA, 236 bp, Homo sapiens
attaagatcagcctgggtaatacagtgagaccccatctctagaaaaaataaaaaattagtcaaatgtggtgttagtcccagctacgtgggggactagtagtcccagctacttgggagggggagatgggaggattgcttgagcctgggaagcgaaggttgcagtaagatgagatcgtgccgctgcactccagcctgggtgacagagtgagactctgtctcttaggaaaaaaaaaaaa

SEQ ID NO: 12207 - DNA, 311 bp, Homo sapiens
  misc_feature 309: n=a, g, c or t
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaacaagagtgaaacttcgtctccaaaaaaaaaaaaaaaangy

SEQ ID NO: 12208 - DNA, 500 bp, Homo sapiens
gacctgggctgcagttaggttgtcgcctgcaggaggtgtgctgttgagggagaggaaaaccgtccgaggagaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcagaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggc

SEQ ID NO: 12209 - DNA, 439 bp, Homo sapiens
ttatgaatcctgatcttattatgctaagaggacactgctccctccctgctcagagtcatatgacaaagacttcgcatgtcagtacccgcagtgaagggggctaggccaactggctcctgtacatgcgtgcgtgcgtgtgtgtgtgtgtccctggctacagaaggggcagagggcaatcttgggggcagagggcaatcttgtttgaccgggccacatttattaagtacttaggactgtgtctagcacataataagtgctcaataaacggagatgccatgatcatttgtagctagttacatacccaatatccattcttcctatttttttccttaataacagattcagatcgtgctgcctggaatgaagacatttcccagtctctcttgcattttggtgtggccccgtgactacactatgttccatggactgtagcagtgaa

SEQ ID NO: 12210 - DNA, 163 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaaccctgtctcatgcaaaaaaaaaaaaaaaaa

SEQ ID NO: 12211 - DNA, 209 bp, Homo sapiens; identical to SEQ ID NO: 11886

SEQ ID NO: 12212 - DNA, 155 bp, Homo sapiens
tacaaaaaattagctgggcgtggtggcaggsgcctgtggtsscagctactcgggaggstgaggcaggagaatagtgtgaacccaggaggcggamttgcagtgagccaagatagtgscactgcacttcagsstgggtgacagagtgagactctgtc

SEQ ID NO: 12213 - DNA, 243 bp, Homo sapiens
atgcagcgcgcggcgatggagttcaagaccagcctggccaacatggtgaaacctgtctctactaaaaatacaaaaattagctgggcgtggtggcgcacgctgtagtcccagctactcgggaggctgaagcagaagaattgcttgaacctgggaggcagaggttgcagtgagctgagatcatgccactgcactctagcctgggtgacagagtgagactgcgtctaagaaaaaaaaaaaaaaaaa

SEQ ID NO: 12214 - DNA, 128 bp, Homo sapiens
ttaggcccaagaattacctgaacctgggacgtggaggttgcggtgagccaagatcgcaccactgtaccctagcctgggcaacagagtgactcttaaaaaaaaaaaaaaaaasaaaaaaaaaaaaaaaa

SEQ ID NO: 12215 - DNA, 508 bp, Homo sapiens
gactgacaactcacacggctgggtactcttctgagacaaaacttccagaggagcgatcaggcagcaacatttgctgttcaccaatatccattgttctgcagcctctgctgtgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaaagaagttaaaaaccttgaaaaaagattagatgaaagggct

SEQ ID NO: 12216 - DNA, 94 bp, Homo sapiens
ttakgsccaagaattasctgaacctgggacgtggaggttgcggtgagccaagatcgcaccactgtascctagcctgggcaacagartgactctt

SEQ ID NO: 12217 - DNA, 163 bp, Homo sapiens; identical to SEQ ID NO: 11668

SEQ ID NO: 12218 - DNA, 440 bp, Homo sapiens
cattttatcagaaaaggtaatgaagacagacagggggagactcaaatcatttttttagactcactcatttatttgcttaacaaacatttattgaacactgagcagcattctgaatgtgtgttggctgccgagcagcraacaagaaaacctatttttgcagtgcttcagaaacatgcagttamagaggwatgcagaacaggttctcagaagagagatgaggagccattcacatggaggaggtgttgaacatttggatatgccatgctcattctgggaagtttaatgaggagacgtgggagaaaaccagaaccatcaggacattgagatgcacccactttagagaatgaaggtatgaagataagacagggaagagaagagatcagaggaaaggaatgtatcccagggtagggcactagctgaatgacagttaacacaagagg

SEQ ID NO: 12219 - DNA, 192 bp, Homo sapiens; identical to SEQ ID NO: 11795

SEQ ID NO: 12220 - DNA, 225 bp, Homo sapiens; identical to SEQ ID NO: 11617

SEQ ID NO: 12221 - DNA, 162 bp, Homo sapiens; identical to SEQ ID NO: 11739

SEQ ID NO: 12222 - DNA, 443 bp, Homo sapiens
ttaaaataatacttagaggctgggtgaggtgctcacgcctgtaaccccagcactttgggaggccagggcgggtggatcacctgaggtcaggagttcaagaccagcctgaccagcatggtgaaaccccgtctttactaaaagtaccgagattggccaggcgtggtgggtcacgcctgtaatctcagcactttcggaggccgaggtgggcggatcatctgaggtcaggagttcgagaccatcctgaccggcatggcggaaccctgcctctactaaaaatacaaaaaaaattagtccgttgtggtggcagatgcctgtagtcccggctactcgggaagctaaggcaggagaatcgcttgaaccgaggaggcggaggttgcagtgagccgaaatcacgccactacactccagcctgggcgacaagagcaaaactccgtctcaaaaaa

SEQ ID NO: 12223 - DNA, 226 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaaaaaaaaaaaaaag

SEQ ID NO: 12224 - DNA, 200 bp, Homo sapiens; identical to SEQ ID NO: 11569

SEQ ID NO: 12225 - DNA, 78 bp, Homo sapiens; identical to SEQ ID NO: 11631

SEQ ID NO: 12226 - DNA, 127 bp, Homo sapiens
ctctgtaactctatgcctgtccctctcctctttatttctgtcttactaaattatacaacagatgatatatgcatatatatatacagctgtatataaatatatatattttaaatacagatagggtctc

SEQ ID NO: 12227 - DNA, 361 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcagagtgcacgcctgtaatccctgctactcgggaggctgaaacaggagaatcacttgaacccaggagacggaggttgcggtgagttgagattatgccactgtactccagcctgggtgacagagcgagactcagtctcaaaaaa

SEQ ID NO: 12228 - DNA, 134 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaa

SEQ ID NO: 12229 - DNA, 176 bp, Homo sapiens
tatatacattagctgggcatggtggtgcatgcctgtagtcgcagctgctcgggaggctgaggcaggagaatcgcttgaatctgggaggcggaggttgcagtgagccgagatcacatgacagcactccagcctgggtgacagacagagaccccatctcaaaaaaaaaaaaaaaaaag

SEQ ID NO: 12230 - DNA, 79 bp, Homo sapiens
ctttttcgcaacgggtttgccgccagaacacaggtgtcgtgaaaactacccctaaaagccaaaaaaaaaaaaaaaaarg

SEQ ID NO: 12231 - DNA, 63 bp, Homo sapiens
aaaaataaaaaaaaaaaaaaaaaaaaaaaaaaaaaaaaaaaaaaaaaaaaaaaaaaawttttt

SEQ ID NO: 12232 - DNA, 457 bp, Homo sapiens
gcgggcagatcatgaggtaaggagatcgagaccatcctggctaagacggtgaaacctgtctctactaaaaacacaaaaaattagctgggtgtggtggcagtcgcctgtggtcccagctactcgggaggctgaggcaggagaatggcgggaacctgggaggtggagcttgcagtgagccaaaatcacgccactgcactccagcctgggtgacagagtgagactctgtcccagaaaaaaaaaattgtggaacactttctgctgctcagtatgatgtgaaatctcaacaagcaaaaagattggctaggctgggagcagtggctcaggcctgtaatcccagcactttgggaggccaaggtgggtagattgcttcagctcaggagctctagaacagcctgggcaacatggcaaaacccagtctctaaaaaaatacaaaaattagttgggcgtggtggcacat

SEQ ID NO: 12233 - DNA, 172 bp, Homo sapiens; identical to SEQ ID NO: 11573

SEQ ID NO: 12234 - DNA, 343 bp, Homo sapiens; identical to SEQ ID NO: 11941

SEQ ID NO: 12235 - DNA, 174 bp, Homo sapiens
tacaaaaaattagctgggcgtggtggcaggcgcctgtggtcccagctactcgggaggctgaggcaggagaatagtgtgaacccaggaggcggasttgctgtgagccaagatagtgccactgcacttcagcctgggtgacagagtgagactctgtcacaaaaaaaaaaaaaaaaa

SEQ ID NO: 12236 - DNA, 313 bp, Homo sapiens; identical to SEQ ID NO: 12055

SEQ ID NO: 12237 - DNA, 383 bp, Homo sapiens; identical to SEQ ID NO: 12067

SEQ ID NO: 12238 - DNA, 380 bp, Homo sapiens
tttaaaaaataaataagtaaataaaattgagcctcattttttaacctaattgaaaatgggtgataaaaatgtatacattgcgaccaggtgcggtggctcacacttgtaatcccagcactttgggaggccaaggcaggtggatcacctgaggtcaggagttcaagaccagcctggccaacatggtgaaacttcgtctctattaaaaatacaaaaatcagccaagtgtggtggcacatgcctgtagtcccagctacccgggaggctgaggcaggagaatcgcttgaacttgggatgctgcagttgcagtgagctgagatcgcaccattgcactcctgcctgggtgacagagcaagactctgtctcaaaaaaaaaaaaaaaaa

SEQ ID NO: 12239 - DNA, 485 bp, Homo sapiens
ttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgtttttkgttttkgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaatttttttgtatttttagtagagacggggtttcaccgtgttagccaggatgatctcgatctc

SEQ ID NO: 12240 - DNA, 176 bp, Homo sapiens
tatatacattagctgggcatrgtggtgcatgcctgtagtcgcagstgctcgggaggctkaggcaggagaatcgcttgaatctgggaggcggaggttgcagtgagccgagatcacatgacagcactccagcctgggtgacagacagagaccccatctcaaaaaaaaaaaaaaaaaag

SEQ ID NO: 12241 - DNA, 372 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaacccaaaaaa

SEQ ID NO: 12242 - DNA, 171 bp, Homo sapiens; identical to SEQ ID NO: 11926

SEQ ID NO: 12243 - DNA, 163 bp, Homo sapiens
ctttaggtgtattaagatataaggccaggctgggcatggtggctcatgcctgtaatcccagcactttgagtggctgaggtrggaggatcacttgagcccaggatttcaaggcgagcctgggacacatggtgaaaccctgtctctgcaaaaaaaaaaaaaaaaa

SEQ ID NO: 12244 - DNA, 485 bp, Homo sapiens
ctttttcttttttaagagaggggatcttgctatgttgctcaggctagcttcaaactcctgggctcaaggggtcctcccgcctcagtctccccagtagctgggacgcaggtgcacaccgcctggcctggcttagagattgtccttcttattctgtaatcattggctagaagagggcatttcattgttgtgttttgtatttttcttattaaagaagtgtatcattttcaagtgttcattagctatttttagtttttccacaatttggttatcttttgtctatttttctgttagattgcatttttgattttgtagacactctttattactattattattattatttttcgaggcagggtctcactctgtcacccaggctggagtgcagtggcgtgatcttgtctcactgcaacctccgtctcctgggttcaagcgattttcttgcctcagcctcctgaatagctggggctacaggcatgtgcaccagg

SEQ ID NO: 12245 - DNA, 155 bp, Homo sapiens; identical to SEQ ID NO: 11702

SEQ ID NO: 12246 - DNA, 211 bp, Homo sapiens
  misc_feature 78: n=a, g, c or t
gttaaatattgtctaatcaggccgggcgcggtggctcacgtctgtggtcccggcactttgggagcctgaggcaggcgnatcatgaggtcaggagatcaagaccatcgtggcttacacggtgaaaccacgtctctactaaaaaaaaaaaaaattacaaaaaattcagccgggsatgatggcgggcacctgtagctcccagctattcgggagg

SEQ ID NO: 12247 - DNA, 353 bp, Homo sapiens
ataatacataagatatggtattgtgtgcctgggctcttagacctagcatagtattttcaaggttaatgtgtagcatgagtcactacttcattcctttctgtgtctgagtaacattccattgtatggatatgccacattattcattcatcatttatggacattgggttatcagaattactttagagtaaaactgatgcttgaagaagtgtcagcaatggtcaggcgccaggggcccatgcctgtaatccaagcattttggaggccaacatgggaggatcacttgagcccaggagtcaagaccagcttgggcaacagtgcaagaccctgtatctacccaaaaaaaaaaaaaaaaa

SEQ ID NO: 12248 - DNA, 314 bp, Homo sapiens; identical to SEQ ID NO: 11579

SEQ ID NO: 12249 - DNA, 225 bp, Homo sapiens; identical to SEQ ID NO: 11617

SEQ ID NO: 12250 - DNA, 173 bp, Homo sapiens; identical to SEQ ID NO: 11575

SEQ ID NO: 12251 - DNA, 104 bp, Homo sapiens
gtgtgttaagaaatgagctgtaggctcagtgcagtggctcatgcctgtaatcccagcactttgggaggctgaggtgggcggatcatgaggtaaggagttcgaga

SEQ ID NO: 12252 - DNA, 247 bp, Homo sapiens
aaaaggagaagactgatgttttaggtagggagttcgagaccagcctgaccaacatggagcaaccccatctctactaaaaatataattagccgggcgtggtggggcatgcttgtagtcccagctactcaggaggctgaggcaggagaatcacctgaacccaggagacagaggttgcagtgagccgagatcgccattgtactccagcctgggcaacaagaatgaaactccgtctcaaaaaaaaaaaaaa

SEQ ID NO: 12253 - DNA, 173 bp, Homo sapiens; identical to SEQ ID NO: 11575

SEQ ID NO: 12254 - DNA, 162 bp, Homo sapiens
ctaaaaattagccaggcctggtggcaggtgactgtratgccagctactcgggaggctgaggtaagagaattgcttgaacctgggtggaagaagttgcagtgagccaagattgtgccactgcactcctgcctgggtgatagagtgacactccttctcaaaaaa

SEQ ID NO: 12255 - DNA, 327 bp, Homo sapiens
catataacctttaaaaaataccatacatatttatgaatgcaatagttaaaaccagctataggagtacggctggcgtggtggctcatgcctgcaatctcagcactttgggaggcagaggcgggcggatcactcgaggtcaggagttcaggaccagcctggccaacatggtgaaacctgtctctactggggatacaaaaagtagctgggcatggtggccgcacgcctgtaatcccagctacttgggaggctgaggcaggagaatcgcttgaaccccggagcggaggttgcggtgagcggagattgcgccactgcactccggcctgtgta

SEQ ID NO: 12256 - DNA, 190 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaa

SEQ ID NO: 12257 - DNA, 200 bp, Homo sapiens; identical to SEQ ID NO: 11569

SEQ ID NO: 12258 - DNA, 200 bp, Homo sapiens; identical to SEQ ID NO: 11569

SEQ ID NO: 12259 - DNA, 225 bp, Homo sapiens; identical to SEQ ID NO: 11617

SEQ ID NO: 12260 - DNA, 170 bp, Homo sapiens; identical to SEQ ID NO: 11644

SEQ ID NO: 12261 - DNA, 93 bp, Homo sapiens
cactaatgactcaccttagaaggaaaagaaaaattttaatttacttaaaaattttttttttgattgaatagataattgtgtatatttgtggtt

SEQ ID NO: 12262 - DNA, 116 bp, Homo sapiens
cataagaatttataaacttgaaatagaaatattctattgtaaaggttaagaaaagtatacttggttggccaccgaggctcactaccataatcccagtacttcgggaggcagggtgg

SEQ ID NO: 12263 - DNA, 112 bp, Homo sapiens
ttaggcccaagaattacctgaacctgggacgtggaggttgcggtgagccaagatcgcaccactgtaccctagcctgggcaacagagtgactcttaaaaaaaaaaaaaaaacc

SEQ ID NO: 12264 - DNA, 159 bp, Homo sapiens
  misc_feature 16: n=a, g, c or t
aatggtagagacaggntttcaccatgttggccaagctggtctcaaactcctgacctcatgcctgtaatcccagcagtttgggaggccaaggcgggtggatcacctgagatcaggagttcaagaccagcctggccaacatggcgaaacccccattctact

SEQ ID NO: 12265 - DNA, 89 bp, Homo sapiens
aaacctaacttgcgcagaaaacaagatgagattggcatggctttatttgttttttttgttttgttttggtttttttttttttttgggct

SEQ ID NO: 12266 - DNA, 77 bp, Homo sapiens
gtcagacaataaagtctttgtaaaaagagaaaaaaaaaaaaaaaaaaaaaaaaaaaaaaaaaaaaaaaaaaaaaaaa

SEQ ID NO: 12267 - DNA, 438 bp, Homo sapiens
atcagccccggcgctctctcatcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgagagcaccgcgcccggcctgagtgagtcttaatccgtggccatctgcgttcctgcargcttcatctggccctatkgtcccctggcatcat

SEQ ID NO: 12268 - DNA, 365 bp, Homo sapiens
tatattgtttcccaagaagttctacttggtttcatttcaaacctgcctggtttttttgtttgtttgtttttatttttgttttgagacgaaktgggggtttcactcttgttgcccgggctggagtgcaatggcgtgatctcagctcactgcaacctccaccacctgggttcaagcaattctcctgcctcagcctcctgaggtcaggagtttaagaccagcctgacgaacatggagaatctccgtctctaataaatatacaaaattagccagacatggtgatgcatgcctgtaatcccagctactcaggaggctgaggcaggagaatcacttgaacccgggagttgaaggatgcagtgagctgagat

SEQ ID NO: 12269 - DNA, 302 bp, Homo sapiens
aaaaagtccctgggaagcggccgggcgcggttggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccacccca

SEQ ID NO: 12270 - DNA, 175 bp, Homo sapiens; identical to SEQ ID NO: 12058

SEQ ID NO: 12271 - DNA, 124 bp, Homo sapiens; identical to SEQ ID NO: 12092

SEQ ID NO: 12272 - DNA, 175 bp, Homo sapiens
tatatacattagctgggcatggtggtgcatgcctgtagtcgcagctgctcgggaggctgaggcaggagaatcgcttgaatctgggaggcggaggttgcagtgagccgagatcacatgacagcactccagcctgggtgacagacagagaccccatctcaaaaaaaaaaaaaaaaaa

SEQ ID NO: 12273 - DNA, 99 bp, Homo sapiens; identical to SEQ ID NO: 12001

SEQ ID NO: 12274 - DNA, 187 bp, Homo sapiens; identical to SEQ ID NO: 11697

SEQ ID NO: 12275 - DNA, 367 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagkgggaggatcacttcagcctgggagaccaaggctgcagtgagtcatgagtgtgccattgcaccccagtgtgggccacagagcgagaccttgtctccaaaaaaaaaaaaaccca

SEQ ID NO: 12276 - DNA, 78 bp, Homo sapiens; identical to SEQ ID NO: 11631

SEQ ID NO: 12277 - DNA, 98 bp, Homo sapiens
ccccttctccccggcggtyagtgctgagagtgcggagtgtgtgctccgggctcggaacacacatttattattaaaaaatccaaaaaaaaaaaaaaaaa

SEQ ID NO: 12278 - DNA, 401 bp, Homo sapiens
aggcggcgaagatggcggagaacagcggtcgcgccggcaagagcagcgggassgcgsgggaagggggcggtgtccgcagagcaggtgattgctggcttcaaccgccttcggcaggaacagcgaggcctggcatccaaagcagctgagttggagatggagttgaatgagcacagcctagtgatcgatacactgaaggaggtagatgaaactcgtaagtgctaccgcatggttggaggagtgctggtggagcgaactgtcaaagaggtgctgcccgctttggagaacaacaaggagcagatacagaagatcattgagacactgacacagcagcttcaggcaaagggaaaagaactaaatgaattccgggaaaagcacaacattcgtctcatgggagaagatga

SEQ ID NO: 12279 - DNA, 360 bp, Homo sapiens
gttgtttcggccgaggagccgtcgccgccatttcaagaccgtactaggtagatggtcaattagagttcccagggtttgaagcctggtaackgctgccgccgctcaagccctccagagcattgctacggctgctgcccttgtactactacctccaaatacgttcttgctggtagtggcggcasaggaccaattacctcttttttgctctccctcgagaagctccagatggcgtcttccgtgggcaacgtggccgacagcacagggttagctgagttggcacatcgagaatatcaggcaggagattttgaggcagctgagagacactgcatgcagctctggagacaagagccagacaatact

SEQ ID NO: 12280 - DNA, 341 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcaagtgcacgcctgtaatccctgctactcgggaggctgaaacaggagaatcacttgaacccaggagacggaggttgcggtgagttgagattatgccactgtactccagcctgggtgacagagc

SEQ ID NO: 12281 - DNA, 174 bp, Homo sapiens; identical to SEQ ID NO: 11611

SEQ ID NO: 12282 - DNA, 225 bp, Homo sapiens; identical to SEQ ID NO: 11617

SEQ ID NO: 12283 - DNA, 372 bp, Homo sapiens; identical to SEQ ID NO: 12192

SEQ ID NO: 12284 - DNA, 370 bp, Homo sapiens
  misc_feature 362..363: n=a, g, c or t
ttatgttttgaaagcaataaaaatcacccagtttcaaaactgcacaaagggtttgaatagagatttttccagagaggacatacagatggccagtagcacatcaacatgattggtcattaggaaatgcaagtcaaaaccaaaataagataccacttcataccaggtatcttattttacctagtatggctataatagtttaaagaaaaaagggaaataactgttggcaaggatgtggagaaatgggaacattgctgatgaaaatgtaaagtggtgtagccmtgtggaaaagggtttggcagttcctcccaaaggtgaacacagaaaccatatgtccagcaattccactcctacatatatatccnnaacaatt

SEQ ID NO: 12285 - DNA, 165 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgactcctgcctgggtgatagagtgacactccttctcaaaaaaaaaa

SEQ ID NO: 12286 - DNA, 200 bp, Homo sapiens; identical to SEQ ID NO: 11569

SEQ ID NO: 12287 - DNA, 488 bp, Homo sapiens
atgttttgtgcggcgcggagttaagcgccccggcagtaacttaagggaagtggaccagggttgccgctgcccagagcggtcctttagtttccactggagtgagggaagagtgctgccatggcasccctgcgcasccaagaaggtcgtggcccctacggtgtcccaaatcaatgcggagttcgtgacccagttagcatgtaaatactgggctccccacatcaagaagaaatcaccttttgatataaaggttattgaagatatatatgaaaaagagattgtcaaatcaaggtttgctattagaaagataatgctcttggaatttaggtaagttataaggcattccattgatgaaagagataatgtgatttcagttttagctaaattttctgtgttatttctgtgagtcactaagaaaatctaaatttgtgaagatttatatttctgtgattggcttattttggaatatgtatatgatagcctttgttttc

SEQ ID NO: 12288 - DNA, 310 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaa

SEQ ID NO: 12289 - DNA, 209 bp, Homo sapiens; identical to SEQ ID NO: 11886

SEQ ID NO: 12290 - DNA, 351 bp, Homo sapiens
  misc_feature 16: n=a, g, c or t
aatggtagagacaggntttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggcagggtgagaatccatctcaaaaaacaaaaaaaaaaaaaaaaag

SEQ ID NO: 12291 - DNA, 124 bp, Homo sapiens; identical to SEQ ID NO: 12092

SEQ ID NO: 12292 - DNA, 255 bp, Homo sapiens
atacaattagccaggtgtggcggcgtaatcccagctggcctgtaatcccagctacttgggaggctgaggcagaactgsttgaacccaggaggtggaggttgcagtgagccgtcatcgsgccactgagcsaagatcgcgcsactgcactccagcctgggcgacagagccakactgtctcaaataaataaatatgagataatgcagtcgggagaagggakggagagaattttattaaatgtgacgaactgcsccccc

SEQ ID NO: 12293 - DNA, 485 bp, Homo sapiens
  misc_feature 472: n=a, g, c or t
gactgacaactcacacggctgggtactcttctgagacaaaacttccagaggagcgatcaggcagcaacatttgctgttcaccaatatccattgttctgcagcctctgctstgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaaagangttaaaaaccttg

SEQ ID NO: 12294 - DNA, 174 bp, Homo sapiens; identical to SEQ ID NO: 11611

SEQ ID NO: 12295 - DNA, 300 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaa

SEQ ID NO: 12296 - DNA, 339 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtccaaaaaaaaaaaaaaaaaagy

SEQ ID NO: 12297 - DNA, 243 bp, Homo sapiens; identical to SEQ ID NO: 11807

SEQ ID NO: 12298 - DNA, 67 bp, Homo sapiens
gttaaatattgtctaatcaggscgggcgcggtggctcamgtctgtggtcccggcactttgggagcct

SEQ ID NO: 12299 - DNA, 78 bp, Homo sapiens; identical to SEQ ID NO: 11631

SEQ ID NO: 12300 - DNA, 170 bp, Homo sapiens; identical to SEQ ID NO: 11644

SEQ ID NO: 12301 - DNA, 200 bp, Homo sapiens; identical to SEQ ID NO: 11569

SEQ ID NO: 12302 - DNA, 174 bp, Homo sapiens; identical to SEQ ID NO: 11611

SEQ ID NO: 12303 - DNA, 309 bp, Homo sapiens
atatacaaatgtcggctgggcacggtggatcacacctgtaatcccagcactttgggaggccgaagcaggtggatcacgaggtcaggagattgagaccatcctggctaacacagtgaaactccgtctctactaaaaacagaaaaaattagctgggcatggtggcacgtgcctgtaatcccagctacttgggaggctgaggcaggagaatcgtttgaacctgggaggtggaggttgcagtgagccgcgatgctgagatcacgccactgcactccagcctgggtgacagagcgagactccgtctccgaaaaa

SEQ ID NO: 12304 - DNA, 74 bp, Homo sapiens
tktctaggctgascgtggtggctcacgcctgtactcctaccastttgggaggccaaggcaggcggatcatttga
